United States Patent 7,939,087 (NUCLEIC ACIDS AND PROTEINS FROM STREPTOCOCCUS GROUPS A & B) - sequence listing, part 4

SEQ ID NO: 9760 - protein, 427 aa, Streptococcus agalactiae
MSKHQEILEYLENLAVGKRVSVRSISNHLKVSDGTAYRAIKEAENRGIVETRPRSGTVRVAQKAKVNIEKLTYAEIARISDSQVVAGIEGLSKEFSKFSIGAMTHRNIEKYLVQGGLLIVGDRDEIQHLALQHQNAILVTGGFNVSPSVCRLADKLQIPVMVTHYDTFTVSTMINHTLSNAKIRTDLKTVEQVYQSQMDYGFLAQDDTVKEFNLLVKQTKNVRFPIVNQANVVVGVVSVQDILGKDKEVKLATVMSKNIIVAKPRMSLANISQKMIFEDLNMMPVVSDDFELLGVITRRQAVENLSMSQGTDLYTYSDQILSNLQIEDGHFSFLVEPAMIDHTGSLTQGVLTEFLKEICIRVLTRKHQRSIVVKQMTLYFLQPVQIDEIIMVTPTIISEKRREATLDLELKLENKIIAKAMIAVKIN

SEQ ID NO: 9761 - DNA, 750 bp, Streptococcus agalactiae
atgtgggaagttgaagaatacgttcgtagacgttgtaaagaagaaaacgtattgccattgcaaatcggggttgatggtgcagttatggattacccatatgctacttgttgtgggcttaatgatgaagtggctcatgcctttcctcgtcattataccctaaaacaaggtgaccttttaaaagtagatatggttttaagcgaacctttagataaatcaattgttgacgtttcatcgttaaactttgacaacgtggctcaaatgaaaaagtacacggaaacatatagtggtggtttggcagactcgtgttgggcttatgctgtaggtgaagtttcacaagaggtgaaagacttaatgtctgtgacaagagaagcaatgtatattgggattgaaaaagcagttatcggaaaccgcattggtgatattggagctgctattcaggattatgcagagagtcgtggttatggagttgttcgtgatttggttggtcacggtgttggtccaacaatgcatgaagagcctatggtgcctaactatggtacagcaggtcgaggtctccgtcttcgtgaggggatggttttaaccatcgaaccaatgattaatactggtacttgggaaattgatacagacatgaaaactggttgggcacataaaaccttagatggtggtctttcttgtcaatatgaacatcaatttgttatcactaaagatggtcctgttattttaacgagtcaaggagaagaaagaacttac

SEQ ID NO: 9762 - protein, 250 aa, Streptococcus agalactiae
MWEVEEYVRRRCKEENVLPLQIGVDGAVMDYPYATCCGLNDEVAHAFPRHYTLKQGDLLKVDMVLSEPLDKSIVDVSSLNFDNVAQMKKYTETYSGGLADSCWAYAVGEVSQEVKDLMSVTREAMYIGIEKAVIGNRIGDIGAAIQDYAESRGYGVVRDLVGHGVGPTMHEEPMVPNYGTAGRGLRLREGMVLTIEPMINTGTWEIDTDMKTGWAHKTLDGGLSCQYEHQFVITKDGPVILTSQGEERTY

SEQ ID NO: 9763 - DNA, 1944 bp, Streptococcus agalactiae
atgaatgaattagtatctttgttgaatcagtacgcaaaagagtattatacacaagataatcccacagtttctgacagtcaatatgaccagttatatcgagagttagtagaattagaaaagcaacatccagaaaacattttgccaaatagtcccacacatcgagtgggtggtttagttttagaaggctttgaaaaataccaacatgaatatcctttgtattcattgcaggatgctttctcaaaagaagaattgatagcctttgataaacgtgttaaagcagagtttccaactgctgcttatatggcagagctgaaaattgatggtctatctgtctcgttgacttatgtaaatggtgttttacaggttggggcaacacgtggtgatggcaatattggagaaaatattactgaaaatttaaagcgtgttcatgatattcctctacatttagaccaaagtttagatattactgttcgcggagagtgctaccttcccaaagaatcttttgaagctattaacatagaaaaacgagcaaatggtgagcaggaatttgctaatcctaggaatgcagcagcaggaaccttgcgccaattaaacacaggaattgttgcgaaacgtaaattagcaacttttctttatcaagaagctagccctacgcaaaaagaaacacaagatgatgttttaaaagagctagaaagctatggcttttcagtcaatcatcatcgtttaattagctcgtctatggagaaaatttgggattttatccaaactatagaaaaagatagagtttccctcccttatgatatcgatggtattgttattaaggttaatagcatagcaatgcaagaagagctgggcttcactgtaaaggcacctcgttgggcgattgcatataaatttcctgctgaagaaaaggaagcagaaatattatctgttgattggacagttgggcgaacaggagtcgtaacaccaacagctaacctaactccagttcaactagcagggacaaccgttagtagggccactctgcataatgtagattatattgccgaaaaagatatccgtattggagatactgttgttgtatacaaagcaggggatatcatccctgcagtcttaaatgtcgttatgagtaagcgaaaccagcaagaagtcatgcttattcctaaactatgtccttcttgtggtagtgaattagttcattttgaaggtgaggtggctttacgttgtattaatccgctgtgccccaaccaaatcaaagaacgtttagctcattttgctagccgagatgctatgaatattacaggttttggtccatccttagtcgaaaaattatttgatgctcatttaatagcagatgttgcagatatttatcgtttaagtatagagaatttattaactttagatggtattaaagagaaatctgcaactaagatttatcatgcaatccaatcttcaaaagaaaattctgctgaaaaacttctttttggcctaggtattcgtcatgtgggaagcaaggcgagccgccttttattggaggaatttggtaatttgaggcaactaagtcaagcaagtcaagaaagtattgcctcaattgatggactaggaggggttattgccaaatcacttcataccttctttgaaaaagaagaggtagataaactactagaggaattaacttcctataacgttaattttaattatctaggaaaacgagttagtacagatgcacaactttcaggtttaacagtcgttttaaccggtaagcttgaaaaaatgactcgtaatgaagcaaaagagaaattacaaaaccttggtgctaaggtgacaggtagcgtttctaaaaagactgatttaattgttgcaggaagcgatgcaggaagtaaactaaccaaggctcaagatttagggattacaatacaagatgaagactggttactcaacctt

SEQ ID NO: 9764 - protein, 648 aa, Streptococcus agalactiae
MNELVSLLNQYAKEYYTQDNPTVSDSQYDQLYRELVELEKQHPENILPNSPTHRVGGLVLEGFEKYQHEYPLYSLQDAFSKEELIAFDKRVKAEFPTAAYMAELKIDGLSVSLTYVNGVLQVGATRGDGNIGENITENLKRVHDIPLHLDQSLDITVRGECYLPKESFEAINIEKRANGEQEFANPRNAAAGTLRQLNTGIVAKRKLATFLYQEASPTQKETQDDVLKELESYGFSVNHHRLISSSMEKIWDFIQTIEKDRVSLPYDIDGIVIKVNSIAMQEELGFTVKAPRWAIAYKFPAEEKEAEILSVDWTVGRTGVVTPTANLTPVQLAGTTVSRATLHNVDYIAEKDIRIGDTVVVYKAGDIIPAVLNVVMSKRNQQEVMLIPKLCPSCGSELVHFEGEVALRCINPLCPNQIKERLAHFASRDAMNITGFGPSLVEKLFDAHLIADVADIYRLSIENLLTLDGIKEKSATKIYHAIQSSKENSAEKLLFGLGIRHVGSKASRLLLEEFGNLRQLSQASQESIASIDGLGGVIAKSLHTFFEKEEVDKLLEELTSYNVNFNYLGKRVSTDAQLSGLTVVLTGKLEKMTRNEAKEKLQNLGAKVTGSVSKKTDLIVAGSDAGSKLTKAQDLGITIQDEDWLLNL

SEQ ID NO: 9765 - DNA, 1137 bp, Streptococcus agalactiae
atgaaaaatgaaatgttagcactcattctcgccggaggacaaggcactcgactcggaaaattgactcagagcattgcgaaacctgctgttcaatttggaggtcgttaccgtattattgactttgcgctttcaaattgtgcgaattcaggtattaataatgttggagttattactcagtatcaaccgctggaactcaatactcatattggaaacggatctagctggggactagatggtatcgattcgggagtaactgtattacagccatattctgcaacagaaggtaatcgctggtttcaaggtaccagccacgctatctatcaaaatattgactacattgatcgtattaatccagaatatgtactcattctctctggggaccacatctataaaatgaactatgatgacatgctacagacgcataaagataatttagcaagcctaacagtcgctgttttagatgttcctttaaaagaagcaagccgttttggaattatgaatactgattcaaacgaccgtattgtcgaatttgaagaaaaacctgaacatcctaagtcaacaaaggcttcaatgggaatatacatttttgactggaagagattacggacagttttaattgatggtgaaaagaacggcatagacatgtcagactttggtaaaaatgttataccagcataccttgaatcgggtgaacgtgtttatacctataattttgatgggtattggaaagatgttggtactattgaatccctttgggaagctaatatggaatatattggagaagataacaaattacatagtcgtgatcgttcatggaaaatctattctaaaaatttgattgcaccacctaatttcatgacagaagatgcaaatgttaaagattctttagttgtagatggatgctttgttgcaggaaatgttgagcactccattttatcaactaatgtccaggtaaaaccaaatgctattattaaagactcctttgttatgagtggcgcgactatcggtgaaggtgcaaagataaatcgagctattatcggtgaggatgctgttattggtgatggtgttgtgattgatggaagtaaagaagtagaagttattggttataaagaagtagcgggggttccaaatgaagat

SEQ ID NO: 9766 - protein, 379 aa, Streptococcus agalactiae
MKNEMLALILAGGQGTRLGKLTQSIAKPAVQFGGRYRIIDFALSNCANSGINNVGVITQYQPLELNTHIGNGSSWGLDGIDSGVTVLQPYSATEGNRWFQGTSHAIYQNIDYIDRINPEYVLILSGDHIYKMNYDDMLQTHKDNLASLTVAVLDVPLKEASRFGIMNTDSNDRIVEFEEKPEHPKSTKASMGIYIFDWKRLRTVLIDGEKNGIDMSDFGKNVIPAYLESGERVYTYNFDGYWKDVGTIESLWEANMEYIGEDNKLHSRDRSWKIYSKNLIAPPNFMTEDANVKDSLVVDGCFVAGNVEHSILSTNVQVKPNAIIKDSFVMSGATIGEGAKINRAIIGEDAVIGDGVVIDGSKEVEVIGYKEVAGVPNED

SEQ ID NO: 9767 - DNA, 1269 bp, Streptococcus agalactiae
atggataaaattattgtggaaggtgggcaaacgcagcttcaaggtcaagttgttattgaaggagctaaaaatgcagttttacctcttttagcagccacaattttaccaagccaagggaaaacattgttgaccaatgttcctatcttgtctgatgtatttacaatgaacaatgttgttcgtggtttagatattcaagttgactttaattgcgataaaaaagaaatcttagtggatgcctcaggtgatattttagatgttgcaccttatgaatttgttagtcaaatgagagcttctattgttgttttgggacctattttagctagaaatggccatgctaaggtttcaatgccaggcggttgtacaattggtagccgaccaattgaccttcatcttaaaggtttagaagctatgggagctacgattacacaaaatggtggtgatattactgcccaagctgaaaagcttaagggagctaatatatacatggattttccctcagtcggtgccactcaaaacttaatgatggctgctacacttgcttcaggcacaacaacgatagagaatgctgcacgtgaaccagaaattgtagaccttgcgcagttactaaataaaatgggagctaaagtaaagggtgctggtacggaaacattaacgatcattggtgttgatgctttacatggtacagaacatgatgttgtccaagatcgtattgaagctggaacctttatggtggcagctgctatgacttctggaaatgttctagtaaaggatgctatttgggaacataaccgtcctttaatctctaaattgatggagatgggtgttgaagtgtcagaggaagaagatggtattcgtgtaaaagctgatactaaaaaattgaagccagtgactgtgaaaacactccctcatccaggatttcctactgatatgcaagctcaatttacagctctaatggcagtagttaatggcgaatcaactatgattgagacagtttttgaaaatcgttttcaacatttggaagaaatgcgtcgcatgggattacaaacggaaattttacgagatactgcaatgattcatggtgggagagctttacaaggtgcaccggtcatgtctactgacttacgagctagtgcagctttaatcttggcaggaatggttgcgcaagggcaaacagtagttggccaattaacccatttagaccgtggttattatcaattccatgaaaaattagcggctcttggtgctaatattaaacgtgtaagtgaggcg

SEQ ID NO: 9768 - protein, 423 aa, Streptococcus agalactiae
MDKIIVEGGQTQLQGQVVIEGAKNAVLPLLAATILPSQGKTLLTNVPILSDVFTMNNVVRGLDIQVDFNCDKKEILVDASGDILDVAPYEFVSQMRASIVVLGPILARNGHAKVSMPGGCTIGSRPIDLHLKGLEAMGATITQNGGDITAQAEKLKGANIYMDFPSVGATQNLMMAATLASGTTTIENAAREPEIVDLAQLLNKMGAKVKGAGTETLTIIGVDALHGTEHDVVQDRIEAGTFMVAAAMTSGNVLVKDAIWEHNRPLISKLMEMGVEVSEEEDGIRVKADTKKLKPVTVKTLPHPGFPTDMQAQFTALMAVVNGESTMIETVFENRFQHLEEMRRMGLQTEILRDTAMIHGGRALQGAPVMSTDLRASAALILAGMVAQGQTVVGQLTHLDRGYYQFHEKLAALGANIKRVSEA

SEQ ID NO: 9769 - DNA, 519 bp, Streptococcus agalactiae
atgtctcaaattacttttaaaaaggttggccttgataatgtgaatattttacagaatattgctatagaaacctttcggcagacgttttctcatgataatagtgaggaacaacttcaagcatttttcaatgagtcttacactttaccagtattaaaatcggaaattacccatgctgaatctgatacttattttgtttatcttgatacagatttagtgggttatttaaaagtaaactggggaagtcagcaaactgaaaaagatcttgataaagcatttgaaattcaaaggatttatcttctagatgcctaccaagggcaaggtataggtaaggctactttcgaatttgctttggatttagcttataaatcaggcttagattgggcttggttaggtgtttgggagtttaatcataaagctcaggcattttacgctaaatacggatttgaaaaattttctgagcaccaattttcagtaggtgataaagtggatacggattggttattaagaaaaagtttacac

SEQ ID NO: 9770 - protein, 173 aa, Streptococcus agalactiae
MSQITFKKVGLDNVNILQNIAIETFRQTFSHDNSEEQLQAFFNESYTLPVLKSEITHAESDTYFVYLDTDLVGYLKVNWGSQQTEKDLDKAFEIQRIYLLDAYQGQGIGKATFEFALDLAYKSGLDWAWLGVWEFNHKAQAFYAKYGFEKFSEHQFSVGDKVDTDWLLRKSLH

SEQ ID NO: 9771 - DNA, 3621 bp, Streptococcus agalactiae
atgacctttaagcctttcttaaatccagaagatattgctgttattcagacagaagaaaaaaattctgataaaaaacaaaagcgaacgcctgaacaaattgaagccatttatacttttggtaacaatgtcctggtatcagcttcggctggttctggaaagacttttgtaatggttgagcggattttagataaacttttaagaggggttccgattgactctttgtttatctcaacatttacagtaaaagcggcaggtgagctcaaagaacgtttagaaaagaaaataaacgagtctttgaaatccgcagaatcagatgatttaaaacagtttctcacccagcaacttgtcggcattcaaacagctgatattggtactatggatgcttttacgcaaaaaatagttaaccaatatggttatactttgggcatatcacctatatttaggattttacaagataaaaatgagcaagacgtcataaagaatgaggtctatgctgatttattttctgactacatgactgggaagaatgcagcttcattcataaaattagtcaaaaatttctcaggtaatcgtaaagatagcaaagcttttcgagaaatggtttataaagtttatgcttttagccagtccaccgataaccccaagcgctggatgcaaacagtttttctaaaaggtgcacaaacttacactgattttgaagctattccagatcaagaagtttcaagccttttaaatgtaatgcaaacaactgctaatcaattacgtgatttaacggatcaagaagattataagcaattaactgctaaaggggttccgacagcaaattacaaaaaacaccttaaaataattgaaaatttagtccattggtctcaagactttaatttgctgtatggaaaaaaaggattgactaatttggcacgtgatatcactaatgtgattccttcaggcaatgatgttacagttgctggcgttaaatatcctatctttaaacaattgcataatcgtatcgttggacttaagcacttagaagttatttttaagtatcaaggagaatctcttttcttgttagaattattgcaatcctttgttttagatttctcagaacaatatttacaggagaagattcaagaaaatgcttttgaattttctgatattgcccattttgcaattcaaatattggaagaaaatcatgatattaggcaactttatcaagataagtatcatgaagtaatggttgatgagtatcaggacaataaccatacccaagagagaatgttagaattattgtctaatggacataatcgtttcatggttggagacataaaacaatcaatttaccgttttcgtcaggctgatccacaaatttttaatgataaatacaaagcttaccaagacaatccaagtcaagggaaattaattattctgaaagagaattttcggagtcaatcagaggttttagacagtacaaatagtgtgtttacacatcttatggatgaagaagtaggagacattctttatgatgaaagtcaccaattaaaagctggtagtccaagacagcaagaaagacatccgaataataaaacacaagttttactattagatactgatgaagatgatatagatgacagtgatagtcaacaatatgatattagcccagctgaagcaaagttagtcgcaaaagaaattattcgattgcataaagaagagaatgttccctttcaagatatcaccctcttagtttcttcaaggacaaggaatgatggtatcttacaaacttttgaccgttatggtattcctttggtaactgacggtggggagcaaaattacttaaaatcagtcgaagtgatggtaatgcttgatactttgcggtcaattgataatcccttaaatgattatgctctagttgctcttttgagatctcccatgtttggctttaatgaagatgatttaacaagaattgctattcaggatgtcaaaatggctttttatcataaagtgaaattgtcttatcataaagaaggtcatcatagtgatttaattactccagaattatcttctaaaatagatcactttatgaaaacattccagacttggcgtgattttgctaaatggcattcgctttatgatttaatatggaaaatatataatgaccgtttttattatgattatgtaggagctctgcctaaagctgagcaacgtcaagccaatctatatgccttggcacttcgagcaaatcagtttgaaaaaacaggtttcaagggtttatcacgctttattcgaatgattgataaagttttagaaaatgaaaatgatttggcagatgttgaggtggcattaccgcaaaatgctgttaacctaatgactatacacaaatcaaaggggcttgagtttaagtatgtatttattttaaatattgataagaaattttcaatggtagacataacttcccctcttattttaagccgaaatcaaggaattggtattaaatatgttgctgatatgcgacatgaactcgaagaagagatactgcctgcagtaaaggttagcatggaaacacttccttaccaacttaataaaagagagttacgcttagctactttatcagagcaaatgcgtttactttacgtagctatgacacgtgcagagaaaaaattatatctggttggtaaggctagtcaaaccaaatgggctgatcattatgacttagtatctgaaaataatcatctcccattagctagtcgtgagacttttgtgacctttcaagattggttactggctgttcatgaaacctataagaaacaagagttgttttatgacatcaacttcgtatcattagaggaattaacagatcaccacatagggatggttaaccctagtctacctttcaatcccgataataaggtagagaatcgtcagtctgaagatatcgtgcgtgcgattagcgtgttagaatctgttgagcagattaatcaaacttataaagcggctattgagttaccgacagtgagaacaccaagtcaagtcaaaaaaatctatgagcctattctagatatagaaggtgttgatgtgatggaaactattactaaaacatcagtagattttaagttacctgatttttctacaagtaaaaagcaagacccagcagctttaggatctgctgtacatgaattaatgcaacgcatagagatgtcatctcatgtcaaaatggaagatattcaaaaagctttgacagaagtgaatgctgaaacaagtgtcaaagcggctattcagattgaaaaaatcaactattttttccaagaaacctcactcggtaagtatatacaagaagaagtagaacatctgcatcgagaggcaccttttgccatgttaaaagaagatccggagagtggtgagaaattcgttgtacgtggtattattgatgggtatctactattagaaaatcggataattctatttgattataagactgataaatttgtcaatcctctagaattaaaagaacgctatcagggacaaatggctttatatgcagaagctttaaaaaaatcttacgagatagaaaagatagacaaatacttaattcttttaggtggtaaacagctagaagtggtaaaaatggat

SEQ ID NO: 9772 - protein, 1207 aa, Streptococcus agalactiae
MTFKPFLNPEDIAVIQTEEKNSDKKQKRTPEQIEAIYTFGNNVLVSASAGSGKTFVMVERILDKLLRGVPIDSLFISTFTVKAAGELKERLEKKINESLKSAESDDLKQFLTQQLVGIQTADIGTMDAFTQKIVNQYGYTLGISPIFRILQDKNEQDVIKNEVYADLFSDYMTGKNAASFIKLVKNFSGNRKDSKAFREMVYKVYAFSQSTDNPKRWMQTVFLKGAQTYTDFEAIPDQEVSSLLNVMQTTANQLRDLTDQEDYKQLTAKGVPTANYKKHLKIIENLVHWSQDFNLLYGKKGLTNLARDITNVIPSGNDVTVAGVKYPIFKQLHNRIVGLKHLEVIFKYQGESLFLLELLQSFVLDFSEQYLQEKIQENAFEFSDIAHFAIQILEENHDIRQLYQDKYHEVMVDEYQDNNHTQERMLELLSNGHNRFMVGDIKQSIYRFRQADPQIFNDKYKAYQDNPSQGKLIILKENFRSQSEVLDSTNSVFTHLMDEEVGDILYDESHQLKAGSPRQQERHPNNKTQVLLLDTDEDDIDDSDSQQYDISPAEAKLVAKEIIRLHKEENVPFQDITLLVSSRTRNDGILQTFDRYGIPLVTDGGEQNYLKSVEVMVMLDTLRSIDNPLNDYALVALLRSPMFGFNEDDLTRIAIQDVKMAFYHKVKLSYHKEGHHSDLITPELSSKIDHFMKTFQTWRDFAKWHSLYDLIWKIYNDRFYYDYVGALPKAEQRQANLYALALRANQFEKTGFKGLSRFIRMIDKVLENENDLADVEVALPQNAVNLMTIHKSKGLEFKYVFILNIDKKFSMVDITSPLILSRNQGIGIKYVADMRHELEEEILPAVKVSMETLPYQLNKRELRLATLSEQMRLLYVAMTRAEKKLYLVGKASQTKWADHYDLVSENNHLPLASRETFVTFQDWLLAVHETYKKQELFYDINFVSLEELTDHHIGMVNPSLPFNPDNKVENRQSEDIVRAISVLESVEQINQTYKAAIELPTVRTPSQVKKIYEPILDIEGVDVMETITKTSVDFKLPDFSTSKKQDPAALGSAVHELMQRIEMSSHVKMEDIQKALTEVNAETSVKAAIQIEKINYFFQETSLGKYIQEEVEHLHREAPFAMLKEDPESGEKFVVRGIIDGYLLLENRIILFDYKTDKFVNPLELKERYQGQMALYAEALKKSYEIEKIDKYLILLGGKQLEVVKMD

SEQ ID NO: 9773 - DNA, 1374 bp, Streptococcus agalactiae
atgtctattacaaaagaatttgataccatcgcagctatttcaactcctctcggtgagggagctattggtattgtccgtatatctggtacagatgccttaaagatagcatcaaaaatttatcgtggaaaagatctatccgcgatccaatcccataccttaaactatggtcatattgtggacccagataaaaatgaaatcttggatgaagttatgttaggcgttatgcttgctccaaaaacattcacaagagaagatgttattgaaattaatacgcatggaggaattgcagttactaacgaaattcttcagttaattttacgacatggagcacgaatggctgaaccaggagaatttactaaacgtgcttttttaaatggtcgagttgacttgactcaggctgaagctgttatggatcttattagagctaaaacagataaagcaatggatattgccgttaagcaattagatggttctttaaagacactaatcaataacactcgacaagaaattttaaatactctagcccaagttgaagttaatatcgattaccctgaatatgatgacgttgaagagatgactacaacactgatgcgtgaaaaaacacaagagtttcaagcacttatggaaaatttacttcgaactgccagacgtggaaaaattcttcgagaaggactttcaacagcaatcattggtcgtccaaatgtcggtaaatccagcttactaaataacctcttacgtgaagaaaaggcgattgtgacagatattgaaggaacaactcgtgatgttattgaagaatacgtcaatattaaaggagttcctttaaaactagttgacactgctggtatccgtgatacagatgatatcgttgaaaaaattggtgttgaacgttcaaagaaggctttagaagaagccgaccttgtgttgttggttctcaatagttccgaaccactaacattacaagaccgctcccttctagaactaagtaaagaaagtaatcgtatcgtattactcaataaaacggatcttcctcaaaaaatagaagttaacgaattacctaaaaatgttattccaatttcggttttagaaaatgaaaacatcgataaaatcgaagaacgtattaacgatattttctttgacaacgctggtatggtagaacatgacgctacttatctatcaaatgctcgccatatctcactaattgaaaaagccgttgatagtttaaaagctgtcaatgagggcttggaattaggaatgcctgttgatctcttacaagtcgatatgactagaacttgggaaatacttggagaaatcactggggatgcagctccagatgaactaataactcagctcttcagccaattctgcttaggtaaa

SEQ ID NO: 9774 - protein, 458 aa, Streptococcus agalactiae
MSITKEFDTIAAISTPLGEGAIGIVRISGTDALKIASKIYRGKDLSAIQSHTLNYGHIVDPDKNEILDEVMLGVMLAPKTFTREDVIEINTHGGIAVTNEILQLILRHGARMAEPGEFTKRAFLNGRVDLTQAEAVMDLIRAKTDKAMDIAVKQLDGSLKTLINNTRQEILNTLAQVEVNIDYPEYDDVEEMTTTLMREKTQEFQALMENLLRTARRGKILREGLSTAIIGRPNVGKSSLLNNLLREEKAIVTDIEGTTRDVIEEYVNIKGVPLKLVDTAGIRDTDDIVEKIGVERSKKALEEADLVLLVLNSSEPLTLQDRSLLELSKESNRIVLLNKTDLPQKIEVNELPKNVIPISVLENENIDKIEERINDIFFDNAGMVEHDATYLSNARHISLIEKAVDSLKAVNEGLELGMPVDLLQVDMTRTWEILGEITGDAAPDELITQLFSQFCLGK

SEQ ID NO: 9775 - DNA, 1908 bp, Streptococcus agalactiae
atgattatactacaaggaaacaaaattgagcgctcattttcaggtgatgtgctttttgataatattaatattcaagttgatcaacgtgatcgtattgctcttgttggacgtaatggtgctggcaaatcaacgcttcttaaaattttagttggtgaagaggctccgacaaaaggagaaataaataaaaagcgtgatttgagtttgtcctacttggcacaagatagtcgttttcaatctgaaaatacaattttccaagaaatgttacaagtttttgactcattaagagaagtagagaagcgcttacgtgaattggaattacaaatggggcaagtttcaggaagtgacctggaacaattgatgaaaacatacgatattttgtcagaagagtttcgtgaaaaaggtggctttacctatgaatcagatataaaggctattttaaatggttttaagtttaacagtgatatgtgggaaatgcctattagtgaattgtctggcgggcaaaatacacgattagcgcttgcaaaaatgctacttgaaaagccagaattacttgttttagatgaaccaacgaaccatttagacattgatacgattgcttggttagaaaattatcttgtaaattatcaaggagcccttattattgtcagccatgaccgctattttttagacaaggtagctacagtaacttatgatttaacgacacattctctagaccgctatgtaggcaattattcgaaatttatggatcttaaggcagagaaaatagcgactgaagaaaagaattttgaaaaacaacaaaaagaaattgctaagttagaagattttgtacaacgtaacattgttagggcttcaaccactaaacgagcacaagctcgtcgtaaacaattagaaaagatggaacgactcgacaaaccgaatgtagagcaaaaatcagctaatatgacttttcatgctgggaaagtctcagggaatgttgttttaacacttgagaatgcagctattggttatgaaggtgtttctttatcggagccaatcgatttggacgtgaagaaatttgatgctattgcaattgtaggtccaaatggtatcgggaaatcaactttaatcaaatcgcttgttgggcaaattccttttatcaaaggagaagcaaaattaggagcaaatgtcgaaactgggtattacgatcaaagtcaaagtaatttaacaaaaacgaatactgttttagatgagttatgggatgctttttcaacaacgccagaagttgaaattagaaaccgtttaggagcttttcttttttcaggtgatgatgttaaaaaatcagtttcaatgctatcaggtggtgaacgagcgcgtttgctattggcaaaattatctatggaaaataataattttctcatattagatgagccaacaaaccacttggatattgatagtaaagaagtcttagaaaatgcactcatcgaatttgatggcacattactttttgttagtcatgatcgctattttattaatcgtgtggcaactaaggttctcgaaatttctgataagggaagtactctctatctaggagattatgattattacctcactaagaaagccgaactagaggaattagcacgtttaaatgaagaagaagtgagtgcttcaaaaacagaaatcgacgttacatcagattatgagacacaaaaagcaaatcaaaaggaatttaggaaaattacccgtcgcgttgtagaaattgaggcgcgtttggaagttcttgaaaatgatgaaaacaatatcaatggtttaatgttagaaaccaatgacatcggaaaactctctgatttgcaaaaagagctggaatcaatccaagaagaacaattgctattaatggaagagtgggaaaatctaaatatgagactagatttg

SEQ ID NO: 9776 - protein, 636 aa, Streptococcus agalactiae
MIILQGNKIERSFSGDVLFDNINIQVDQRDRIALVGRNGAGKSTLLKILVGEEAPTKGEINKKRDLSLSYLAQDSRFQSENTIFQEMLQVFDSLREVEKRLRELELQMGQVSGSDLEQLMKTYDILSEEFREKGGFTYESDIKAILNGFKFNSDMWEMPISELSGGQNTRLALAKMLLEKPELLVLDEPTNHLDIDTIAWLENYLVNYQGALIIVSHDRYFLDKVATVTYDLTTHSLDRYVGNYSKFMDLKAEKIATEEKNFEKQQKEIAKLEDFVQRNIVRASTTKRAQARRKQLEKMERLDKPNVEQKSANMTFHAGKVSGNVVLTLENAAIGYEGVSLSEPIDLDVKKFDAIAIVGPNGIGKSTLIKSLVGQIPFIKGEAKLGANVETGYYDQSQSNLTKTNTVLDELWDAFSTTPEVEIRNRLGAFLFSGDDVKKSVSMLSGGERARLLLAKLSMENNNFLILDEPTNHLDIDSKEVLENALIEFDGTLLFVSHDRYFINRVATKVLEISDKGSTLYLGDYDYYLTKKAELEELARLNEEEVSASKTEIDVTSDYETQKANQKEFRKITRRVVEIEARLEVLENDENNINGLMLETNDIGKLSDLQKELESIQEEQLLLMEEWENLNMRLDL

SEQ ID NO: 9777 - DNA, 966 bp, Streptococcus agalactiae
atggtaactctatctaaagaacaacacttggatatgtttctaaaaatgcaacgtattcgtgatgttgatatgaaatttaacaaattggttcgtcgtggtttcgtccaagggatgactcacttctctgttggtgaagaagctgcttcagtaggtgctatccaagatttaacagattcagatatcattttctcaaaccaccgtggacacggacaaactattgcaaaaggtattgatattggtggaatgtttgctgaacttgctggtaaagcaacaggaacatcaaaaggtcgtggaggctcaatgcacttagcaaaccttgaaaaaggtaactatggaacaaacggtatcgtcggtggaggatatgcgcttgcagtaggtgctgcccttacacagcaatatgaaggaactgataacattgttatcgccttttcgggtgactcagcgactaacgagggctcattccatgagtcagttaacttagctgctgtttggaacttaccagttatcttctttatcatcaacaaccgttatggtatctcaacagacatcacatactcaactaaaattcctcacctttacatgcgtgctgatgcgtacggtattccagggcattatgttgaagatggtaatgaccttatggctgtttacgagaaaatgcatgaagttatcaattacgtgcgttcaggaaatggaccagctattgtagaggttgaatcataccgttggtttggtcattcaactgctgatgctggggtataccgtactaaagaagaagttgattcatggaaagctaaagatccagtaaaacgctaccgtgcatacttaattgaaaatgaaatcgctactgaagaagagcttgcagctattgaagcacaagtgattaaagaagttgaagaaggggttaaattcgctgaagaaagtccattccctgatatgtctgttgcatttgaagacgtttttgtggac

SEQ ID NO: 9778 - protein, 322 aa, Streptococcus agalactiae
MVTLSKEQHLDMFLKMQRIRDVDMKFNKLVRRGFVQGMTHFSVGEEAASVGAIQDLTDSDIIFSNHRGHGQTIAKGIDIGGMFAELAGKATGTSKGRGGSMHLANLEKGNYGTNGIVGGGYALAVGAALTQQYEGTDNIVIAFSGDSATNEGSFHESVNLAAVWNLPVIFFIINNRYGISTDITYSTKIPHLYMRADAYGIPGHYVEDGNDLMAVYEKMHEVINYVRSGNGPAIVEVESYRWFGHSTADAGVYRTKEEVDSWKAKDPVKRYRAYLIENEIATEEELAAIEAQVIKEVEEGVKFAEESPFPDMSVAFEDVFVD

SEQ ID NO: 9779 - DNA, 858 bp, Streptococcus agalactiae
atgttagaagagtttggtgctaagcgcgttcgcgacacaccaatctcagaggctgcgattgcaggttcagctatcggtgctgcacaaacaggtttgcgtcctatcgttgatttgacattcatggattttgtaacaatcgcaatggatgctatcgttaaccaaggtgctaaaacgaattatatgtttggtggaggtctatcaactccagttactttccgtgtggcatcagggtcaggtattggttcggctgcacaacactcacaatcattagaagcttggttaacacacattccaggtctaaaagttgttgcacctggtactgttaatgagtcaaaagcacttttgaaatcttctattcttgacaataacccagttatcttcttagagccaaaagctctctatggtaagaaagaagaagttaatatggaccctgatttctatattccacttggtaaaggggatattaagcgtgaggggactgacttaacaattgtttcttatggccgtatgcttgagcgtgttatgcaagctgctgaagaagttgctgaggaaggtattaacgttgaggttgttgatccacgtacacttattccgcttgataaagaattaattatcgattctgttaagaaaactggtaaattgatcttggttaacgatgcttataaaactggtggtttcactggtgaaattgcaactatggttgctgaaagtgaagcatttgattaccttgatcatcctatcgtgcgtcttgcaagtgaagatgttccagtaccgtattcacgtgtacttgaacaaggaatcttacctgatgtagcaaaaattaaagatgctatctataaagtagttaacaaaggtaaa

SEQ ID NO: 9780 - protein, 286 aa, Streptococcus agalactiae
MLEEFGAKRVRDTPISEAAIAGSAIGAAQTGLRPIVDLTFMDFVTIAMDAIVNQGAKTNYMFGGGLSTPVTFRVASGSGIGSAAQHSQSLEAWLTHIPGLKVVAPGTVNESKALLKSSILDNNPVIFLEPKALYGKKEEVNMDPDFYIPLGKGDIKREGTDLTIVSYGRMLERVMQAAEEVAEEGINVEVVDPRTLIPLDKELIIDSVKKTGKLILVNDAYKTGGFTGEIATMVAESEAFDYLDHPIVRLASEDVPVPYSRVLEQGILPDVAKIKDAIYKVVNKGK

SEQ ID NO: 9781 - DNA, 1278 bp, Streptococcus agalactiae
atgggacgtggctctacttatccgggtagtttagcactcaaattcgataaagatatactagatacaattgccaaagattatgaaattgtagttgtgactggtactaacggtaaaaccttaacaacagctttaacagttggtattttaaaggaagccttcggtcaggtggtaaccaacccaagtggagcaaatatgattacaggtattgtttcgaccttcctaacagctaagaaaagtaaatctggtaaaaaaatagctgtccttgaaatagacgaagcgagtttaccccgtattacacagtatataaagcctagtttgttcgtctttaccaatattttccgtgatcaaatggaccgttatggcgaaatctacacaacttatcaaatgattttagatggagctgctaacgctccgcaagctactatcttagctaacggtgacagtccactttttaattctaaaagcgtgactaaccctgtgcaattctatggatttaataccgacaaacatgagccacgattagcacactataatactgagggtattctctgtccaaagtgtcaagcaattttaacttatcgattgaacacatatgccaaccttggtgactacacttgtcctaattgtgattttgaacgtccaaaccttgattatgccttaacaaggctaacacatctgacaaatacttcatcaggtttcgttattgatggccaacaatataatatcaacgtgggtggcctttataatatttacaatgctttggcggcagtatctgttgctgaatattttggtgtagaaccaagtcaaattaaggatggatttgataaaagccgtgccgtttttggtcgtcaagaaacctttacaattggaaataaaaaatgtactttagttctgattaaaaatccggtaggagctagtcaagctcttgatatgattaaacttgctccatacccgttctctctctcagtactactgaatgccaattatgctgacggtattgatacttcttggatttgggacgctaattttgaaactattctcacgatgaatatcccagaaatatttgctggtggtgttcgccactctgaaattgctcgtcgcttacgtgtaactggttatgatgagaaacgcataaaacaagctgataaactgcaagatattatgacaatgattgagcagcaagagactgagcatgcttatattttagcaacatatacagctatgctggagtttcgtgaaattcttgctaaccacaacgctatcagaaaggagatgaat

SEQ ID NO: 9782 - protein, 426 aa, Streptococcus agalactiae
MGRGSTYPGSLALKFDKDILDTIAKDYEIVVVTGTNGKTLTTALTVGILKEAFGQVVTNPSGANMITGIVSTFLTAKKSKSGKKIAVLEIDEASLPRITQYIKPSLFVFTNIFRDQMDRYGEIYTTYQMILDGAANAPQATILANGDSPLFNSKSVTNPVQFYGFNTDKHEPRLAHYNTEGILCPKCQAILTYRLNTYANLGDYTCPNCDFERPNLDYALTRLTHLTNTSSGFVIDGQQYNINVGGLYNIYNALAAVSVAEYFGVEPSQIKDGFDKSRAVFGRQETFTIGNKKCTLVLIKNPVGASQALDMIKLAPYPFSLSVLLNANYADGIDTSWIWDANFETILTMNIPEIFAGGVRHSEIARRLRVTGYDEKRIKQADKLQDIMTMIEQQETEHAYILATYTAMLEFREILANHNAIRKEMN

SEQ ID NO: 9783 - DNA, 324 bp, Streptococcus agalactiae
atgcgaatgattttaatgtttgatatgcctactgaaacagcagaagaacggaaggcgtatcgtaagtttagaaagtttctcttgagcgaaggctttatcatgcatcagttttctgtttatagtaaattattactcaataatacagctaataatgctatgataggtcggcttaaagtgaataatcctaaaaagggtaatatcacactcttaacagttacggaaaaacaatttgcgagaatggtttacctccatggagaacgcaacacaagtgttgccaactctgatagtcgcttggttttcctaggagattcttatgatcaagat

SEQ ID NO: 9784 - protein, 108 aa, Streptococcus agalactiae
MRMILMFDMPTETAEERKAYRKFRKFLLSEGFIMHQFSVYSKLLLNNTANNAMIGRLKVNNPKKGNITLLTVTEKQFARMVYLHGERNTSVANSDSRLVFLGDSYDQD

SEQ ID NO: 9785 - DNA, 609 bp, Streptococcus agalactiae
atggttcaccataaattaaaaaatgatccaagtggccatgactggtttcatattgttagagtaagaaatcttgcggtagaattagcacacaaagaaggggctaatacctttatttgtcaaatggctgcacttttgcatgatattattgatgacaaaatctgccaagatagtaagcaagcgtcgtatgaattgactcaatggttatatagtcaagatcttgccatagcagaagtagaacatatccttgatattcttgaaaatatttcattcaaagcaggaactggattgactatgaaaacattggaaggtcaaattgttcaagatgcagatcgcctagatgctatgggggctattggtattgcaagaacgatggcttattcagggagtaaaggacgtttaattcatgaccctaacttaaaaccacgagaaaacctcactttagaagagtatcgtaatggtcaggatacagctatcattcatttttacgaaaaattattaaagttaaaagaccttatgaatacaaaacaagggaaaatgcttgctcaaaaacgtcatgattttttagaactatatttagccgaattttatgctgaatggaatggtaaacgt

SEQ ID NO: 9786 - protein, 203 aa, Streptococcus agalactiae
MVHHKLKNDPSGHDWFHIVRVRNLAVELAHKEGANTFICQMAALLHDIIDDKICQDSKQASYELTQWLYSQDLAIAEVEHILDILENISFKAGTGLTMKTLEGQIVQDADRLDAMGAIGIARTMAYSGSKGRLIHDPNLKPRENLTLEEYRNGQDTAIIHFYEKLLKLKDLMNTKQGKMLAQKRHDFLELYLAEFYAEWNGKR

SEQ ID NO: 9787 - DNA, 1917 bp, Streptococcus agalactiae
atgaaaattattaatattggagttttagctcatgttgatgcaggaaaaactaccttaacagaaagcttattatataacagtggagcgattacagaattaggaagcgtggacaaaggtacaacgaggacggataatacgcttttagaacgtcagagaggaattacaattcagacaggaataacctcttttcagtgggaaaatacgaaggtgaacatcatagacacgccaggacatatggatttcttagcagaagtatatcgttcattatcagttttagatggggcaattctactgatttctgcaaaagatggcgtacaagcacaaactcgtatattatttcatgcacttaggaaaatggggattcccacaatcttttttatcaataagattgaccaaaatggaattgatttatcaacggtttatcaggatattaaagagaaactttctgccgaaattgtaatcaaacagaaggtagaactgtatcctaatatgtgtgtgacgaactttaccgaatctgaacaatgggatacggtaatagagggaaacgatgaccttttagagaaatatatgtccggtaaatcattagaagcattggaactcgaacaagaggaaagcataagatttcataattgttccctgttccctgtttatcacggaagtgcaaaaaacaatatagggattgataaccttatagaagtgattacgaataaattttattcatcaacacatcgaggtccgtctgaactttgcggaaatgttttcaaaattgaatatacaaaaaaaagacaacgtcttgcatatatacgcctttatagtggagtactacatttacgagattcggttagagtatcagaaaaagaaaaaataaaagttacagaaatgtatacttcaataaatggtgaattatgtaagattgatagagcttattctggagaaattgttattttgcaaaatgagtttttgaagttaaatagtgttcttggagatacaaaactattgccacagagaaaaaagattgaaaatccgcaccctctactacaaacaactgttgaaccgagtaaacctgaacagagagaaatgttgcttgatgcccttttggaaatctcagatagtgatccgcttctacgatattacgtggattctacgacacatgaaattatactttctttcttagggaaagtacaaatggaagtgattagtgcactgttgcaagaaaagtatcatgtggagatagaactaaaagagcctacagtcatttatatggagagaccgttaaaaaatgcagaatataccattcacatcgaagtgccgccaaatcctttctgggcttccattggtttatctgtatcaccgcttccgttgggaagtggaatgcagtatgagagctcggtttctcttggatacttaaatcaatcatttcaaaatgcagttatggaagggatacgctatggttgcgaacaaggattatatggttggaatgtgacggattgtaaaatctgttttaagtatggcttatactatagccctgttagtaccccagcagattttcggatgcttgctcctattgtattggaacaagtcttaaaaaaagctggaacagaattgttagagccatatcttagttttaaaatttatgcgccacaggaatatctttcacgagcatacaacgatgctcctaaatattgtgcgaacatcgtagacactcaattgaaaaataatgaggtcattcttagtggagaaatccctgctcggtgtattcaagaatatcgtagtgatttaactttctttacaaatggacgtagtgtttgtttaacagagttaaaagggtaccatgttactaccggtgaacctgtttgccagccccgtcgtccaaatagtcggatagataaagtacgatatatgttcaataaaataact

SEQ ID NO: 9788 - protein, 639 aa, Streptococcus agalactiae
MKIINIGVLAHVDAGKTTLTESLLYNSGAITELGSVDKGTTRTDNTLLERQRGITIQTGITSFQWENTKVNIIDTPGHMDFLAEVYRSLSVLDGAILLISAKDGVQAQTRILFHALRKMGIPTIFFINKIDQNGIDLSTVYQDIKEKLSAEIVIKQKVELYPNMCVTNFTESEQWDTVIEGNDDLLEKYMSGKSLEALELEQEESIRFHNCSLFPVYHGSAKNNIGIDNLIEVITNKFYSSTHRGPSELCGNVFKIEYTKKRQRLAYIRLYSGVLHLRDSVRVSEKEKIKVTEMYTSINGELCKIDRAYSGEIVILQNEFLKLNSVLGDTKLLPQRKKIENPHPLLQTTVEPSKPEQREMLLDALLEISDSDPLLRYYVDSTTHEIILSFLGKVQMEVISALLQEKYHVEIELKEPTVIYMERPLKNAEYTIHIEVPPNPFWASIGLSVSPLPLGSGMQYESSVSLGYLNQSFQNAVMEGIRYGCEQGLYGWNVTDCKICFKYGLYYSPVSTPADFRMLAPIVLEQVLKKAGTELLEPYLSFKIYAPQEYLSRAYNDAPKYCANIVDTQLKNNEVILSGEIPARCIQEYRSDLTFFTNGRSVCLTELKGYHVTTGEPVCQPRRPNSRIDKVRYMFNKIT

SEQ ID NO: 9789 - DNA, 912 bp, Streptococcus agalactiae
atgatgaaatttagaaaaaatcagaataaagaaaaacagataccaaaggaaaagaaacctcgtgtctataaggtcaatcctcataaaaaggttgtgattgccttgtgggtacttttagggcttagtttcagctttgcgatattcaagcactttacagctatagatactcatactattcacgaaacaactatcatagaaaaggaatacgttgatactcatcatgtagaaaattttgtagagaactttgcgaaagtctactattcatgggagcaatccgataagtccattgataatcgaatggaaagtctaaaaggctatctgacagatgaacttcaagctctcaatgttgatacagtacgcaaagatattcctgtatcgtcttctgtaagaggatttcagatatggacggtagagccaactggcgacaatgagtttaatgtaacctacagtgtagaccagctcattacagagggagaaaatacaaagaccgtccactctgcttatatagtgagtgtctatgtagatggttctggaaatatggtactggttaagaatccgaccattaccaacatacctaagaaatcaagttataaaccaaaagccattgaaagtgaggggacggttgattccattacaaccaatgaaatcaatgagtttttaacgacgttcttcaagctctatcctacagcgacagccagtgaactttcctactatgtgaatgacgggatattaaaaccaatcggaaaagagtacatctttcaagaactggtaaatcctattcacaatcgtaaggataatcaagtcacggtatcgctgacagtggagtatatcgaccagcagaccaaagcaacgcaggtatctcaatttgatttggtacttgaaaagaacgggagtaattggaagattgtaaaa

SEQ ID NO: 9790 - protein, 304 aa, Streptococcus agalactiae
MMKFRKNQNKEKQIPKEKKPRVYKVNPHKKVVIALWVLLGLSFSFAIFKHFTAIDTHTIHETTIIEKEYVDTHHVENFVENFAKVYYSWEQSDKSIDNRMESLKGYLTDELQALNVDTVRKDIPVSSSVRGFQIWTVEPTGDNEFNVTYSVDQLITEGENTKTVHSAYIVSVYVDGSGNMVLVKNPTITNIPKKSSYKPKAIESEGTVDSITTNEINEFLTTFFKLYPTATASELSYYVNDGILKPIGKEYIFQELVNPIHNRKDNQVTVSLTVEYIDQQTKATQVSQFDLVLEKNGSNWKIVK

SEQ ID NO: 9791 - DNA, 924 bp, Streptococcus agalactiae
atggcatatccaattaaatacattgaaaacaatctcgtctggaataaagacggggaatgttatgcttactatgagcttgttccttacaattactcatttctaagtccagaacagaaaatacaagtgcatgattctttcagacagcttatcgcacaaaatcgtgatggcaaaattcatgctttacaaatcagtacagaatccagcatacgttctgcacaagagcgttccaaaaatgaagtcactggcaagctcaaagcggttgcctatgacaaaatcgaccaacagacagacgctttaatatccatgattggcgaaaatcaagtgaactaccgtttctttatcggctttaagttgcttctcaacgatcaggagttttctatgaaaagtcttaccgttgaagcaaaaaatgctttgtctgattttgtctatgatgtgaaccataagctgatgggcgattttgttagtatgagtaatgatgaaatcctgcgttttcagaagatggaaaagctcttagaaaataaaatctctcgtcgtttcaaaatccgcaggttagataaggacgacttcggctatctgattgaacacctttacggacagacaggcactgcctatgaagagtatgagtaccatctatcaaagaaaaagctggataatgaaacgctgattaaatactatgacttgattaagcctactcgctgtttggtggaagaaaaacagcgatatttgaaaatccagcaggaagatgaaaccgtctatgtagcttactttaccattaacagcattgtcggagaactggacttcccgtcctctgaaatcttctactaccagcaacagcaatttacattcccgattgatacgtcaatgaatgtggaaattgtagcgaatcgtaaagccctatctactgtccgcaaaaaaagaaagaac

SEQ ID NO: 9792 - protein, 308 aa, Streptococcus agalactiae
MAYPIKYIENNLVWNKDGECYAYYELVPYNYSFLSPEQKIQVHDSFRQLIAQNRDGKIHALQISTESSIRSAQERSKNEVTGKLKAVAYDKIDQQTDALISMIGENQVNYRFFIGFKLLLNDQEFSMKSLTVEAKNALSDFVYDVNHKLMGDFVSMSNDEILRFQKMEKLLENKISRRFKIRRLDKDDFGYLIEHLYGQTGTAYEEYEYHLSKKKLDNETLIKYYDLIKPTRCLVEEKQRYLKIQQEDETVYVAYFTINSIVGELDFPSSEIFYYQQQQFTFPIDTSMNVEIVANRKALSTVRKKRKN

SEQ ID NO: 9793 - DNA, 1146 bp, Streptococcus agalactiae
ttggcttatggactatctcaaaaccgtttagctgttgcgactggtattacaaggcagtatctaagcgatattgaaacaggaaaagtcaagccatcagaggatttacagcagtccctttgggaagctctggaacgcttcaatcccgacgctccccttgaaatgctgtttgattatgtaagaattcgctttccgacaacagacgtacagcaggtggtcgaaaacatcttacaactgaaactgtcctattttcttcatgaggactatggtttctattcttattcagagcattatgctttaggcgacatattcgtcctttgctcccatgaactggacaaaggagttctggtggaattgaaaggtcgtgggtgcagacaatttgaaagctatcttctggcacaacaaagaagctggtatgagttctttatggacgttttggtggctggcggtgtgatgaaacgccttgaccttgccattaacgataagacagggattttaaatatccctgtactcactgaaaagtgccaacaggaagaatgtatctccgtcttccgcagttttaaaagctatcgcagtggcgaactggtacgcaaagaggaaaaggaatgtatgggaaacaccctctatatcggttcattacaaagtgaagtttatttctgtatctatgaaaaggactacgagcagtacaagaaaaatgatattcccattgaagacgcagaagtaaaaaaccgttttgagattcgattgaaaaatgagcgtgcctattatgcagtccgtgatttactcgtctatgacaatccagagcataccgcctttaaaattatcaatcggtatatccgttttgtagataaagacgattccaaacctcgttctgattggaaactgaatgaagaatgggcttggtttattgggaacaatcgtgaacgattaaaactaaccacaaaaccagagccttactccttccaaaggacgctgaactggctatctcatcaagttgccccgaccttaaaggttgcgattaaacttgatgaaatcaaccagacgcaggttgtaaaagacattctcgaccatgcgaaactgacagaccgacacaagcagattttgaagcaacagtcagtaaaagaacaggacgtgataacaacaaaaaaa

SEQ ID NO: 9794 - protein, 382 aa, Streptococcus agalactiae
MAYGLSQNRLAVATGITRQYLSDIETGKVKPSEDLQQSLWEALERFNPDAPLEMLFDYVRIRFPTTDVQQVVENILQLKLSYFLHEDYGFYSYSEHYALGDIFVLCSHELDKGVLVELKGRGCRQFESYLLAQQRSWYEFFMDVLVAGGVMKRLDLAINDKTGILNIPVLTEKCQQEECISVFRSFKSYRSGELVRKEEKECMGNTLYIGSLQSEVYFCIYEKDYEQYKKNDIPIEDAEVKNRFEIRLKNERAYYAVRDLLVYDNPEHTAFKIINRYIRFVDKDDSKPRSDWKLNEEWAWFIGNNRERLKLTTKPEPYSFQRTLNWLSHQVAPTLKVAIKLDEINQTQVVKDILDHAKLTDRHKQILKQQSVKEQDVITTKK

SEQ ID NO: 9795 - DNA, 1296 bp, Streptococcus agalactiae
atggctactgttcgtaaagcagaagagattgcaggacaaaaagttggcttcctccttgatactaaaggacctgaaattcgtacagaactttttgaagatggtgcagatttccattcatatacaacaggtacaaaattacgtgttgctactaagcaaggtatcaaatcaactccagaagtgattgcattgaatgttgctggtggacttgacatctttgatgacgttgaagttggtaagcaaatccttgttgatgatggtaaactaggtcttactgtgtttgcaaaagataaagacactcgtgaatttgaagtagttgttgagaatgatggccttattggtaaacaaaaaggtgtaaacatcccttatactaaaattcctttcccagcacttgcagaacgcgataatgctgatatccgttttggacttgagcaaggacttaactttattgctatctcatttgtacgtactgctaaagatgttaatgaagttcgtgctatttgtgaagaaactggcaatggacacgttaagttgtttgctaaaattgaaaatcaacaaggtatcgataatattgatgagattatcgaagcagcagatggtattatgattgctcgtggtgatatgggtatcgaagttccatttgaaatggttccagtttaccaaaaaatgatcattactaaagttaatgcagctggtaaagcagttattacagcaacaaatatgcttgaaacaatgactgataaaccacgtgcgactcgttcagaagtatctgatgtcttcaatgctgttattgatggtactgatgctacaatgctttcaggtgagtcagctaatggtaaatacccagttgagtcagttcgtacaatggctactattgataaaaatgctcaaacattactcaatgagtatggtcgcttagactcatctgcattcccacgtaataacaaaactgatgttattgcatctgcggttaaagatgcaacacactcaatggatatcaaacttgttgtaacaattactgaaacaggtaatacagctcgtgccatttctaaattccgtccagatgcagacattttggctgttacatttgatgaaaaagtacaacgttcattgatgattaactggggtgttatccctgtccttgcagacaaaccagcatctacagatgatatgtttgaggttgcagaacgtgtagcacttgaagcaggatttgttgaatcaggcgataatatcgttatcgttgcaggtgttcctgtaggtacaggtggaactaacacaatgcgtgttcgtactgttaaa

SEQ ID NO: 9796 - protein, 432 aa, Streptococcus agalactiae
MATVRKAEEIAGQKVGFLLDTKGPEIRTELFEDGADFHSYTTGTKLRVATKQGIKSTPEVIALNVAGGLDIFDDVEVGKQILVDDGKLGLTVFAKDKDTREFEVVVENDGLIGKQKGVNIPYTKIPFPALAERDNADIRFGLEQGLNFIAISFVRTAKDVNEVRAICEETGNGHVKLFAKIENQQGIDNIDEIIEAADGIMIARGDMGIEVPFEMVPVYQKMIITKVNAAGKAVITATNMLETMTDKPRATRSEVSDVFNAVIDGTDATMLSGESANGKYPVESVRTMATIDKNAQTLLNEYGRLDSSAFPRNNKTDVIASAVKDATHSMDIKLVVTITETGNTARAISKFRPDADILAVTFDEKVQRSLMINWGVIPVLADKPASTDDMFEVAERVALEAGFVESGDNIVIVAGVPVGTGGTNTMRVRTVK

SEQ ID NO: 9797 - DNA, 555 bp, Streptococcus agalactiae
atggttaaacgcgattttattagaaatattattttagcattgattgctgtattgattttgattctcttgagatattttgtttttgcaacctttaaagtacataaggatgctacaaattcttattttagcaacggagatgttgttgttgttaatcgtaataggacgcctaagtacaaagactttattgtctataaggttggaaagattttctatattagtcgtgttattggtgagccaaatcaaaaagtgagagtaatggatgatattttatatttgaatgatgttttcaaggatgagccttacattgaaaaaatgaaaaatgcttattctgaaaagaaagacggtcaaatgccctttacttccgacttctcagttgaaacattaacacgaaataaagaaagcagagttcctaagggttcttatcttgtgttaaatgataatcgacaaaataaaaatgatagtcgaaaatttggattaatcaaagagaaagatattcgtggtgttattacctttaaagtataccctctaagtgaatttggttttacagcttcagag

SEQ ID NO: 9798 - protein, 185 aa, Streptococcus agalactiae; identical to SEQ ID NO: 8790

SEQ ID NO: 9799 - DNA, 468 bp, Streptococcus agalactiae
atgatagattatggtagtcaagtccttctaaatagtttacattttgaaaaaaataaatccttgttagaccttgggtgtggatacggtccgctgggaatttctctagccaaagtgcaaggagttaaagcaactatggttgacattaatacgagagcattggaattagctaagaaaaatgcaacacgcaatggagtagtagttgaagtctttcagtcaaacatttatgaaaatatttctaaaactttcgactatattataagcaacccacctattcgtgctggaaagcaagttgttcattctattatcgaagaaagtatctgttaccttaatacaggcggtagccttaccattgtcattcaaaagaaacaaggcgctccaagtgcaaaagctaaaatgctagatacttttggtaattgcgatattttaaaaaaagataagggatattatatattgagaagtgaaaaagtc

SEQ ID NO: 9800 - protein, 156 aa, Streptococcus agalactiae
MIDYGSQVLLNSLHFEKNKSLLDLGCGYGPLGISLAKVQGVKATMVDINTRALELAKKNATRNGVVVEVFQSNIYENISKTFDYIISNPPIRAGKQVVHSIIEESICYLNTGGSLTIVIQKKQGAPSAKAKMLDTFGNCDILKKDKGYYILRSEKV

SEQ ID NO: 9801 - DNA, 414 bp, Streptococcus agalactiae
atgaagcgaaaggtgcagctactaaaaatgggaaatatagagttgaaaaaattggctgtaaaagcgagtgaaaatgcatacgttccttactcgaaatttccagtaggcgcagcattgcgtacagcagaaggaaaaatatttacaggatgtaacgttgaaaatatcagttatggattagcaaactgtgctgagcgtactgcaatttttaaagctgtttcagaaggttataaagatttttcggaaattgctatttatggaaatactgaagaaccaatttctccttgcggtgcatgccgtcaagtgatggtggaattttttaataagaatgctaaagttacattgattgctaaaaatggtaagacggtcgagacgacggtcggtgagttgttaccatactcgtttgttgatttaaaa

SEQ ID NO: 9802 - protein, 138 aa, Streptococcus agalactiae
MKRKVQLLKMGNIELKKLAVKASENAYVPYSKFPVGAALRTAEGKIFTGCNVENISYGLANCAERTAIFKAVSEGYKDFSEIAIYGNTEEPISPCGACRQVMVEFFNKNAKVTLIAKNGKTVETTVGELLPYSFVDLK

SEQ ID NO: 9803 - DNA, 1533 bp, Streptococcus agalactiae
atgacacagaatgtcattgaaatgaaagaaatcactaagaaattcggtgattttgtggcaaatgatcatatcaatttgacggttgaaaaaggtgagatacatgctctgcttggcgaaaacggtgcagggaaatcaactttaatgaacatgttagcaggtttactagaaccaacagacggtcaaatttttattaatggtcagcctgtaactattgattcaccttccaaatcgtcacaattggggattggtatggtacatcagcatttcatgcttgttgaagcatttactgtagctgaaaatattgttctaggaaatgaaaccacccaaaatggtgttttagacattaagacagcagctaaagaaataaaggaactatcagagaaatatggtttgtcagtaaatccaaatgctaaaatatctgatatttctgtaggagcacagcagcgtgttgaaattttgaagacactttatcgcggtgcagatattttaatttttgatgagccgacggcggtgcttacaccatcagaaataaaagaattgatgacaattatgaagagccttgttaaagaaggcaaatccattatactaattacccataaattggatgaaattcgggcagttgctgataaagttactgtgattcgccgtggtaaaagtattgaaacagtccctgttgcaggcgcaagttctcaacaactggcggaaatgatggttggacgatctgtttccttcagaactgaaaaaaaggaagctaatccgactgacataatcctttctgtaaaggatttagttgtagaagaaaatagaggcggcgttctagctgttaaaaatctgtcgttagatgttcgagcaggtgaaattgtaggtatagctggtattgatggtaatggacaaagtgaattaattcaagctattacaggtttaagaaaggtaacttctggtcaaattgtaattaaaggtaaagatgtcacaaaattttcaagtcgacaaattacagaattaagtgtaggtcatgttccagaagatcgtcatagagatggtttggttctagatatgacgatggcagaaaatttagctttacaaacttattataaagagccattgagtcataaaggtatccttaattttgctaaaattaaagagtatgctcgtcaattaatgacagaatttgatgtgcgtggtgctggtgaacatgttttagcaagaggattttctggtggtaaccaacaaaaagcaattattgctcgtgaagtggatcgcgatccagacctactcattgttagccaaccgactcgtggtctagatgttggtgctatcgagtatattcataaacgtttgattgaagagcgcgataaagggaaagcggtcttagtagttagctttgagttagatgaaatcttaaacttatcagatcgtattgcagttattcatgatggtaaaattcaaggaattgttaaacccgaccaaaccaacaagcaagaattgggtattttgatggctggtggaaaaattgaaaaggaggagagagatgtc

SEQ ID NO: 9804 - protein, 511 aa, Streptococcus agalactiae
MTQNVIEMKEITKKFGDFVANDHINLTVEKGEIHALLGENGAGKSTLMNMLAGLLEPTDGQIFINGQPVTIDSPSKSSQLGIGMVHQHFMLVEAFTVAENIVLGNETTQNGVLDIKTAAKEIKELSEKYGLSVNPNAKISDISVGAQQRVEILKTLYRGADILIFDEPTAVLTPSEIKELMTIMKSLVKEGKSIILITHKLDEIRAVADKVTVIRRGKSIETVPVAGASSQQLAEMMVGRSVSFRTEKKEANPTDIILSVKDLVVEENRGGVLAVKNLSLDVRAGEIVGIAGIDGNGQSELIQAITGLRKVTSGQIVIKGKDVTKFSSRQITELSVGHVPEDRHRDGLVLDMTMAENLALQTYYKEPLSHKGILNFAKIKEYARQLMTEFDVRGAGEHVLARGFSGGNQQKAIIAREVDRDPDLLIVSQPTRGLDVGAIEYIHKRLIEERDKGKAVLVVSFELDEILNLSDRIAVIHDGKIQGIVKPDQTNKQELGILMAGGKIEKEERDV

SEQ ID NO: 9805 - DNA, 822 bp, Streptococcus agalactiae
atggtaattggagctttctcaggcgttgtatttaatttagagtttgcttctgtttttggtgatgcgactccatggatttctgtactagttggtggtttagttggtttaattttttctgttatccatgcagttgcgacagttaattttcgtgcagatcatattatcagcggaaccgttcttaatttaatggcaccttcattagctgttttcttgattaaggttctttataataaaggtcaaactgataatattcaagaatcatttggaaaatttaatttccctatactatcagatattccttttgttggtgatatcttctttaaaggaacaagcttagtcggttatattgctattcttttctcattccttgcttggtttattctatataaaactcgctttggattaagattacgctcagttggagaacatcctcaagcagcagacaccttaggtattaatgtttatcttatgcgttactctggtgtcttgatttcaggtttccttggtggaataggaggagctgtatatgctcaatctatttctgttaactttgcagcgacaactatattaggaccgggctttatctccttagcggcgatgatttttggtaagtggaatccaattggtgcaatgcttgctagtctattctttggtttatcgcaaagtttagcagttatcggtagccatttaccacttttgagcaatattccaacagtttatctacaaattgctccatatgtcctcactatcattgtattagcagctttctttggacaagcagtagctcctaaggcggatggtattaattatattaaaacgaaa

SEQ ID NO: 9806 - protein, 274 aa, Streptococcus agalactiae
MVIGAFSGVVFNLEFASVFGDATPWISVLVGGLVGLIFSVIHAVATVNFRADHIISGTVLNLMAPSLAVFLIKVLYNKGQTDNIQESFGKFNFPILSDIPFVGDIFFKGTSLVGYIAILFSFLAWFILYKTRFGLRLRSVGEHPQAADTLGINVYLMRYSGVLISGFLGGIGGAVYAQSISVNFAATTILGPGFISLAAMIFGKWNPIGAMLASLFFGLSQSLAVIGSHLPLLSNIPTVYLQIAPYVLTIIVLAAFFGQAVAPKADGINYIKTK

SEQ ID NO: 9807 - DNA, 741 bp, Streptococcus agalactiae
atgcactataaagaattacttgagtcatccgaaaaagcttatttggaaactaatcggtataaacattttaagaatataatcatttcagagcgttatttttcaaactatattagctacaaaataatgcctacagtaagtgagtttttacaggatatgatctatttagcagatgaacaaaaagattatcagtctgattttgcttttgtattttttgaggaaaatgctgaattgagcagtgaattacagagaactttatcacaacaaggctttgaatcagagaaacatatcatatttacaaattcattaaatcatcttaaactttttgaaaaagaatttgatgacatcacatttactaaacttaatgaaaattacctagaaaaatacctaaagttcaaatataaacaaagtatagtttacggagaaatttacgctaagcaaatgtataatgataatcgtgttaatcttttaaataataatgctaaagtttacctagctattaaagataatcaaattattggagatgtaacagcttgggactatggtgaatacgtggaaatagatgatttttatgtccaagagtcctacagaggacaaggaattggtacgcgcctacaatttgatgcaagtagggggtttaagaaagttatcttaatttcagaagaagaaaacagaaaaatgtatgagcaccaaggttatgaggaagtcgcctattattggaccgctttacggagccctcgaaag

SEQ ID NO: 9808 - protein, 247 aa, Streptococcus agalactiae
MHYKELLESSEKAYLETNRYKHFKNIIISERYFSNYISYKIMPTVSEFLQDMIYLADEQKDYQSDFAFVFFEENAELSSELQRTLSQQGFESEKHIIFTNSLNHLKLFEKEFDDITFTKLNENYLEKYLKFKYKQSIVYGEIYAKQMYNDNRVNLLNNNAKVYLAIKDNQIIGDVTAWDYGEYVEIDDFYVQESYRGQGIGTRLQFDASRGFKKVILISEEENRKMYEHQGYEEVAYYWTALRSPRK

SEQ ID NO: 9809 - DNA, 1953 bp, Streptococcus agalactiae
atgttttatctcaaaatagcctggcataatttaaaacattctatagaccagtacataccattcctcttagccagtttattactttattcattgacttgttctacgctactaatcttaatgagtgctgttggaagagatatggggacagcggcaacggttctttttcttggagtgattgttttgtcaatctttgcggtagtcatggaacattatagctacaatatcttgatgaaacagcgtagtagtgaatttggactgtataacattttggggatgaataaacgtcaagttgcgcgtgtagctagtctagagctgtttattatttatatatttcttatttctataggaagtctgtttagtgctttttttgctaaatttatttatttaatttttgtcaacattattaactatcatgcactaaatcttagtttaagtttatggccatttattatttgtatcgttatatttacaggtatttttctgactttagaagttccagttattcgacatgttcatttatcatccccattaagtctttttagaaagaaacaacagggagaaaaagaaccaaaaggtaatcttatacttgcaattttagcgttagtagctatcgccatcgcttatacaatggctcttacttcaggtaaagcacctgcattagctgttatctatcgtttcttctttgcagtacttttagttattgctggtacttatcttttttatattagttttatgacatggtacttaaaaaggttgcgtcaaaacaagcattattattataaatctgagcattttgtatcaacttcgcaaatgatttttcgaatgaagcaaaatgcagtagggttagcaagtatcactttattagctgttatggctctagttactattgctacaacagtctcactttattcaaatacacaaaatgttgttaccggactatttccaaaatcagtaagtttatcaatagataattcaaaaggtgacgcgaaaaatatatttgaagaaaagattttgaagaaactaggtaagtcatctaaggaagctatcacttataatcagacaatgatttcgatgccagttagtcaatcaagtgaacttaatatcacatctaaaaacgtcaaacatgttgatatcacaaaaacgggttttatgtacctaattactcagaatgatttccgtcgtttaggtcaccaattaccaaaattaaaagataaccaagtggcttactttgttcaaaaaggtgatagccgtttgaaaaaaataaatctattgggaaataaatttgacgttgtaaaaaatttaaaagaggcttatgtcccagagactacaaatacttacaacccgggtttgattatatttgcaaacaacaaacaaattgacaatattagaaaagcatatttaccttatactaagaacatcaatacttttccaaaaacctttaaggcatatttggatttgaatagtcaagagataaattcaatttctaaaaacgacataatagaggtagatggtaagtatgttggaaatattagcactaaacagagttttctaaaagaaggttatcaaatgtttggtgggttattatttactggatttctgttaggtataagctttttgctaggtatagctctaattgtttactataagcaatactcagaaggtcatgaagataagagatcttatcgtatcttacaagaagtaggtatgagcaaaaaattagttaaacggactattaattctcaaattatgattttcttcttccaacctttagtggtagcagttattcactttggagttgctattccaatgctaaaacagatgcttttggtatttggggtgcttaactcaacaatcgtatatgtagtaagtggtttgacagtacttgcgatttctataatttactttatcatttaccgtataactagtcgaacttattatcatattattgaacgc

SEQ ID NO: 9810 - protein, 651 aa, Streptococcus agalactiae
MFYLKIAWHNLKHSIDQYIPFLLASLLLYSLTCSTLLILMSAVGRDMGTAATVLFLGVIVLSIFAVVMEHYSYNILMKQRSSEFGLYNILGMNKRQVARVASLELFIIYIFLISIGSLFSAFFAKFIYLIFVNIINYHALNLSLSLWPFIICIVIFTGIFLTLEVPVIRHVHLSSPLSLFRKKQQGEKEPKGNLILAILALVAIAIAYTMALTSGKAPALAVIYRFFFAVLLVIAGTYLFYISFMTWYLKRLRQNKHYYYKSEHFVSTSQMIFRMKQNAVGLASITLLAVMALVTIATTVSLYSNTQNVVTGLFPKSVSLSIDNSKGDAKNIFEEKILKKLGKSSKEAITYNQTMISMPVSQSSELNITSKNVKHVDITKTGFMYLITQNDFRRLGHQLPKLKDNQVAYFVQKGDSRLKKINLLGNKFDVVKNLKEAYVPETTNTYNPGLIIFANNKQIDNIRKAYLPYTKNINTFPKTFKAYLDLNSQEINSISKNDIIEVDGKYVGNISTKQSFLKEGYQMFGGLLFTGFLLGISFLLGIALIVYYKQYSEGHEDKRSYRILQEVGMSKKLVKRTINSQIMIFFFQPLVVAVIHFGVAIPMLKQMLLVFGVLNSTIVYVVSGLTVLAISIIYFIIYRITSRTYYHIIER

SEQ ID NO: 9811 - DNA, 684 bp, Streptococcus agalactiae
atgtatttagcattaatcggtgatatcattaattcaaaacagatacttgaacgtgaaactttccaacagtcttttcagcaactaatgaccgaactatctgatgtatatggtgaagagctgatttctccattcactattacagctggtgatgaatttcaagctttattgaaaccatcaaaaaaggtatttcaaattattgaccatattcaactagctctaaaacctgttaatgtaaggttcggcctcggtacaggaaacattataacatccatcaattcaaatgaaagtatcggtgctgatggtcctgcctactggcatgctcgctcagctattaatcatatacatgataaaaatgattatggaacagttcaagtagctatttgccttgatgatgaagaccaaaaccttgaattaacactaaatagtctcatttcagctggtgattttatcaagtcaaaatggactacaaaccattttcaaatgcttgagcacttaatacttcaagataattatcaagaacaatttcaacatcaaaagttagcccaactggaaaatattgaacctagtgcgctgactaaacgccttaaagcaagcggtctgaagatttacttaagaacgagaacacaggcagccgatctattagttaaaagttgcactcaaactaaagggggaagctatgatttc

SEQ ID NO: 9812 - protein, 228 aa, Streptococcus agalactiae
MYLALIGDIINSKQILERETFQQSFQQLMTELSDVYGEELISPFTITAGDEFQALLKPSKKVFQIIDHIQLALKPVNVRFGLGTGNIITSINSNESIGADGPAYWHARSAINHIHDKNDYGTVQVAICLDDEDQNLELTLNSLISAGDFIKSKWTTNHFQMLEHLILQDNYQEQFQHQKLAQLENIEPSALTKRLKASGLKIYLRTRTQAADLLVKSCTQTKGGSYDF

SEQ ID NO: 9813 - DNA, 306 bp, Streptococcus agalactiae
atgaatgccctttttgagttttatgcggcattattaacagataaacaaatgaattatatcgagttatactacgccgatgactacagccttgctgaaatagctgaagaatccggtgttagccgacaagctgtctatgataatatcaaacgaactgaaaaaattcttgaggcgtacgaaatgaaactacatatgtattcagattatattgtccgtagtcagatttttgatgacattctagaaaaatataccgatgatgcctttttacaagaaaaaatttccattctaagtagcattgataatagagat

SEQ ID NO: 9814 - protein, 102 aa, Streptococcus agalactiae
MNALFEFYAALLTDKQMNYIELYYADDYSLAEIAEESGVSRQAVYDNIKRTEKILEAYEMKLHMYSDYIVRSQIFDDILEKYTDDAFLQEKISILSSIDNRD

SEQ ID NO: 9815 - DNA, 555 bp, Streptococcus agalactiae
atgtataacggacataatgtttatagcccgcgcactgataccgtagaacttcgtaaagaaattgggatggtttttcagcagcctaatccatttcctatgtcagtatttgaaaatgttgtttatggtcttagactcaaaggaataaaagacaaagctacgttagatgaagccgtagagacttcattgaagggcgcgtctatctgggacgaggtcaaagatagattacacgactctgctcttggtttatctggtggtcaacaacaacgtgtttgtattgccagaacccttgctaccaagcctaaaattatccttctagatgagccaacctctgcacttgacccaatttctgctggtaaaattgaagagactttacatggtctaaaagatcaatataccatgttacttgttacacgttctatgcagcaagcctcacgtatttctgatcgtacaggtttcttcttagacggtaacttaattgaatatggcaatacaaaagaaatgtttatgaatcctaaacataaagaaactgaagattacattacaggtaaattcggt

SEQ ID NO: 9816 - protein, 185 aa, Streptococcus agalactiae
MYNGHNVYSPRTDTVELRKEIGMVFQQPNPFPMSVFENVVYGLRLKGIKDKATLDEAVETSLKGASIWDEVKDRLHDSALGLSGGQQQRVCIARTLATKPKIILLDEPTSALDPISAGKIEETLHGLKDQYTMLLVTRSMQQASRISDRTGFFLDGNLIEYGNTKEMFMNPKHKETEDYITGKFG

SEQ ID NO: 9817 - DNA, 843 bp, Streptococcus agalactiae
atgacatcacacgatgctgtattcaagcttcgaaagatattacatacaaaaaaaataggacacggcggaactcttgatccagatgttgttggggttttaccaattgcggttggaaaagccactcgtgttattgaatatatgacagaaagtggcaaaatttatgaaggagaaatcactttaggatatgccacaagtacagaagattctagtggagaggtcatttcaagaactccactaactcaatccgatcttagcgaggatgttgtggatcatgcgatgaaaagttttaccggtccaattacacaagttcctcctatgtattcagcagttaaagtaaatggtaaaaaactctatgaatatgctcgttcaggagaagaagtagagcgacctaaacgacaaataacaatttctgaatttagacgcacaagcccattgtacttcgaaaaaggcatctgccgttttagtttctatgtctcatgcagtaaaggtacctatgttaggacgttagctgttgatctaggaataaaactaggatatgctagccatatgtctttcctaaaaagaacctcatctgcaggattatctattacacaatcattaacgcttgaagaaattaatgaaaaatataagcaagaagatttttcatttttacttccaattgaatatggtgttttagatctcccaaaagttaacctaactgaggaagataaagttgaaatctcatacggacgtcgtatcttattagaaaatgaagcagataccttagcagctttttatgaaaatagagttatcgctatactagaaaaacgtggcaatgaatttaaaccacacaaagtattgtta

SEQ ID NO: 9818 - protein, 281 aa, Streptococcus agalactiae
MTSHDAVFKLRKILHTKKIGHGGTLDPDVVGVLPIAVGKATRVIEYMTESGKIYEGEITLGYATSTEDSSGEVISRTPLTQSDLSEDVVDHAMKSFTGPITQVPPMYSAVKVNGKKLYEYARSGEEVERPKRQITISEFRRTSPLYFEKGICRFSFYVSCSKGTYVRTLAVDLGIKLGYASHMSFLKRTSSAGLSITQSLTLEEINEKYKQEDFSFLLPIEYGVLDLPKVNLTEEDKVEISYGRRILLENEADTLAAFYENRVIAILEKRGNEFKPHKVLL

SEQ ID NO: 9819 - DNA, 429 bp, Streptococcus agalactiae
atgaagattagaactgctacactagacgatagtgaaaaattagtccctttgtatcaagaattaggatacgcaatatcattatcagagattcaatctattttaaaggttattcttactcattcagattatggctttttgatagctgaggataatggcaaactcctcgccttcgttggatatcataaactttacttttttgaaaaaagtgggacttactatcgtattttagcactagtagttaatgaaaagcaccgtcgtaaaggcatcgctagtcaacttattaatcacgttaaacagctagctaaaacagatggaagtgaagtactggctttaaatagcagtttaaaagaatatcgtcaggaagcttatcatttttatgaaaacctagggttcaagaaggttagtacaggcttttcatactatttagat

SEQ ID NO: 9820 - protein, 143 aa, Streptococcus agalactiae
MKIRTATLDDSEKLVPLYQELGYAISLSEIQSILKVILTHSDYGFLIAEDNGKLLAFVGYHKLYFFEKSGTYYRILALVVNEKHRRKGIASQLINHVKQLAKTDGSEVLALNSSLKEYRQEAYHFYENLGFKKVSTGFSYYLD

SEQ ID NO: 9821 - DNA, 2118 bp, Streptococcus agalactiae
atggcaactacgacaaaaacgtcgaccaaaaaaacaagtaaaaaaaaatcagctactgctaaaaaaaatctagttattgtggagtctcctgcaaaagcaaagactatcgaaaaatacttaggacgtaactataaagttgtagcctcagtaggtcatatccgtgatttaaaaaagtcaagtatgtccattgattttgagaataattacgaaccacaatatattaatattcgtggtaaaggacctctcattaatgatttaaaaaaagaagctaaaaaggctaaaaaagtttacctcgcgagtgacccggaccgtgaaggagaagctatttcctggcatttagcgcatattttagatttagacaaagaagacagaaaccgtgttgttttcaatgaaatcacaaaagatgctgttaaaaatgcttttgtggaacctcgtcagattaacatggatctcgttgatgctcagcaagcacgacgtgttttagatcgcattgttggttattctatctcacctattttatggaaaaaagtaaaaaaaggcctatcagctggacgtgtacaatcagttgctcttaaactaatcattgatcgtgaaaatgagattaaggctttccaaccggaggagtattggactattgacggttcctttaaaaaaggaacacgtaaattcaatgccactttctacggtttagacggaaagaaattcaaattatcgaataatgaagacgtcaaaacagttctaaaacgtattaaaactgatgaattcttagttgaaaaagttgaaaaaaaagagcgtcgtcgtaatgcaccattaccgtatacaacttcttcattgcaacaagatgcagctaataaaatcaattttcgaactcgtaaaaccatgatgattgcgcaacagctgtacgaaggacttagcttaggcacagcaggtcatcaaggtctgattacctatatgcgtactgattctacacgtattagtccgttagcacaaaatgaagcaacagaatttattactaaccgttttggtgcaaattattctaaacatgggaataaagttaaaaatgcttctggagcacaagacgctcacgaagctattcgcccatctagtgttaatcatacacccgaaagtattgctaagtatttagacaaagatcaactaaaactttacactcttatctggaaccgttttattgcaagccaaatgacagcagcagtctttgacacaatgaaagttaatttaacgcaaaatggtgttacttttattgctaatggtagccaagtcaagtttgatggttacatggctgtttataacgatactgacaaaaataaaatgttaccagatatggaggaaggagaaagtgttaaaaaggttaatacgaatcctgaacaacacttcactcaacctcctgcaaggttttcagaagcaagtctcattaaaacacttgaagaaaacggtgtaggtcgtccttcaacttatgccccaacgcttgagactattcaaaaacgttattatgttaagcttgcagctaaacgcttcgaaccaactgaacttggtgaaattgttaatagccttattgtagaatttttcccagatattgttgatgttaccttcactgccgaaatggaagggaaactagacgaagttgagattggtaaagagcagtggcaaaagattatcgatgaattttataaaccatttgaaaaagaacttgcaaaagcagaaactgaaatggagaaaattcaaataaaggatgaacctgctggatttgattgcgagctatgtggatcaccaatggtaataaaactaggacgttatggaaagttttatgcgtgtagcaatttccctgaatgtcataacacaaaagctatcactaaggaaataggtgttatttgtcctatctgtcaaaaaggacaagttattgagcgaaaaacaaaacgcaatcgtatcttttatggctgtgaccgctacccagaatgtgagtttacatcttgggacaaacctattggacgaacttgccccaaatcaaatgatttcttagtggagaaaaaagtacgcggtggtggtaaacaagttgtttgctcaaatgaaaaatgcgactaccaagaagagaaaattaaa

SEQ ID NO: 9822 - protein, 706 aa, Streptococcus agalactiae
MATTTKTSTKKTSKKKSATAKKNLVIVESPAKAKTIEKYLGRNYKVVASVGHIRDLKKSSMSIDFENNYEPQYINIRGKGPLINDLKKEAKKAKKVYLASDPDREGEAISWHLAHILDLDKEDRNRVVFNEITKDAVKNAFVEPRQINMDLVDAQQARRVLDRIVGYSISPILWKKVKKGLSAGRVQSVALKLIIDRENEIKAFQPEEYWTIDGSFKKGTRKFNATFYGLDGKKFKLSNNEDVKTVLKRIKTDEFLVEKVEKKERRRNAPLPYTTSSLQQDAANKINFRTRKTMMIAQQLYEGLSLGTAGHQGLITYMRTDSTRISPLAQNEATEFITNRFGANYSKHGNKVKNASGAQDAHEAIRPSSVNHTPESIAKYLDKDQLKLYTLIWNRFIASQMTAAVFDTMKVNLTQNGVTFIANGSQVKFDGYMAVYNDTDKNKMLPDMEEGESVKKVNTNPEQHFTQPPARFSEASLIKTLEENGVGRPSTYAPTLETIQKRYYVKLAAKRFEPTELGEIVNSLIVEFFPDIVDVTFTAEMEGKLDEVEIGKEQWQKIIDEFYKPFEKELAKAETEMEKIQIKDEPAGFDCELCGSPMVIKLGRYGKFYACSNFPECHNTKAITKEIGVICPICQKGQVIERKTKRNRIFYGCDRYPECEFTSWDKPIGRTCPKSNDFLVEKKVRGGGKQVVCSNEKCDYQEEKIK

SEQ ID NO: 9823 - DNA, 759 bp, Streptococcus agalactiae
atggcaacaattaaagaaatcaaagcaattttagagactattgttgatttaaaagacaaacgttggcaagaatatcaaacagattcacgcgcaggtgttcaaaaagcaatccttcaacgaaaaaaaaatattcagtcagatttagacgaagaagcgcgcttagaacaaatgttggtctacgaaaaaaaactttacattgaacatataaaccttattgcaggaatcgatgaagtaggtagaggtcctttagcgggaccagtagtagctgctgctgttattcttccaccaaactgtaaaataaaacatctcaatgactccaaaaaaattccaaagaaaaagcatcaagaaatctatcaaaatattttagatcaagcgttagcagttggtattggtattcaagacagccaatgtattgatgatatcaacatttatgaagctacaaaacatgctatgattgatgcagtttctcatttatctgtggctcctgaacatcttttaattgatgctatggttttagatctatcaattccacaaactaaaattatcaaaggtgatgctaattcactctctattgcagcagcttcaatcgtagctaaagtgaccagagataaaataatgtctgattatgatagcacatatcctggatatgcattttctaaaaatgctggctatggtactaaagagcatttagaaggtttgcaaaaatacggtattactccgatacatcgtaaaagttttgaacctataaaatcaatgttg

SEQ ID NO: 9824 - protein, 253 aa, Streptococcus agalactiae
MATIKEIKAILETIVDLKDKRWQEYQTDSRAGVQKAILQRKKNIQSDLDEEARLEQMLVYEKKLYIEHINLIAGIDEVGRGPLAGPVVAAAVILPPNCKIKHLNDSKKIPKKKHQEIYQNILDQALAVGIGIQDSQCIDDINIYEATKHAMIDAVSHLSVAPEHLLIDAMVLDLSIPQTKIIKGDANSLSIAAASIVAKVTRDKIMSDYDSTYPGYAFSKNAGYGTKEHLEGLQKYGITPIHRKSFEPIKSML

SEQ ID NO: 9825 - DNA, 522 bp, Streptococcus agalactiae
atgagtatctttagcgtatattctatttttcgtggtgataaagccaaagaaaaagcaagtgtcataaaacaagcatctcaaacaagtcaaacttcaaaaaaagaggtcttacaaaagaagacttatccaaatctaaataaatattcaaatctagaaattcatgtttcatctacgaggcaaacaatgacaataacctcgaatgacaaggtcatctttaaaacgattgtttcaacaggagcaaaagagagccctaccccaaaaggaacttttgtcatagaaccggaacgaggagattttttctataacgcctcatcaaaagaaggagcctattattgggtctcctttaaagaacatggtatttatctctttcatagcgttccgactgatcaacaaggaaatgagattccagaagaagcaaagcaattaggaaaagccgcctcacatggctgtgtgcgtatgtcaagggcggatgcaaaatggttctatgaaaatattcctcaaggaacgactgttaccatcaaa

SEQ ID NO: 9826 - protein, 174 aa, Streptococcus agalactiae
MSIFSVYSIFRGDKAKEKASVIKQASQTSQTSKKEVLQKKTYPNLNKYSNLEIHVSSTRQTMTITSNDKVIFKTIVSTGAKESPTPKGTFVIEPERGDFFYNASSKEGAYYWVSFKEHGIYLFHSVPTDQQGNEIPEEAKQLGKAASHGCVRMSRADAKWFYENIPQGTTVTIK

SEQ ID NO: 9827 - DNA, 120 bp, Streptococcus agalactiae
atgtttaaaggatttaaaaaattgattattattatgggagggataagcttaatgatgattttaacagcatgtgacttagtaaaaaaaatcaccaatgggttcaagaacattgaaaatact

SEQ ID NO: 9828 - protein, 40 aa, Streptococcus agalactiae
MFKGFKKLIIIMGGISLMMILTACDLVKKITNGFKNIENT

SEQ ID NO: 9829 - DNA, 699 bp, Streptococcus agalactiae
atgttagaaaaatgccctatcattgccttagatttttctgatttggcttctgtaacaacttttttagaacattttccaaaagaagaattgctttttgtcaaaataggaatggagctttattattccgaaggtccctcaattattagatatattaaatccttaggacatcgcatttttttggatttaaaattacatgatatccctaatacagttcgatcatctatgtctgtcttagccaaattaggcattgatatgactaatgtgcatgctgcaggaggagtcgaaatgatgaaagcagctagagaaggtttggggaagggtccaatactattagcagtgacacaattaacctcgacttcacaagaacaaatgcaggtggatcaacatattaacttaagtgtagttgattcggtttgccattatgctcaaaaagctcaagaagcaggcttagatggagtagtcgcatcggctcaagagggaatgcaaatcaagaaacagactaacgaacatttcatttgcttaacgcctggtatcagacctccacaaaccaatcagttagatgatcaaaaaagaacgatgactcctgagcaagcacgtatagttggggctgattatatcgttgtgggaagacctataacgaaagcagaaaatccatatcaagcatatctagagataaaagaagaatggaatcgtattaaa

SEQ ID NO: 9830 - protein, 233 aa, Streptococcus agalactiae
MLEKCPIIALDFSDLASVTTFLEHFPKEELLFVKIGMELYYSEGPSIIRYIKSLGHRIFLDLKLHDIPNTVRSSMSVLAKLGIDMTNVHAAGGVEMMKAAREGLGKGPILLAVTQLTSTSQEQMQVDQHINLSVVDSVCHYAQKAQEAGLDGVVASAQEGMQIKKQTNEHFICLTPGIRPPQTNQLDDQKRTMTPEQARIVGADYIVVGRPITKAENPYQAYLEIKEEWNRIK

SEQ ID NO: 9831 - DNA, 1023 bp, Streptococcus agalactiae
atgattcgtcaattagaacaatcgaatttaccaatagaacaagtgaaacttttatcatcaagtcgctcagcaggtaaaattttacattttaaagatgaggctatacgtgttgaagagacaacaaaagaatcattttacgatgttgatattgccttgttttcagctggtggatctatttcagcaaagttcgctccttatgcagtaaagtctggagcagttgtagtagataacacgtcatattttcgtcagaatcctgatgttccactagttgttcctgaagtaaatgctcatgccatgattggtcataatggtatcatagcttgccccaattgttctactattcaaatgatgattgctttagagcccattcgtcaaaaatgggggatagagcgtgttatagtttccacctatcaagctgtttcgggttcaggtgcacgtgctgttgaagaaactaaggaacagttgagacaagttttaaatgataacctttcacctgatcaattaattgcaacagtcttgccatgttctagcgatcaaaaacattatcctatcgcattcaatgcattacctcaaattgatatttttactgataatgattatacgtacgaagaaatgaaaatgactttggagacaaagaaaattatggaagatgctactattaaggtttcagctacctgcgtccgtattcccgttttatcggggcattctgagtccatttatattgagacgaaagaattagcctcaatctctgaaattaaaaaggctattgcaaattttcctggtgccgtcctacaagaccttccatctcagcaaatttaccctcaagcgattaatgctgtaggccatagggagacctttgttggtcgtattcgaaaagaccttgatcaagaaaatggtgttcatatgtgggtagtttcagataatctactgaagggggcagcttggaattctgttcaaattgcagaaacattgcataagaatgggctggttaaaccagcaaaagagttaaaatttgaattaata

SEQ ID NO: 9832 - protein, 341 aa, Streptococcus agalactiae
MIRQLEQSNLPIEQVKLLSSSRSAGKILHFKDEAIRVEETTKESFYDVDIALFSAGGSISAKFAPYAVKSGAVVVDNTSYFRQNPDVPLVVPEVNAHAMIGHNGIIACPNCSTIQMMIALEPIRQKWGIERVIVSTYQAVSGSGARAVEETKEQLRQVLNDNLSPDQLIATVLPCSSDQKHYPIAFNALPQIDIFTDNDYTYEEMKMTLETKKIMEDATIKVSATCVRIPVLSGHSESIYIETKELASISEIKKAIANFPGAVLQDLPSQQIYPQAINAVGHRETFVGRIRKDLDQENGVHMWVVSDNLLKGAAWNSVQIAETLHKNGLVKPAKELKFELI

SEQ ID NO: 9833 - DNA, 834 bp, Streptococcus agalactiae
ttggaatggcaagatctagcgcagttacctgtatctatttttaaagactatgttacagatgctcaagacgcggaaaaaccttttatatggacagaagtatttttaagggagattaatcgctcaaatcaagaaattattttgcatatttggccgatgactaagacagtcattctggggatgttagatcgagaattaccacatttagaattagctaaaaaagaaatcatcagtcgtggctatgaaccagttgttcggaattttggtggtctcgcagttgtagctgatgaaggaattttaaatttttcattggttattccagatgtttttgagagaaaattgtctatctcagatgggtatcttataatggtcgattttattagaagtatattttcagatttttatcaacctattgagcactttgaagtagagacctcctattgtcctggtaagtttgatcttagtataaatggcaaaaaatttgctggcttggctcagcgccgtataaagaatggtattgcggtatcaatttaccttagcgtttgtggcgatcaaaaagggcggagtcaaatgatttcagatttttataagattggtctaggtgatacgggtagtccaattgcttatccaaatgtagatcctgaaattatggctaatctatctgatctattagattgtcctatgacagtagaagatgttattgatcgtatgttgattagccttaaacaagtaggttttaatgatcgtttactgatgattagacccgatttagttgcagagtttaatagatttcaggctaagtctatggctaataaggggatggtgagcagagatgaa

SEQ ID NO: 9834 - protein, 278 aa, Streptococcus agalactiae
MEWQDLAQLPVSIFKDYVTDAQDAEKPFIWTEVFLREINRSNQEIILHIWPMTKTVILGMLDRELPHLELAKKEIISRGYEPVVRNFGGLAVVADEGILNFSLVIPDVFERKLSISDGYLIMVDFIRSIFSDFYQPIEHFEVETSYCPGKFDLSINGKKFAGLAQRRIKNGIAVSIYLSVCGDQKGRSQMISDFYKIGLGDTGSPIAYPNVDPEIMANLSDLLDCPMTVEDVIDRMLISLKQVGFNDRLLMIRPDLVAEFNRFQAKSMANKGMVSRDE

SEQ ID NO: 9835 - DNA, 690 bp, Streptococcus agalactiae
atggctatgaaaattttgattacatcaggtggaactaccgagaaaattgataccgttaggagtatcacgaatcacgcaacaggaactttaggaaaaataattgcagaaaaatatttacgagaaggacatcaggtgacactcgtgactactaaaaatgcagtcaaaccagaatctgctaccaacttatccacatttgagattgaggacgttgactcattaataaaaaccttgaagccattagtgaaagagcatgatattttaattcatagcatggcagtgtctgactatacccccgtctacatggctgatttcgaaaaggttaaatcaagcgatcatttagatacttttttgcgcaaagataaccacgaagggaaaatatcatctgaatcagaatatcaagtcctttttctcaaaaaaacaccaaaagttatcagccttgtgaaaaaatggaatcctcaaattactctagtaggttttaaactacttgtgaacgttactaaagaaaatctttttaaagttgctcgtcatagcttaatcaaaaataaagctacgtttattttagctaatgacctcattgatattacctcaaaacatcacatagcctacctacttgaccatgataatgtgtataaagctaccaccaaagaagatattgctcaattaatttacgaaaaggtaaaaaaatatgat

SEQ ID NO: 9836 - protein, 230 aa, Streptococcus agalactiae
MAMKILITSGGTTEKIDTVRSITNHATGTLGKIIAEKYLREGHQVTLVTTKNAVKPESATNLSTFEIEDVDSLIKTLKPLVKEHDILIHSMAVSDYTPVYMADFEKVKSSDHLDTFLRKDNHEGKISSESEYQVLFLKKTPKVISLVKKWNPQITLVGFKLLVNVTKENLFKVARHSLIKNKATFILANDLIDITSKHHIAYLLDHDNVYKATTKEDIAQLIYEKVKKYD

SEQ ID NO: 9837 - DNA, 975 bp, Streptococcus agalactiae
atgatggatttttatatcaaacagattattatacatcagttttctcctaacgacacagagttagtgctatcagatactccgctaaccctaactccaaggattgatgactactttcgtaaaaaattaagtaaagttttttctgatgaagctaagcgtggctattttggagaggataatgtatttatgagtcatttacaagatgatttatatgtttcttcctgtcaaattgcgcaactttggaaagaagagtttgtcatatcggaagatcaaaaaacgaatgacttagtttttattcaatttgacaaggatggaatggaacattttgctttccttcgaatctcattaaaggaacaatttgctcatgtttctgaaaatcaagagcagccaattacaataacacagaataaccttccaagtgctgctcaaactccagatgaagctttggttgttaacaagtcatcaaagcaatactatttaattgaaaagcgtatcaaacacaatggttcatttgctaattatttttctgaaaatttattacaagtacaaccagaacagtctgttaaaaaatctataaaaatggttgaacagacagctcaaaaaattgctgaaaatttcaacaaagatgatttttctttccaatcaaaaatgaaatcggctatttataagaatttagaagaagagcaagaattgtctccagaaaaattagcagatcaattatttgatgataatttaacagccaggctgacttttgttgatgaattgaaagacgcaatacctggacctgttcaagtaagtgatattgatcattcccgtcaaattaagaagttagagaatcagaagctatctctttcaaatggtattgaattgattgtacccaacaatgtctaccaagatgccgaatcagttgaatttatccaaaaccctgatggtacatactcaatactaatcaaaaacatacaggatattcaaaataaa

SEQ ID NO: 9838 - protein, 325 aa, Streptococcus agalactiae
MMDFYIKQIIIHQFSPNDTELVLSDTPLTLTPRIDDYFRKKLSKVFSDEAKRGYFGEDNVFMSHLQDDLYVSSCQIAQLWKEEFVISEDQKTNDLVFIQFDKDGMEHFAFLRISLKEQFAHVSENQEQPITITQNNLPSAAQTPDEALVVNKSSKQYYLIEKRIKHNGSFANYFSENLLQVQPEQSVKKSIKMVEQTAQKIAENFNKDDFSFQSKMKSAIYKNLEEEQELSPEKLADQLFDDNLTARLTFVDELKDAIPGPVQVSDIDHSRQIKKLENQKLSLSNGIELIVPNNVYQDAESVEFIQNPDGTYSILIKNIQDIQNK

SEQ ID NO: 9839 - DNA, 549 bp, Streptococcus agalactiae
atgccaacagaaacagtctacggaatttttgccaaagctttgagtgaagaagctgtgaaccacgtctatgagcttaaaaaaaggcctcgtgataaggctatgaacttaaatatatgtgattttgagactattttaaaatattctaaaaatcaaccgacctatttaaagcaattgtacgatgcttttttaccaggaccgctaaccattattttggaagcttcacaagaagttccgcattggatcaattctgggttattaagcgtaggatttcggatgcctaaacaccctgtaacccttgatatgattgctaaccatggtccactgattggtccttctgctaatatttctggatgtgatagtggtcgtgtgttctcagaaattcaaaaacagtttaatcatcaagttttaggtattgaagatgataaagcattgacaggtgtggattctactattattgatttgtctggtgatagagttaagattttaaggcaaggtgcaatcacgcaagaggtactaacggctacgatacctgaattaatttttgaaaat

SEQ ID NO: 9840 - protein, 183 aa, Streptococcus agalactiae
MPTETVYGIFAKALSEEAVNHVYELKKRPRDKAMNLNICDFETILKYSKNQPTYLKQLYDAFLPGPLTIILEASQEVPHWINSGLLSVGFRMPKHPVTLDMIANHGPLIGPSANISGCDSGRVFSEIQKQFNHQVLGIEDDKALTGVDSTIIDLSGDRVKILRQGAITQEVLTATIPELIFEN

SEQ ID NO: 9841 - DNA, 471 bp, Streptococcus agalactiae
gtggttattatgacaagcgccttggacactcgagatgaatttggagtcgtttcaagtcgtattggaatgcgtcgtgaagcagttccaatttcagatgatatggacattttctcctatattcagaatttaccacaaaagccttattgtgttttaattgatgaatgtcaatttttgagtaagaaaaacgtctacgatttagctagagtagtagatgacttagatgtaccagtcatggcttttggtttgaaaaatgatttccaaaacaatctttttgaaggttcaaaacatttgctattattggccgataagattgatgaaatcaaaacaatttgccaatactgtagtaagaaagcaaccatggttttaaggacagaaaacggaaaacctgtctatgaaggtgatcagatacaaattggtggtaatgaaacatatatcccagtttgtcgaaaacattattttaatccagatatt

SEQ ID NO: 9842 - protein, 157 aa, Streptococcus agalactiae
MVIMTSALDTRDEFGVVSSRIGMRREAVPISDDMDIFSYIQNLPQKPYCVLIDECQFLSKKNVYDLARVVDDLDVPVMAFGLKNDFQNNLFEGSKHLLLLADKIDEIKTICQYCSKKATMVLRTENGKPVYEGDQIQIGGNETYIPVCRKHYFNPDI

SEQ ID NO: 9843 - DNA, 936 bp, Streptococcus agalactiae
ttgcaactttctcatagtttaagactcatgggaacgactatcgatattcaaattaattctaaaaatgctcaaaaacaaatccgagaggtcatagaactcttggagctctacaaaaatcgctttagtgcaaatgactttaattcagagttaatggctataaataacaacgctggtatcaagcctattcaagtacatccagacctctttgaattaatcacaattgggaaagaacacagcttagctaggcctagtaacctaaatattgctattggtcctttagtgcaaacttggagaattggattttcagatgctaaactacctagccctagtgaaatatcagaagctatgattttatctgacccaactcatatacttctagattcaaataaacaatctgtttttttaaatcagataggaatgaaaattgatttgggtgcacttgcaaaaggatatatcgctgacaaaattatgacctatctcaaaaatgagatgattgattctgctattattaatttaggcggaaacgttttagttcacggagataatcctaatcgttcagaagggtattgggttatcggcattcaacatccgaaaaagaaacggggaaaaaatattggaactgtcaaaattaaaaaccaatctgttgtaacctcaggtacttatgaacgccgtctgattattgacgataaggaataccatcatatttttgatcgacagactggttatccgatacaaacagagatggctagcatttctattgtttctaaacaatccgtcgactgtgaaatctggaccacaaggttgttcggcttatccattaaagaggctcttgatattttaaacgctgtttcctacattgaaggcattatcatcactaaagatgatcgtatctatttatctgatggcttaaaacatcattttcaactattttatcat

SEQ ID NO: 9844 - protein, 312 aa, Streptococcus agalactiae
MQLSHSLRLMGTTIDIQINSKNAQKQIREVIELLELYKNRFSANDFNSELMAINNNAGIKPIQVHPDLFELITIGKEHSLARPSNLNIAIGPLVQTWRIGFSDAKLPSPSEISEAMILSDPTHILLDSNKQSVFLNQIGMKIDLGALAKGYIADKIMTYLKNEMIDSAIINLGGNVLVHGDNPNRSEGYWVIGIQHPKKKRGKNIGTVKIKNQSVVTSGTYERRLIIDDKEYHHIFDRQTGYPIQTEMASISIVSKQSVDCEIWTTRLFGLSIKEALDILNAVSYIEGIIITKDDRIYLSDGLKHHFQLFYH

SEQ ID NO: 9845 - DNA, 663 bp, Streptococcus agalactiae
atgcttttgtcagccttccacatgtacgaaaaacaactggataaagtaaggtttgtcggtgttcatacaggacatttagggttttatacagactatcgagattttgaagttgacacattaattaataatttgaaaaatgataaaggtgaacaaatctcctatcccattttgaaagtaactattacccttgaagatggtcgagttattcgtgcgcgtgctttaaatgagtctactattaagcgtattgaaaaaacaatggtagcggatgttgttattaatcaagtggtatttgaaaggtttaggggagatggcattttagtttctacaccaaccggtagtactgcttacaataaatcactagggggggcagtactccacccaacgatagaagccttgcaactaacagaaatttctagtcttaataatcgcgtctatcgtaccttggggtcatcggttatcatccccaaaaaagatgctatagagatagttcctaaacgagttggtgtctatacaatttctatagataacaaaacagtccattacaagaatgttaccaaaatagaatatagtattgacgaaaaaagtattaactttgtttcaactccaagtcacactagtttttgggaacgtgttaacgatgcttttatcggagaacctgaacat

SEQ ID NO: 9846 - protein, 221 aa, Streptococcus agalactiae
MLLSAFHMYEKQLDKVRFVGVHTGHLGFYTDYRDFEVDTLINNLKNDKGEQISYPILKVTITLEDGRVIRARALNESTIKRIEKTMVADVVINQVVFERFRGDGILVSTPTGSTAYNKSLGGAVLHPTIEALQLTEISSLNNRVYRTLGSSVIIPKKDAIEIVPKRVGVYTISIDNKTVHYKNVTKIEYSIDEKSINFVSTPSHTSFWERVNDAFIGEPEH

SEQ ID NO: 9847 - DNA, 678 bp, Streptococcus agalactiae
atgtaccatattgaattaaaaaaggaagctttattaccaagagaacgcctagttgatttaggcgcagatagattgagtaatcaggagttattagccattctcttacgtacaggtattaaagaaaaacctgttctggaaatttcaacgcaaattttagaaaacataagcagtttagcagattttggtcaattatccttacaggagttgcaatccattaaaggaatcggtcaggttaaatccgtcgaaataaaagctatgctagaactagcaaaacggattcacaaagctgaatatgatcgtaaagagcaaattttaagtagtgaacaattagcgaggaaaatgatgctcgaattaggggataaaaaacaagaacatttagtagctatttatatggatacacaaaatcgtattatcgaacagagaactatttttattggtactgtacgtcgttcagtagcagagccaagagaaattctacattatgcttgtaaaaacatggcaacttctttgattatcatacataatcatccctcaggttctccaaagcccagtgaaagtgatttaagtttcactaaaaaaataaaacgatcatgtgatcatctgggaattgtctgcctagatcacatcatcgttggaaaaaataaatattatagttttcgagaagaagcagatatttta

SEQ ID NO: 9848 - protein, 226 aa, Streptococcus agalactiae
MYHIELKKEALLPRERLVDLGADRLSNQELLAILLRTGIKEKPVLEISTQILENISSLADFGQLSLQELQSIKGIGQVKSVEIKAMLELAKRIHKAEYDRKEQILSSEQLARKMMLELGDKKQEHLVAIYMDTQNRIIEQRTIFIGTVRRSVAEPREILHYACKNMATSLIIIHNHPSGSPKPSESDLSFTKKIKRSCDHLGIVCLDHIIVGKNKYYSFREEADIL

SEQ ID NO: 9849 - DNA, 1434 bp, Streptococcus agalactiae
atggtaaaacaagtatttccaaaaggttttttatggggcggggcaactgctgccaatcaatgcgaaggagcttacaatgttgatggacgtggcctagcaaatgtagatgttgttcctactggagaagatcgatttgcaattatttcaggacaaaagaaaatgtttgattttgaggaaggatacttttatccagcaaaagaatcaatagatttttatcaccattataaagaggaccttgcattacttgcagaaatgggtttcaaaacctatcgtatgtcaatagcatggacgcgtatttttccaaagggtgatgagctatatccaaatgaagctggtcttcagttttatgaaaatatttttaaagagtgtcgtaagtatggtattgaacctttggtaaccattacacattttgactgtcctatctaccttattaaacattacggtgggtggcggagccgtaaaatgattggtttttatgagcgccttgtacgagctttatttactcgttttaaggggttagttaaatattggttgacctttaacgaaatcaatatgattttacacgctccttttatgggcgctggcttatattttgaagatggtgaaaatcaagagcaaattaaatatcaagcagctcaccatgagttagtggcttcggctattgcagtaaaaattgctcatgaagttgatccaaataatcaaatcggatgtatgctagctgcaggtcaatactatccaaatacgtgtcatccacaagattattgggcttcgatgcaaaaaaatagagaaaattatttttttattgatgtgcaagctcgtggcaaataccctaattatgctaaaaaacattttgagcatttaggtatttcaattcaaatgacagcagaagatcttgctttgttaagagactatacggttgattttatttcattttcttactattcaagccgagtagcttcaggtaatccaactgtcagtgaacaggttcaagaaaatattttcgcatctcttaagaatccttacttgaaatcttctgaatggggatggcaaattgatccgcttggattacgtattaccttaaatgctatctgggatcgttatcaaaaaccgatgtttattgttgaaaatggacttggagcagtagatattcctgatgagaatggttacgtagaagatgattatcgtattgattacctccgtcagcacattgctgcaatgagagatgctatatatgtagatggtgttaatctaattggctatactacatggggatgtattgatttagtatctgcaggaactggtgaaatggaaaaacgctatggtttcatttatgttgatcgcaataataaaggagaggggacactcaagcgttacaagaaaaaatcgttttattggtacaagaaggttattgcaagtaatggcagtcaaatagaa

SEQ ID NO: 9850 - protein, 478 aa, Streptococcus agalactiae
MVKQVFPKGFLWGGATAANQCEGAYNVDGRGLANVDVVPTGEDRFAIISGQKKMFDFEEGYFYPAKESIDFYHHYKEDLALLAEMGFKTYRMSIAWTRIFPKGDELYPNEAGLQFYENIFKECRKYGIEPLVTITHFDCPIYLIKHYGGWRSRKMIGFYERLVRALFTRFKGLVKYWLTFNEINMILHAPFMGAGLYFEDGENQEQIKYQAAHHELVASAIAVKIAHEVDPNNQIGCMLAAGQYYPNTCHPQDYWASMQKNRENYFFIDVQARGKYPNYAKKHFEHLGISIQMTAEDLALLRDYTVDFISFSYYSSRVASGNPTVSEQVQENIFASLKNPYLKSSEWGWQIDPLGLRITLNAIWDRYQKPMFIVENGLGAVDIPDENGYVEDDYRIDYLRQHIAAMRDAIYVDGVNLIGYTTWGCIDLVSAGTGEMEKRYGFIYVDRNNKGEGTLKRYKKKSFYWYKKVIASNGSQIE

SEQ ID NO: 9851 - DNA, 795 bp, Streptococcus agalactiae
atggatggaacttttctacgctcagataaaacttatgataaagcacggttttcttctttattaacgttgatggagaagtatgatattaaatttgtagctgctagtggtaatttatacgatcaattgttgttaaactttttggaataccctaatcgtatcgcctacgtcgctgaaaatggtggtcgtgtcattgaccaagatggcacattactaaaagaaacttatttatctaatgatacagttgcagctgttttatcctatttatatcagaactatcctgagacactcatcagcttatctggtgaaaaacgttcataccttgagcgaagaactcctattaataggcggactgaattagaatactatatgcctaattttatctataaagaccatttgctgcccttagatgatgaccgctattttcaaatgacactttgggtaaatgaaaatcttgtttctgagatgttgttagatattagtgaacactttaaaaatcatcatatcagattgacctctagtggttttggttgtatcgatgtcttaccagctgatgtcaataaagcggatggtatcgctattctccttgaaaagtggggattgaaacaggatcaagtgatggtttttggtgatgggggcaatgatgtggaaatgttgagagcagcaaatatttcttacgctatgtcaaatgcgccagaagaaattaaagctattgctaaatatcaaacagttagtaacgatcaagatggtgtgttagaaacgatagagaactttcttcacaagatgagtgataatgaa

SEQ ID NO: 9852 - protein, 265 aa, Streptococcus agalactiae
MDGTFLRSDKTYDKARFSSLLTLMEKYDIKFVAASGNLYDQLLLNFLEYPNRIAYVAENGGRVIDQDGTLLKETYLSNDTVAAVLSYLYQNYPETLISLSGEKRSYLERRTPINRRTELEYYMPNFIYKDHLLPLDDDRYFQMTLWVNENLVSEMLLDISEHFKNHHIRLTSSGFGCIDVLPADVNKADGIAILLEKWGLKQDQVMVFGDGGNDVEMLRAANISYAMSNAPEEIKAIAKYQTVSNDQDGVLETIENFLHKMSDNE

SEQ ID NO: 9853 - DNA, 792 bp, Streptococcus agalactiae
atgaagaaaacctctagtctattttcaattccttatatggcttggttattcttatttgtattagcacctgttgctttgattgcttggaactcgttctttgatattaatgggcactttactttagctaattaccagacgttttttagctcaggaacctatcttaaaatgagctttaactcggtcctatatgcaggcatcgttagtttcataacgcttttgattagctatccagctgcttatttgcttacaaaattaaaacacaagcaattatggctaatgctagttattttgccaacatggattaatcttttgttaaaagcctatgcttttatggggatatttggtcaacaagggggaattaacgccttcttaacctttataggtatcggcccaaaacagattctatttacagacttttcatttctttttgtagcagcttacattgaattaccgtttatgttattacccatttttaatgccttggatgatattgatcaaaatctcatttatgcaagtgatgacttgggtgcaaatgcatggcaaacttttcagaaggttatatttcctttatctctgaatggtgtaagagcaggtgtacagtctgtctttatccctagtttgagtctctttatgcttacgcgtcttattggtggtaatcgagttatcactttagggacagccatagaacaacattttttaatcacacaaaataaaggtatgggctcaaccataggggttattttaattttagtgatggttgctattatgtggttaacaaaggagaggaaagca

SEQ ID NO: 9854 - protein, 264 aa, Streptococcus agalactiae
MKKTSSLFSIPYMAWLFLFVLAPVALIAWNSFFDINGHFTLANYQTFFSSGTYLKMSFNSVLYAGIVSFITLLISYPAAYLLTKLKHKQLWLMLVILPTWINLLLKAYAFMGIFGQQGGINAFLTFIGIGPKQILFTDFSFLFVAAYIELPFMLLPIFNALDDIDQNLIYASDDLGANAWQTFQKVIFPLSLNGVRAGVQSVFIPSLSLFMLTRLIGGNRVITLGTAIEQHFLITQNKGMGSTIGVILILVMVAIMWLTKERKA

SEQ ID NO: 9855 - DNA, 1179 bp, Streptococcus agalactiae
atgctagagcagctgggaaaccctcaaaacaacctatctgccattcatgttgttggaacgaatggtaaaggatcaacaactagttatttacaacatatttttaccaattctggttatcaagttggaacatttacatcaccatatattgttgactttagagagcgtattagcattgatggtcaaatgattccagagtctgattttatcaaacttgttgaaactgttcgtccagttgttgaacggttgcaccttgagaccaacctagaaccagctacagaatttgaagttataacagttttgatgttctattattttggcaatagctgtccggttgatatcgtcattattgaggctggaatgggcggttattatgattctaccaacatgttcaaggctttagcggttacttgtccgtcaattggattagatcatcaggaggttttaggacgaacttatgtagatatagctgagcaaaaagtaggtgttttaaaaaaaggagttccattcgtatatgctaatgatcgtcaggatgttgaagaagtctttcaaataaaagccaaggaaacccacagccagacttatcgtttacacaatgacttttatataaaagaagaggaaaattattttaactatataggtcctcaagcaaatattgatcatattcagttgcaaatgccgggacatcaccaagtttccaatgctagcatagctataactaccagtttattattaagagacaaatatccaaagttaaccctacagaccattaaagatgggcttgaaatgacaaaatgggtaggccgtacagaattaatctttccgaatgtaatgattgatggcgctcataataatgaaagtgtcgatgctctcgttcaagttataaaaaaatatcagcagaaaaacgtgcatattctatttgctgcaattaatactaaaccgatagagagtatgttagaatcattgtctagtatcgctccggtttcggttactagctttgattaccctaaatcaataaacttagacaaatatcctaaagcgtacactagagttagtgattggaagaaatggctacatgatataaatctgacatcagataaagatttctatgtgattactggctccctttattttatttctcaagttcgtcaggagctactattaatcaaaactacaacaact

SEQ ID NO: 9856 - protein, 393 aa, Streptococcus agalactiae
MLEQLGNPQNNLSAIHVVGTNGKGSTTSYLQHIFTNSGYQVGTFTSPYIVDFRERISIDGQMIPESDFIKLVETVRPVVERLHLETNLEPATEFEVITVLMFYYFGNSCPVDIVIIEAGMGGYYDSTNMFKALAVTCPSIGLDHQEVLGRTYVDIAEQKVGVLKKGVPFVYANDRQDVEEVFQIKAKETHSQTYRLHNDFYIKEEENYFNYIGPQANIDHIQLQMPGHHQVSNASIAITTSLLLRDKYPKLTLQTIKDGLEMTKWVGRTELIFPNVMIDGAHNNESVDALVQVIKKYQQKNVHILFAAINTKPIESMLESLSSIAPVSVTSFDYPKSINLDKYPKAYTRVSDWKKWLHDINLTSDKDFYVITGSLYFISQVRQELLLIKTTTT

SEQ ID NO: 9857 - DNA, 1281 bp, Streptococcus agalactiae
atgactattaaaatagctttattaggttttggaacggttgctaagggtattccatatttgctaaaagaaaatcaacataagctactttctttagaaggcgaagatattgtgattgataaagtattagtaagagataatgaaagccgccagcgtttcatcaatcagggatttacttataactttgtgacagagataaatactattcttcaagattcacaaattgatattgtagtggaattaatgggggggattgagccagctaaaacttatttgagtcaagcattaggatttggtaaacatattgtgacagccaataaagatctcattgctttacacggaaaagagttgatggatttagcagacgctagaggtctagctttattctatgagggagcagttgctggaggcattcctattttaaggaccctatcgcattcgtttgcctcagataaaatgacacgtttattaggaattctcaacggtacctccaacttcatgttaacaaaaatgtttgaagagggatggtcttatgaacaagctctaaaaaaggcacaagagttaggttatgctgaaagtgatcccacaaatgatgttgaaggtattgatactgcctacaaagccactatcttaagtcaatttggatttggtatgcctattgattttgatgatgttaattataaggggatttctagtattcgctcagaggatgttgaagtagctcaggagatgggctttgccattaagttggtagctgatcttcgtgaaactccaactggtataagtgtagacgtttctccgacactaatttctcaaaagcatcccttagctgcagttaatcatgtgatgaatgcagtattcattgaatcaatagggattggtcagtctcttttttatggaccaggtgcgggacaaaatccaacagcaacctctgttttagcggatatcatcgatattagtcgtagtattcgatcacagataaaaattaagcctatgaatacttatcattgtccgtgtaggttgtcaatgcagtctgatattttcaatgagtactatctagctatttctttgagaaatgctgaagatagtgatacacttggaaggtactttgagcaagaaaatataggtttgaaaaatgttatcgaaaaagcattgggtgataaacaacaagaaatctatgtattaacagatgaagttagccaagagaaaataactcaatttattgaggagtttcctgagagtggtgtcattcagttaatcaatgttttcaaagtaataggaggg

SEQ ID NO: 9858 - protein, 427 aa, Streptococcus agalactiae
MTIKIALLGFGTVAKGIPYLLKENQHKLLSLEGEDIVIDKVLVRDNESRQRFINQGFTYNFVTEINTILQDSQIDIVVELMGGIEPAKTYLSQALGFGKHIVTANKDLIALHGKELMDLADARGLALFYEGAVAGGIPILRTLSHSFASDKMTRLLGILNGTSNFMLTKMFEEGWSYEQALKKAQELGYAESDPTNDVEGIDTAYKATILSQFGFGMPIDFDDVNYKGISSIRSEDVEVAQEMGFAIKLVADLRETPTGISVDVSPTLISQKHPLAAVNHVMNAVFIESIGIGQSLFYGPGAGQNPTATSVLADIIDISRSIRSQIKIKPMNTYHCPCRLSMQSDIFNEYYLAISLRNAEDSDTLGRYFEQENIGLKNVIEKALGDKQQEIYVLTDEVSQEKITQFIEEFPESGVIQLINVFKVIGG

SEQ ID NO: 9859 - DNA, 1374 bp, Streptococcus agalactiae
atggcatataaaacaatttatccgtacactaacgaagtattgcatgaattcgataatatcagtgacagtgatctcgaacagtcattagacatagcgcatgccctctacaagacatggcgcaaagaagataatgttgaagaacgccaaaatcaattgcataaagtagcagatttattacgtaaggatcgtgataagtacgctgaagttatgactaaagatatgggaaaacttttcactgaagcacaaggagaagtggacttgtgtgcagacatagctgactattatgctgataatgggcaaaagtttttaaaacctgttccgttagaaagtccaaatggagaggcttactatttgaagcaagctgtcggtgttttacttgctgtcgagccatggaatttcccattttatcagattatgcgtgtatttgcccctaactttatagtgggtaatactatgcttttaaaacatgcttctatttgtcctgcctcagctcaagcgtttgaggatttagtccgagaagcaggagctccagaaggagcgtttaaaaatatttttgcttcgtatgatcaagtttcaaaccttatatcagatcctcgtgttgcaggtgtgtgtttaactggttctgagcgtggtggggcatcaatagcagctgaagctggtaaaaatttgaaaaaatcgtctatggaattaggtgggaacgatgcttttcttattttagatgatgctgattttgatttacttagtaaaacaatattctttgcgcgtttatataatgcaggtcaagtatgtacatcttcaaaacgtttcattgtcatggctgataagtatgacgaatttgtaaatatggtagttgagacctttaagtctgctaaatggggcgacccaatggattcggaaacaaccttggctccactgtcatctgcaggtgcaaaggatgatgttttaaaacaaattaaattggcggtagaccacggtgctgaggtagtttttggaaatgacactatagatcatccaggaaacttcgtcatgccaactgttttaacgaatatcactaaagcaaatccaatctataatcaagaaattttcggccccgtagcctctatctataaagtggatactgaagaagaagctattgctttagctaatgattctagttatggtttaggaagcactgttttttcttctgatccagaacatgctaaaaaagtggcggctcagattgaaacagggatgacatttattaattcagggtggacatcattaccggaattaccgtttggaggtattaaaaattcaggatatggtcgtgagttgagccaacttggatttgatgcctttgtcaacgaacatttggtatttacaccaaatagtgat

SEQ ID NO: 9860 - protein, 458 aa, Streptococcus agalactiae
MAYKTIYPYTNEVLHEFDNISDSDLEQSLDIAHALYKTWRKEDNVEERQNQLHKVADLLRKDRDKYAEVMTKDMGKLFTEAQGEVDLCADIADYYADNGQKFLKPVPLESPNGEAYYLKQAVGVLLAVEPWNFPFYQIMRVFAPNFIVGNTMLLKHASICPASAQAFEDLVREAGAPEGAFKNIFASYDQVSNLISDPRVAGVCLTGSERGGASIAAEAGKNLKKSSMELGGNDAFLILDDADFDLLSKTIFFARLYNAGQVCTSSKRFIVMADKYDEFVNMVVETFKSAKWGDPMDSETTLAPLSSAGAKDDVLKQIKLAVDHGAEVVFGNDTIDHPGNFVMPTVLTNITKANPIYNQEIFGPVASIYKVDTEEEAIALANDSSYGLGSTVFSSDPEHAKKVAAQIETGMTFINSGWTSLPELPFGGIKNSGYGRELSQLGFDAFVNEHLVFTPNSD

SEQ ID NO: 9861 - DNA, 1005 bp, Streptococcus agalactiae
atgttatttaaggaaaaaattcctggattaatattatgctttattattgctataccatcttggttgcttgggctttatctccctttaataggagcaccagtttttgctatcttgattggaataattgttggatccttttatcaaaatcgacaattatttaataagggtattgcttttacatctaaatatattttacaaacagcagttgtcttattaggttttggactaaacctcatgcaagtgatgaaagttggtatatcatcgttacccatcattattatgacgatttccatttcattgattattgcttatgttttgcaaaagttatttaagttagataaaacgattgctactttaataggtgttggttcatctatttgtggtgggtccgcaattgcagcgactgcaccagttattaatgctaaagatgatgaagtagcacaagctatttcggttatttttttattcaatatcttagcggctttaatttttccaacgctggggaattttattggtctctctgatcacggttttgcattatttgcagggactgctgtcaatgatacctcgtcagttacagcaactgctactgcatgggatgctatcaatcacagcaatactttgggcggagctactattgttaaattgacacgaacattagccatcattccaattacgattgtattatctatttaccatatgaaacaaacgcagaaagaacaatctgtaagtgttactaagatatttccgaagtttgtgctttattttatcttagcttctttgctaacaacgatagttgcttcattaggtttttcgttacgtatctttgagccacttaaggttttatctaaattttttattgttatggcaatgggggcaattggtataaatactaatgttagcaaactaattaaaactggaggaaaatcaattcttttaggtgcagcgtgttggttaggcattattatagttagtttaacaatgcaagctatccttggaacttgg

SEQ ID NO: 9862 - protein, 335 aa, Streptococcus agalactiae
MLFKEKIPGLILCFIIAIPSWLLGLYLPLIGAPVFAILIGIIVGSFYQNRQLFNKGIAFTSKYILQTAVVLLGFGLNLMQVMKVGISSLPIIIMTISISLIIAYVLQKLFKLDKTIATLIGVGSSICGGSAIAATAPVINAKDDEVAQAISVIFLFNILAALIFPTLGNFIGLSDHGFALFAGTAVNDTSSVTATATAWDAINHSNTLGGATIVKLTRTLAIIPITIVLSIYHMKQTQKEQSVSVTKIFPKFVLYFILASLLTTIVASLGFSLRIFEPLKVLSKFFIVMAMGAIGINTNVSKLIKTGGKSILLGAACWLGIIIVSLTMQAILGTW

SEQ ID NO: 9863 - DNA, 2277 bp, Streptococcus agalactiae
atgaatcctttaataattggaatgaatgataaacaagcagaagcggtacaaacgacagacggaccgcttttgattatggcaggagctggctctggaaaaacacgtgttctgactcatcgtattgcttatttaatagatgaaaaatatgttaatccttggaatattttagcgattacttttactaataaagcagcgcgtgaaatgcgtgaacgtgctatcgccttgaatccagctacccaagatactttgattgcaacttttcatagtatgtgtgttcgtattttacgtcgtgaagctgattatattggatataatcgtaactttacaatcgttgatccaggtgagcagcgtactttaatgaagcgaatcattaagcaattaaatttggacacaaaaaagtggaatgaacgttcaattttaggtacaatctctaatgctaaaaatgaccttcttgatgaaattgcatatgagaagcaagccggagatatgtatacacaggtaattgctaaatgctataaagcttatcaagaggaattacgtagaagtgaggccatggatttcgatgacttgattatgatgacacttcgattatttgatcagaataaagatgttttggcctattaccaacagaggtatcaatatatccatgtagacgagtatcaagatactaaccacgctcaataccaattagttaagttattagcttcgcgtttcaaaaatatttgtgttgttggtgatgccgatcaatccatttacggatggcgtggagctgatatgcaaaatattcttgattttgaaaaggactatccgcaagccaaagttgtattattagaagaaaattatcgatcgactaagaaaatacttcaagctgctaataatgtgattaatcataataaaaatcgccgtcccaaaaaattatggactcaaaatgatgaaggtgagcaaattgtatatcatagagctaacaacgagcaagaagaagcagtttttgtagcatcaactattgataacatcgttcgagaacaaggaaaaaatttcaaagattttgccgttctttatcgtacgaatgcgcaatctcgtactattgaggaagcacttttaaaatccaatattccatatacaatggttggtggaacaaaattctatagtcgtaaagaaattcgagatgttattgcttatctcaatatccttgcaaatacttctgataatatttcttttgagcggattgtaaatgaacctaaaagaggggtggggccaggaactttagaaaaaatacggtcatttgcctatgaacagagcatgtctcttcttgatgcctcttcaaatgtcatgatgtcgcccttaaaagggaaggctgctcaagctgtttgggatttagctaatctgattttgactctacgtagtaatctagatagtttaactgtaacggagattacagaaaacctactggataagacaggatatctagaagcacttcaagttcaaaatacattagaaagtcaagcgcgtattgaaaatattgaagaattcttgtcagtgactaaaaattttgacgataacccagagattacagtagagggtgaaactggtttagatcgtctatcgcgttttttaaatgatttagctttaatagcagatactgatgatagcgccactgaaacggctgaggtcactttaatgacattacatgctgccaagggtctagaatttccagttgttttcttaatcggtatggaagaaggagtatttcctttatcgcgtgcaatagaggatgctgatgaattagaagaagagcgtcgtttagcttatgtcgggattacgagagcagaacaaatacttttccttaccaatgctaatacccgtactttatttggtaaaactagttataatagaccaacccgttttatacgtgagattgatgatgaactgatacaataccaagggttagctcgaccagttaattcttcatttggtgtgaaatattcaaaagaacagcctacacaatttggtcaaggaatgagtcttcaacaagcgcttcaggcacgtaaaagtaattcacaatctcaagtaactgcccaactccaggctcttaacgcgaacaatagccatgagacatcatgggagattggtgatgttgcaactcataaaaaatggggggacggtacggtgcttgaagtttcaggtagcggaaagactcaagagttaaaaataaattttccaggtattgggttaaagaaattattagcgagtgtcgctcctattagcaaaaaggaaaac

SEQ ID NO: 9864 - protein, 759 aa, Streptococcus agalactiae
MNPLIIGMNDKQAEAVQTTDGPLLIMAGAGSGKTRVLTHRIAYLIDEKYVNPWNILAITFTNKAAREMRERAIALNPATQDTLIATFHSMCVRILRREADYIGYNRNFTIVDPGEQRTLMKRIIKQLNLDTKKWNERSILGTISNAKNDLLDEIAYEKQAGDMYTQVIAKCYKAYQEELRRSEAMDFDDLIMMTLRLFDQNKDVLAYYQQRYQYIHVDEYQDTNHAQYQLVKLLASRFKNICVVGDADQSIYGWRGADMQNILDFEKDYPQAKVVLLEENYRSTKKILQAANNVINHNKNRRPKKLWTQNDEGEQIVYHRANNEQEEAVFVASTIDNIVREQGKNFKDFAVLYRTNAQSRTIEEALLKSNIPYTMVGGTKFYSRKEIRDVIAYLNILANTSDNISFERIVNEPKRGVGPGTLEKIRSFAYEQSMSLLDASSNVMMSPLKGKAAQAVWDLANLILTLRSNLDSLTVTEITENLLDKTGYLEALQVQNTLESQARIENIEEFLSVTKNFDDNPEITVEGETGLDRLSRFLNDLALIADTDDSATETAEVTLMTLHAAKGLEFPVVFLIGMEEGVFPLSRAIEDADELEEERRLAYVGITRAEQILFLTNANTRTLFGKTSYNRPTRFIREIDDELIQYQGLARPVNSSFGVKYSKEQPTQFGQGMSLQQALQARKSNSQSQVTAQLQALNANNSHETSWEIGDVATHKKWGDGTVLEVSGSGKTQELKINFPGIGLKKLLASVAPISKKEN

SEQ ID NO: 9865 - DNA, 1323 bp, Streptococcus agalactiae
atgactttaaatgctaaaggtgaaagtaatcaaattctagtagataaggaagtacattctactaacttattactagatatcgatgaaaaaccagaattatttcaaggtttgctgttaagttttcaacatgtttttgccatgtttggagctacgatattagttccgcttattttagggatgcctgtatcagtggctttatttgcttctggttgcggaacgctcatttatcaagttgcgacaaaatttaaagtccctgtttacctaggctcatcatttgcttatattacagctatggcattagccatgaaacaaatgcatggcgatatttcggctgctcaaacaggtattctttttgtaggtctaatctatgtcgttgtggcgacggttattaagttcgtaggaaattcatgggttgataagattttgccaccaataatcattggacctatgattattgttattggtttaggtttggcaaactctgctgtaactaatgcaggttttgtcgctaaaggtgattggcgtaaaatgctagttgctgttgttacattcttgattgcagcttttatcaatactaaagggaaaggttttatcaagattattccatttttatttgcaattattggaggttatattttatcaatcattcttggcttggtagatttatctccagttgaaaaagctgcctggtttgaattgccaaaattctatttaccgtttaagacaggtttatttcacagttataaactttactttggaccagaaatgcttgccattcttccaatctcaattgtaacgattgctgaaaatatcggtgatcatacagttttaggtcagatttgtgggcgtaactttctaaaaaaaccaggtttaaatcgtcttttaattggagatggtttagcaaccgcattttctgctcttataggaggaccagctgaaactacttatggtgaaaatacaggtgttattggcatgacgcgtatagcttctgtaacggttattcgtaatgcagcttttattgcaatcgctttttcattctttggtaaatttacagctttgatctctacaattcctagtgcagtacttggtggaatggctatattactttatggtgttattgcaagtaatggattaaaagtgttgattgaaaatcgtgtcaattttgctgaggttcgtaatctgattattgctagttccatgttagttttaggcctcggtggagcagtccttgatctaggtgctctaactttatcaggaacagcattaagtgctatagtgggtattatattaaatttaatattgccaaaagaaagcatgaaatca

SEQ ID NO: 9866 - protein, 441 aa, Streptococcus agalactiae
MTLNAKGESNQILVDKEVHSTNLLLDIDEKPELFQGLLLSFQHVFAMFGATILVPLILGMPVSVALFASGCGTLIYQVATKFKVPVYLGSSFAYITAMALAMKQMHGDISAAQTGILFVGLIYVVVATVIKFVGNSWVDKILPPIIIGPMIIVIGLGLANSAVTNAGFVAKGDWRKMLVAVVTFLIAAFINTKGKGFIKIIPFLFAIIGGYILSIILGLVDLSPVEKAAWFELPKFYLPFKTGLFHSYKLYFGPEMLAILPISIVTIAENIGDHTVLGQICGRNFLKKPGLNRLLIGDGLATAFSALIGGPAETTYGENTGVIGMTRIASVTVIRNAAFIAIAFSFFGKFTALISTIPSAVLGGMAILLYGVIASNGLKVLIENRVNFAEVRNLIIASSMLVLGLGGAVLDLGALTLSGTALSAIVGIILNLILPKESMKS

SEQ ID NO: 9867 - DNA, 1344 bp, Streptococcus agalactiae
atgctaacactttttactcatatcaatagcttcgtttggggtccacctttacttgctttattagtcggaacaggtatttacctatcatttcgcttaggttttattcaattgagacaactttctagagctttcaaattgattttccgagaggataacgggcaaggagatatttcaagttatgctgcccttgcaactgctcttgctgcaacggtagggacaggtaatatcgttggtgtggctacggctattaaatctggaggaccaggagctttgttttggatgtgggtagctgccttttttggaatggcaacaaaatacgcagaaggattattagctatcaaatatcgcacaaaagatactaatggagaaatttctggaggaccgatgtactacattatcaatggaatgggacaaaaatggaaaccattagcagtctttttttctgcagcaggtatcttagtagctcttttaggaatagggacattcactcaagtcaatgcaattgcttcttctcttgagcatactttcaaaatatcaactagatttaccagcctcattcttgctgttatagtattatttattatatttggaggtataaaatctatttcaaaagtttcagaaaaaatagtgccttttatggctataagctatattttagcaactctgattattattgcagttaattacaataagattccacatactttccaactcatctttagcggtgctttttctgggacagcagccattggtggtttttctggagctatcgttaaagaagcaattcaaaagggaattgctagaggagttttctcaaatgaatctggattgggttctgctccaatagccgcagcagcagctaaaacaaaagaacctgttgaacaaggccttatttcaatgacaggaaccttcattgacactattgttatttgtactttgacagggattgcaattttagttacaggaaaatggctagaatttgatttacagggtgctccgttaacacaagcatcttttaataccgtatttggctcactaggtagttttgccctaaccttttgccttgtcttatttgcttttactactattttaggatggagctattacggagagcgttgctttgaatatctatttgggactaaatttattaacgcttatcgcattatttttgtcattatggtcggcttaggtggtttcttacagctcgatctcatttgggttatcgctgatatcgttaatggtttaatggctttacccaatctaatagctctcctagctttgtcaccaattattgttaaagaaacacagaaatatttttcagagactaaaaatatcactaagcct

SEQ ID NO: 9868 - protein, 448 aa, Streptococcus agalactiae
MLTLFTHINSFVWGPPLLALLVGTGIYLSFRLGFIQLRQLSRAFKLIFREDNGQGDISSYAALATALAATVGTGNIVGVATAIKSGGPGALFWMWVAAFFGMATKYAEGLLAIKYRTKDTNGEISGGPMYYIINGMGQKWKPLAVFFSAAGILVALLGIGTFTQVNAIASSLEHTFKISTRFTSLILAVIVLFIIFGGIKSISKVSEKIVPFMAISYILATLIIIAVNYNKIPHTFQLIFSGAFSGTAAIGGFSGAIVKEAIQKGIARGVFSNESGLGSAPIAAAAAKTKEPVEQGLISMTGTFIDTIVICTLTGIAILVTGKWLEFDLQGAPLTQASFNTVFGSLGSFALTFCLVLFAFTTILGWSYYGERCFEYLFGTKFINAYRIIFVIMVGLGGFLQLDLIWVIADIVNGLMALPNLIALLALSPIIVKETQKYFSETKNITKP

SEQ ID NO: 9869 - DNA, 705 bp, Streptococcus agalactiae
ttggaggtaaaaatggcaactttaacgaataaccctatctttggtattatgttaaccgtatgggcgtattacattggcataaggatttttagaaaatatccttcccctgcaacaactccacttcttttggcgactattttattaattgcttttttaaaattaacacatatctcctataaagattactacaatggcggttcatttctaacgatgttaattacgccttcaacggttgtattggctattcctctctatagaacctttcatttaatgaagcatcacattaaaagcattagcattagcatcatcttagcttctgttatcaacacagtttttaccgcaatagttgctaagttttttggtatgaaatatttcttagcaatctcacttttcccaaagtccgtaactacagctatggccgttggaattacaagtaaagcaggtggattagctactatcactctggtcgtagttgttattacaggcatcttaacaagcgttttgggtcctatttttctaaaattattaaggatagaagatcctgttgctatagggctcgcgctaggaggaactgggcatgctataggaactggacaagccttaaaatatggccaagttcaaggcgccatggctggactagcaattggtatcacagggatttgctatgttattgtcagtcctttagttgcaggcttaatattgaaa

SEQ ID NO: 9870 - protein, 235 aa, Streptococcus agalactiae
MEVKMATLTNNPIFGIMLTVWAYYIGIRIFRKYPSPATTPLLLATILLIAFLKLTHISYKDYYNGGSFLTMLITPSTVVLAIPLYRTFHLMKHHIKSISISIILASVINTVFTAIVAKFFGMKYFLAISLFPKSVTTAMAVGITSKAGGLATITLVVVVITGILTSVLGPIFLKLLRIEDPVAIGLALGGTGHAIGTGQALKYGQVQGAMAGLAIGITGICYVIVSPLVAGLILK

SEQ ID NO: 9871 - DNA, 1947 bp, Streptococcus agalactiae
ttggctaaacaagatataacagtgacgaattatggcgacgatgctattcaagtcttagaaggattagatgctgttcgtaagcgtccagggatgtatatcggttccacagatggaactggtttacatcatttagtgtgggaaattgtagataatgcagttgatgaagctctatcaggttttggaaatcgcattgatgttattattaacaaagatgggagtataactgttacagaccatggacgcggtatgccaactggaatgcatgctatgggaaaacctactgttgaagtcatcttcacggtgcttcatgcaggtggaaaatttggacaaggtggttataaaacatcaggtggtctccatggtgttggatcatctgtagttaatgctttgtcttcttggttagaagttgaaatcattcgcgacggagctatttacagacaacgttttgaaaatggtggtaagcccgttacaactctgaaaaaaattggcacggcaccaaaatcaaaatctggaacttctgtcagctttatgccagatcaatcagtattttcaacgatagattttaagtttaatacaattgcagagcgcttaaaggaatctgcttttctcttaaaaaatgttactttaaccttaacagataatcgttcagaagaagcagagcatctagaatttcattatgaaaacggtgttcaagattttgtagagtatttaaatgaagataaagaaacgttgacaccaatcatgtttttcgaaggtgaagaacaagaatttcatatcgaagttgctttgcagtataatgatggtttttcagataatatcctttcttttgtcaataatgttcgtactaaagatggtggaacacatgaaactggcttgaaatcagctattacaaagtctatgaatgactatgcacgtaaaacaggacttcttaaagaaaaagataaaaaccttgaaggttctgattatcgtgaggggctatcagccattttatctattcttgtacctgaggagcacttgcaatttgaaggtcaaactaaagataaactaggaagtcccttagcacgaccaattgttgatggtattgtttctgaaaagttaacttactttcttatggaaaatggagatttagcatctaatttaatccgtaaggcaataaaagcacgtgatgcgcgtgaagctgcacgtaaagcacgtgatgaaagtaggaatgggaaaaagtcgaaaaaagataaaggtctactttctggaaaattaacccctgcacaatcaaaaaatgctaagaaaaatgaactctatttagtcgaaggagactctgcaggtggctctgctaagcaaggtcgtgatagaaagtttcaagctattttaccgttgcgaggaaaagtattgaatacagctaaggcaaagatggctgatattataaaaaacgaagaaattaatacaatgatccataccattggtgcaggtgttggtcctgattttaatcttgacgatattaattatgataaaattatcattatgaccgatgctgatactgacggagctcatattcagacactattattaactttcttttatcgctatatgagacctcttgttgaagagggacatgtctatattgctttgccacctttgtataaaatgtcaaaaggaaaaggtaagaaagaaattgttgagtatgcttggacggatatagagttagaagaattacgacaaaaatttggtaaaggctcactattacaacgatataaagggcttggggaaatgaatgccgatcaattgtgggaaaccactatgaaccctgagacaaggacattaattcgtgtaacaattgaagatttagcaagagcagaacgtcgagttaatgtcttgatgggtgataaagttcctccaagacgccaatggattgaagataatgtcaagtttactttagaagagaatacagtattt

SEQ ID NO: 9872 - protein, 649 aa, Streptococcus agalactiae
MAKQDITVTNYGDDAIQVLEGLDAVRKRPGMYIGSTDGTGLHHLVWEIVDNAVDEALSGFGNRIDVIINKDGSITVTDHGRGMPTGMHAMGKPTVEVIFTVLHAGGKFGQGGYKTSGGLHGVGSSVVNALSSWLEVEIIRDGAIYRQRFENGGKPVTTLKKIGTAPKSKSGTSVSFMPDQSVFSTIDFKFNTIAERLKESAFLLKNVTLTLTDNRSEEAEHLEFHYENGVQDFVEYLNEDKETLTPIMFFEGEEQEFHIEVALQYNDGFSDNILSFVNNVRTKDGGTHETGLKSAITKSMNDYARKTGLLKEKDKNLEGSDYREGLSAILSILVPEEHLQFEGQTKDKLGSPLARPIVDGIVSEKLTYFLMENGDLASNLIRKAIKARDAREAARKARDESRNGKKSKKDKGLLSGKLTPAQSKNAKKNELYLVEGDSAGGSAKQGRDRKFQAILPLRGKVLNTAKAKMADIIKNEEINTMIHTIGAGVGPDFNLDDINYDKIIIMTDADTDGAHIQTLLLTFFYRYMRPLVEEGHVYIALPPLYKMSKGKGKKEIVEYAWTDIELEELRQKFGKGSLLQRYKGLGEMNADQLWETTMNPETRTLIRVTIEDLARAERRVNVLMGDKVPPRRQWIEDNVKFTLEENTVF

SEQ ID NO: 9873 - DNA, 621 bp, Streptococcus agalactiae
atgattatcattgcctatctgttaggctctatccaaactggactttggattggtaaatatttttaccaagtcaatcttcgtcaacacggtagtggtaatactggcaccacgaataccttccgtattttaggtgtaaaagctggcattgtcactttgactattgacattttaaaagggactctagcaacacttattcctatcatattaggtataacgacagtatctccattttttatcggtttttttgctattataggtcacactttccctatttttgcacaattcaaaggtgggaaagccgttgctacaagcgctggggttttgctaggatttgcaccttcttttttcctttacttattagttatctttttattaacgctttatctttttagcatgatttccctatccagtattacagtagctgttgtaggtattcttagtgtcttaatttttccattagtaggctttatattaacggactacgactggatatttaccactgtggttatcttaatggccctaacgattattatccgacatcaggataatatcaaacgtattcgaaaaaggcaagaaaatttggttccgtttggcttaaacctaagtaaacaaaaaaataaa

SEQ ID NO: 9874 - protein, 207 aa, Streptococcus agalactiae
MIIIAYLLGSIQTGLWIGKYFYQVNLRQHGSGNTGTTNTFRILGVKAGIVTLTIDILKGTLATLIPIILGITTVSPFFIGFFAIIGHTFPIFAQFKGGKAVATSAGVLLGFAPSFFLYLLVIFLLTLYLFSMISLSSITVAVVGILSVLIFPLVGFILTDYDWIFTTVVILMALTIIIRHQDNIKRIRKRQENLVPFGLNLSKQKNK

SEQ ID NO: 9875 - DNA, 483 bp, Streptococcus agalactiae
atgagagaaactgaaacacacgatcaccaagcgctaattcaaaaattgttagtcagtattcattatttaaccttgtttcgtgatgaaattatattagtagaaaaaaccccatctttactggggaaacatttttctattgctattgtgcagaatgaactaggtgagatactttctaaaatagaagctttgagtaagcaaaaaaaactgattcgttctatttattggtatgatgaatcgtcatttaaagttatgaataaggctctggctattgtagaagaatggattaagggcttagataatcttttagaattctgtcaatcacagacggtttttcaagcaattttaggtgatgaacgtgcacatgtatttggaatccttattgatgtttatacttctttaaacattataaatacttctttgaaagaagaaaattctagaccagtgtccttatctgatttggctctaggtcttaaggacgaagat

SEQ ID NO: 9876 - protein, 161 aa, Streptococcus agalactiae
MRETETHDHQALIQKLLVSIHYLTLFRDEIILVEKTPSLLGKHFSIAIVQNELGEILSKIEALSKQKKLIRSIYWYDESSFKVMNKALAIVEEWIKGLDNLLEFCQSQTVFQAILGDERAHVFGILIDVYTSLNIINTSLKEENSRPVSLSDLALGLKDED

SEQ ID NO: 9877 - DNA, 591 bp, Streptococcus agalactiae
atgtttgaaacacctgaagatattatcttcaaaaacttttctatagttaaacacgaagcggaaaaaagatttgaacatcttcaaatcttatatggtggagaattgtactatacaagtgatatgttagaaaaactgaagttaaagcaaattccaactttaaacaatacgaaatttgctttaattgaattttctatgcaaacttcttggaaagatattcatacagctttgtcaaatgttttaatgcttggtattacaccagtcgttgcgcatatagagaggtataacgctttagagaatcaaaaagaacgggtgaaggaaattattaatatggggtgttacacacaaataaatagttcccatattttgaaacaaaaactttttaatgataagcataaacgctttaagaaaagagcccgttattttttagaggaaaatttagtgcattttgtagcgagtgatatgcataaccttgatgttagaccgccatttttagcagaagcttataagattatctgtagagatttcggtaaagaacgtgctaaccaactttttattgaaaatgctcaatctatattaaaaaaccattacatt

SEQ ID NO: 9878 - protein, 197 aa, Streptococcus agalactiae
MFETPEDIIFKNFSIVKHEAEKRFEHLQILYGGELYYTSDMLEKLKLKQIPTLNNTKFALIEFSMQTSWKDIHTALSNVLMLGITPVVAHIERYNALENQKERVKEIINMGCYTQINSSHILKQKLFNDKHKRFKKRARYFLEENLVHFVASDMHNLDVRPPFLAEAYKIICRDFGKERANQLFIENAQSILKNHYI

SEQ ID NO: 9879 - DNA, 870 bp, Streptococcus agalactiae
atgaatgaagccgctaaacaactctacattacccaaccttcactttcaaacgctgttaggaaccttgagactgagatgggtatccaaatttttattcgaaatccaaaaggaataacgttaacaaaagatggtatggaatttctgtcatatgcgcgacaaattctagaacaaacagcacttcttgaagagcgttataagggtgataatacaagtcgtgagctgttcagcgtttcttcacaacactatgcatttgtggttaacgcttttgtagctctctttaatggcacagacatgacccaatacgaactttttttacgtgaaactaggacttgggaaattattgatgatgttaaaaatttccgttcagagattggtgttctgtttcttaatagctataatagagatgtattaaccaaattattcgacgataattccttaattgccacaactctttttactactacacctcatattttcgtgagcaaatccaatcccttagctaatagaaaaaaattaaatatgaaagatttagaagattatccttatctgagttatgatcaaggcctgcataattctttctacttttctgaggaaatgatgtctcaaattcctcacccaaaatccattgttgtcagtgatagagcaactctgtttaatttaatgattggattagatggttatacagtggcaactggtatcctcaactcaaaattgaacggtgacgaaattgtcgcaatccctcttgacgtggatgatgttattgatattgtctatatccgacacgacaaagcaaacctttcaaaaatgggacaaaaatttattgactatttattagaggaagtttcgtttaatcataaaaataaacagtcc

SEQ ID NO: 9880 - protein, 290 aa, Streptococcus agalactiae
MNEAAKQLYITQPSLSNAVRNLETEMGIQIFIRNPKGITLTKDGMEFLSYARQILEQTALLEERYKGDNTSRELFSVSSQHYAFVVNAFVALFNGTDMTQYELFLRETRTWEIIDDVKNFRSEIGVLFLNSYNRDVLTKLFDDNSLIATTLFTTTPHIFVSKSNPLANRKKLNMKDLEDYPYLSYDQGLHNSFYFSEEMMSQIPHPKSIVVSDRATLFNLMIGLDGYTVATGILNSKLNGDEIVAIPLDVDDVIDIVYIRHDKANLSKMGQKFIDYLLEEVSFNHKNKQS

SEQ ID NO: 9881 - DNA, 765 bp, Streptococcus agalactiae
atgacagatttttcaactgctcttaaagtattagtggatcagtattcttatcataatgctttcttattattacaaaaacatggtcctttaaactcagatttattatttttattggaaatgatgaaagagcgtcgagagttaaacattgattttctttttgctcatcaagaacaagttgttatattacaagaaaaatacaatataaagcttttgcataacccgtatgatttagagttgctggcaaattacatcatggatttagaagcaaaagtaaaaaacggattaatcatagattttgtccgtagtgttagtcctattttatatcgtctatttatgattttacttgcacaagaagtacctcacttgcatgattacatccataatgcaagagatgatcactacgatacttggaagtttaaagaattaaaggagtcaaaccacccagtccttttggcattctctgaaaggtggcacgatagtcgcttgacttctaaaagcctggcagaatgtttacaattaaccgaccttgatgaagaagtgaaatcgaccatcattcaattaagacagttcgaaaaatcagtcagaaatcctttggctcacctgattaaaccttttgatgagcaagaactatatcgtacaactcaattttcttctcaagcatttttagaccagattatcttcttggcaaaggtaattggtgttgagtatgatactgttaattttcactacgatacggttaacaagcttattataaatatacttgag

SEQ ID NO: 9882 - protein, 255 aa, Streptococcus agalactiae
MTDFSTALKVLVDQYSYHNAFLLLQKHGPLNSDLLFLLEMMKERRELNIDFLFAHQEQVVILQEKYNIKLLHNPYDLELLANYIMDLEAKVKNGLIIDFVRSVSPILYRLFMILLAQEVPHLHDYIHNARDDHYDTWKFKELKESNHPVLLAFSERWHDSRLTSKSLAECLQLTDLDEEVKSTIIQLRQFEKSVRNPLAHLIKPFDEQELYRTTQFSSQAFLDQIIFLAKVIGVEYDTVNFHYDTVNKLIINILE

SEQ ID NO: 9883 - DNA, 1170 bp, Streptococcus agalactiae
atgcactatgtattaatgtttacagagtggttagcatttggtgatagtagagaaaatactctgtctttgttaaatagtgtcacaccaattaaaagagtgttatcacttactttagtctcctttttagcatcccttagttggtattacttacaaatcaaaccaaagcaaataactagtattaaacaacaggttgtttttaaggatttttctgtaaaaaaatcaccttactggctacatataggtcacgcatttttgcaattgatttatgtaggaactggtggccctattggaaaagaaggagcgccacgagagtttggagccataaatgctgggaaaatatcggatttattagcacttaaagtgctggataaacgtttattaatcattagtggtgcagctgcaggtttgtcagcagtttatcaagtccccctagctagtgtattctttgcttttgaaactttagctttaggaatctcactgaaaaatattgtgacattgctagcctctacttttggtgcagctagtattgctcaattagttatttcgacagcccctctttatcatatttcaaagatgagtctgaattcacagtcattagcttttatgttcttgatcgttttatgtgtaactccgattgcgattagctttagatatttaaatcaaaaagtgacagagagacgtattaaaaatataaaaatattgttaagtttgccagtagtgtcattgatagtatctgttttatcaatcgtctatccccagattttaggaaatggtaatgccctagttcaagaagtctttaaagggaccacagttagcttaatcgctattttagttgttctcaagatgatagcaacattatccactctttacgctggtgcttatggcggtatactgacaccatctttttccattggtgcttgtttaggttttttgttagctagtatttctattcctttacttccccacatatcgatagtaaccagtatgttggttggtgcagctatttttttagctattacaatgagagcgccactgacagctgtcggtttagtcatatcttttactggtcaatctgttataactattgttcccctaactatagcagtactttttgctactgcctatgattattttataagaaaaatgaggagtttatatgtcaatccatat

SEQ ID NO: 9884 - protein, 390 aa, Streptococcus agalactiae
MHYVLMFTEWLAFGDSRENTLSLLNSVTPIKRVLSLTLVSFLASLSWYYLQIKPKQITSIKQQVVFKDFSVKKSPYWLHIGHAFLQLIYVGTGGPIGKEGAPREFGAINAGKISDLLALKVLDKRLLIISGAAAGLSAVYQVPLASVFFAFETLALGISLKNIVTLLASTFGAASIAQLVISTAPLYHISKMSLNSQSLAFMFLIVLCVTPIAISFRYLNQKVTERRIKNIKILLSLPVVSLIVSVLSIVYPQILGNGNALVQEVFKGTTVSLIAILVVLKMIATLSTLYAGAYGGILTPSFSIGACLGFLLASISIPLLPHISIVTSMLVGAAIFLAITMRAPLTAVGLVISFTGQSVITIVPLTIAVLFATAYDYFIRKMRSLYVNPY

SEQ ID NO: 9885 - DNA, 786 bp, Streptococcus agalactiae
atggcattttttaatattgaatatcactctaaggtactaggaacggaacgtcaagtcaatgttatttacccagatgcttttgagatgtctgatgataaaattgatgattgtgacattcctgttttgtatcttctccatggaatggggggaaatgagaattcttggcaaaaacgcacaaatatagagcgtcttttacgtcatactaatcttatcgtcgtgatgccatcaacagacttagcatggtataccaacacaaagtatgggttggattattttgatgcaatagctatcgagttaccaaaagttttgaaacgtttctttcctaatatgtctgataagagagagaaaaatttcattgccggattatctatggggggatatggagcatataaaatagctctactgactaatcgtttttctcatgctgcctctttgtcaggtgcactttcttttgactttgatttattattcaataatggcaacaataacattaactattggtcgggaatttttggcgatttgaataacactgataacatagagcgtcattcactaaggcgttacgttgagtcttttgatatgaagactaaattttatgcatggtgtggttatgaagattttctttttgaagctaatgaagtcgcaattgatgaacttcgtcaattaggtttaactattgactatttcaatgatcatggtaaacatgaatggtattactggaatcaacaattagaaaaagtcttagaatggctccctgttgattatgtcaaagaagagcgcctttct

SEQ ID NO: 9886 - protein, 262 aa, Streptococcus agalactiae
MAFFNIEYHSKVLGTERQVNVIYPDAFEMSDDKIDDCDIPVLYLLHGMGGNENSWQKRTNIERLLRHTNLIVVMPSTDLAWYTNTKYGLDYFDAIAIELPKVLKRFFPNMSDKREKNFIAGLSMGGYGAYKIALLTNRFSHAASLSGALSFDFDLLFNNGNNNINYWSGIFGDLNNTDNIERHSLRRYVESFDMKTKFYAWCGYEDFLFEANEVAIDELRQLGLTIDYFNDHGKHEWYYWNQQLEKVLEWLPVDYVKEERLS

SEQ ID NO: 9887 - DNA, 759 bp, Streptococcus agalactiae
atggtgatgaaaatcatagagttaaaagaagcaaccgtacaagtcagtaatggtttagcagaaatgaaaacgatattagatcatgttaatttgagtatttatgaacatgacttcattacaatattgggtggaaatggagctggaaaatcaacgctttttaatgtaattgcaggtaccttgatgttaagcagtggaaatatttacatcatgggacaagatgttactaatttatcagcagaaaaacgagctaaatatttatcacgggtatttcaagatccgaaaatgggaacagcacctaggatgacagttgctgaaaatttattagttgctaaatttcgaggtgaaaagagaccgctagttcctagaaagattattaactatacggaagaatttcaaaaattgattgctagaactggtaatggacttgatcgccatttagagacacctacaggtttattatcaggtggacaaagacaagcgcttagtttattaatggcaactttgaaaaaaccaaatctgttattattggacgaacacacagcagcgcttgatcctagaacaagtgtttcgcttatgggcttgactgatgagtttatcaaacaagattcgttgactgccttaatgattacacatcatatggaagatgctctcaaatatggaaatcgtgtattagtaatgaaagatggcaagattgtcagagatttaaatcaggcacaaaaaaacaagatggctatagctgactattatcaattatttgat

SEQ ID NO: 9888 - protein, 253 aa, Streptococcus agalactiae
MVMKIIELKEATVQVSNGLAEMKTILDHVNLSIYEHDFITILGGNGAGKSTLFNVIAGTLMLSSGNIYIMGQDVTNLSAEKRAKYLSRVFQDPKMGTAPRMTVAENLLVAKFRGEKRPLVPRKIINYTEEFQKLIARTGNGLDRHLETPTGLLSGGQRQALSLLMATLKKPNLLLLDEHTAALDPRTSVSLMGLTDEFIKQDSLTALMITHHMEDALKYGNRVLVMKDGKIVRDLNQAQKNKMAIADYYQLFD

SEQ ID NO: 9889 - DNA, 717 bp, Streptococcus agalactiae
atgtcagaaacagttaaattatttcaatacagtaccttgagttcactgatggcaggattgtacaaaggcagtctaactatcggagaattattaactcacggtgacttaggaatcggtactgttcatatgattgatggtgaattgattgtattggatgggaaagcttatcaagctattggtacagatggtaaagcagagattatccaattatcagatgatgtgacagtaccctatgcagcggttttaccacaccatatccaaaaacaatttgatatcaatgctgagatagataataaggatttggaagagatgattctaaaaaactttgaaggtcaaaatctctttaagtctttaaaaatcaaaggaacgttttcaagaatgcacgttcgtatgattccaaaatctccacaacataaacgttttgcagatattgcatctaatcagccagaatttaccagagagaatgtatctggtacgttggttgggatttggacgccggaattatttcatggtgtgggggtaaaagggttccatgtccactttatttcagacgatttaactttcggtgggcatgttatggattactcgctcacacaaggaaaagttgaaattggaaaggttgaccaacttgaccaatgtttcccaactcaagatcaagaatttttgaaagctaactttgacctacaaaagcttagagaagatattgatttaagtgaa

SEQ ID NO: 9890 - protein, 239 aa, Streptococcus agalactiae
MSETVKLFQYSTLSSLMAGLYKGSLTIGELLTHGDLGIGTVHMIDGELIVLDGKAYQAIGTDGKAEIIQLSDDVTVPYAAVLPHHIQKQFDINAEIDNKDLEEMILKNFEGQNLFKSLKIKGTFSRMHVRMIPKSPQHKRFADIASNQPEFTRENVSGTLVGIWTPELFHGVGVKGFHVHFISDDLTFGGHVMDYSLTQGKVEIGKVDQLDQCFPTQDQEFLKANFDLQKLREDIDLSE

SEQ ID NO: 9891 - DNA, 1224 bp, Streptococcus agalactiae
atgttgaatagtgaaaaaatgattgtttctatccaaaatcaggatttagaacatgctaacaagtatttcgaaaaagcgttgaaaaatgatcctgaggaagtcttgttggaactaggagcttatttggagagtattggttttttaccccaagcaaaacgtctctatgatcaaatccgaccaaattatccagaagttgctatcaatttagctcaaattgttgccgaagatggagatattgaacaagcattcttatacttagattatatctcagaagatagtcaagagtatgtttcagccctccttgttatggctgacttatatgatatggaaggcttgactgatgttgcgcgtgaaaagcttttgctagccagcaaacttagcgatgacccattggttacatttggtttagctgaaatgaaccttagtttggaacattatcaagaagcgatagaaggatatgcctcacttgacaatcgagaaatcttagaaacgactggagtttcaacttatcagcgtattggtaaatcctacgctattatggggaaatttgatgcagctatcgaatttttagaaaaagccgttgacattgagtatgatgatttaacagtttttgagttagcaacaatcctttatgatcaagaagaatatcaaaaagctaacctttattttaaacagttggatactattaatccagactttgctggctatgaatatatctatggtttatctcttcgtgaggagcataaatctgaagaagctttacgtctagttcagcaaggtattcgtaaaaatagttttgatggtcaacttctcttactagcctcacaattatcgtatgaattacatgatgttcattcgtcggagtcttatttgaaacaagctgaaaaagtttctgaaaatcaagatgaaattgttatgagattgtcaaatttgtatcttgaagaagagcggtttgaggaagtcttggaattagacaatgataatttagaaaatatccttgcaaaatggaatatcgctaaagcacacaaggctttagaaatggatgatagtgtagactattatcaatctttgtataatgatttaaaagataatccagaatttttacaagattatgcttacattttgagagaatttggttaccttgataaggcacaagaagtaggaaaggcttatttaaaattagttccagatgatatagagatgtcagaatgggtgaataacatt

SEQ ID NO: 9892 - protein, 408 aa, Streptococcus agalactiae
MLNSEKMIVSIQNQDLEHANKYFEKALKNDPEEVLLELGAYLESIGFLPQAKRLYDQIRPNYPEVAINLAQIVAEDGDIEQAFLYLDYISEDSQEYVSALLVMADLYDMEGLTDVAREKLLLASKLSDDPLVTFGLAEMNLSLEHYQEAIEGYASLDNREILETTGVSTYQRIGKSYAIMGKFDAAIEFLEKAVDIEYDDLTVFELATILYDQEEYQKANLYFKQLDTINPDFAGYEYIYGLSLREEHKSEEALRLVQQGIRKNSFDGQLLLLASQLSYELHDVHSSESYLKQAEKVSENQDEIVMRLSNLYLEEERFEEVLELDNDNLENILAKWNIAKAHKALEMDDSVDYYQSLYNDLKDNPEFLQDYAYILREFGYLDKAQEVGKAYLKLVPDDIEMSEWVNNI

SEQ ID NO: 9893 - DNA, 786 bp, Streptococcus agalactiae
atgaaagctagagaacttattgatgtatatgaaacttattgtccacaggaattatctatggaaggagatatttcaggtcttcaaattggatctttagataaagaaataaagacagtcatggtagctttagatgttcgagagactacagtagctgaagcaattgaacgtcaagtagatcttcttattgtaaagcatgctcctatttttcgtccattaaaggatttggtagcaacgccgcaaaataagatttatatagaccttcttaaatcagacattgctgtttatgtgagccatactaatatagatatcgttcctaatggacttaacgactggttttgtgaattattagatattcaatatcccgatatattatctgagacaagtaatggttatggtattggtcgcattggtgatattagaccccagagttttgaattttttgcatggaaaattaaagatgtgtttggtttagatagcgttcgtttagtttcatatgataaatctaatcctgaaattcaacgagttgctatttgtgggggtagtgggcaaagtttctacaaagaagctattgcaaaaggagcagatgtttttgtaacgggagatatttattatcatactgcacaagaaatgatcacaaatggtttgcttgcgattgacccaggtcatcatattgaggttttatttgtttctaaaatagctactatgattgagcagtggaaacttgaaaaaggctgggatatttcagttttagagagtaaagctccaacaaatcccttttaccatatg

SEQ ID NO: 9894 - protein, 262 aa, Streptococcus agalactiae
MKARELIDVYETYCPQELSMEGDISGLQIGSLDKEIKTVMVALDVRETTVAEAIERQVDLLIVKHAPIFRPLKDLVATPQNKIYIDLLKSDIAVYVSHTNIDIVPNGLNDWFCELLDIQYPDILSETSNGYGIGRIGDIRPQSFEFFAWKIKDVFGLDSVRLVSYDKSNPEIQRVAICGGSGQSFYKEAIAKGADVFVTGDIYYHTAQEMITNGLLAIDPGHHIEVLFVSKIATMIEQWKLEKGWDISVLESKAPTNPFYHM

SEQ ID NO: 9895 - DNA, 825 bp, Streptococcus agalactiae
atgtttgattgtggagagggtacacagcgtcaaattttagaaactacgattaaacctcgtaaagttaaaaaaatttttatcacgcacatgcacggagaccatgtttttggtcttccaggttttttatccagtcgggcttttcaagccaatgaagagcagacagatttagatatttatggaccggttggtataaaaagttttgttatgactgccttaaggacatcaggttcacgtttaccttatcgaatccattttcacgagtttgatgaatcatcactcggaaaaattatggaaacagataaatttaccgtttatgcagaaaagctagatcatactatcttttgtatgggatatcgtgttgtgcaaaaagatcttgagggcactttagatgctgaagcattgaaactagcaggtgttccatttggtcctctttttgggaaagtcaaaaatggtgagaatgttaccttagaagatggtagagaaattattgctaaagattatatttctgaaccgaaaaagggtaaagtaatcactattttgggagatactagaaaaacagatgcaagtattaggttagctttgggcgctgatgttttagttcacgaatctacttatggtaagggtgatgagcgaattgctaaatcgcatgggcattcaaccaatatgcaagcagctgatatcgctaaacaagcaaatgctaaacgactattattaaatcatgttagtgctcgttttatggggcgagattgttggcaaatggaagaagatgcaaagacgattttttcaaatacccatcttgttagagatttggaagaagtaggtata

SEQ ID NO: 9896 - protein, 275 aa, Streptococcus agalactiae
MFDCGEGTQRQILETTIKPRKVKKIFITHMHGDHVFGLPGFLSSRAFQANEEQTDLDIYGPVGIKSFVMTALRTSGSRLPYRIHFHEFDESSLGKIMETDKFTVYAEKLDHTIFCMGYRVVQKDLEGTLDAEALKLAGVPFGPLFGKVKNGENVTLEDGREIIAKDYISEPKKGKVITILGDTRKTDASIRLALGADVLVHESTYGKGDERIAKSHGHSTNMQAADIAKQANAKRLLLNHVSARFMGRDCWQMEEDAKTIFSNTHLVRDLEEVGI

SEQ ID NO: 9897 - DNA, 888 bp, Streptococcus agalactiae
atgagaaaaatcaaacttatagcagttgttggtccaactgcggttgggaagacagcattaggaattgaattagctaaaactttcaatggcgaaatcattagtggtgatagtcagcaagtttatcagaagttagatatcggaacggctaaagctagtaaagaagagcaagaacaagcttatcatcacttgattgatgttcgtgaagtaaatgagaactattcggtttatgatttcgtcaaagaggcaaaagtagctattgatacgattatttctaaggggaaaattcctattattgttggaggtactggcctatatttacagagtttgtttgagggctatcatttaggaggcgaagtcaatcaagaaactcttatggcctatcgtgaaaaattagagtctctaagtgatgaagatttatttgaaaagttgacagaacaatccattattataccacaagttaatcgtcgacgtgccattcgtgcattagaattggcgaagtttgggaatgatttgcaaaatagtgaaagtccgtatgatgttttattaattggattgaatgatgatcgtcaggtgctttatgatcgtatcaatagacgagttgatttgatgatggacaatggtctcttagatgaagctaaatggctatacgataactacccgagtgttcaagcaagtaaaggaattggctataaagaattatttccttacttttcaaagcaaataccattagaagaagctgttgataaactaaaacaaaataccagacgttttgcaaaacgccaattaacatggtttagaaaccgtatgaatgtcgaatttattatggttggtgaggaaaattatcaacaaaaaatcaagcgaaaagtcagtgattttttatcatcaaag

SEQ ID NO: 9898 - protein, 296 aa, Streptococcus agalactiae
MRKIKLIAVVGPTAVGKTALGIELAKTFNGEIISGDSQQVYQKLDIGTAKASKEEQEQAYHHLIDVREVNENYSVYDFVKEAKVAIDTIISKGKIPIIVGGTGLYLQSLFEGYHLGGEVNQETLMAYREKLESLSDEDLFEKLTEQSIIIPQVNRRRAIRALELAKFGNDLQNSESPYDVLLIGLNDDRQVLYDRINRRVDLMMDNGLLDEAKWLYDNYPSVQASKGIGYKELFPYFSKQIPLEEAVDKLKQNTRRFAKRQLTWFRNRMNVEFIMVGEENYQQKIKRKVSDFLSSK

SEQ ID NO: 9899 - DNA, 348 bp, Streptococcus agalactiae
atggaatttgccataggccgtgtggaagcgcacgttttagctcactttgattatggttttcgtaagttaaacttagatgtagaagatttaaaaccgtttgaaacgcaattgaagcgcattttcataaagatgttatctaaggggttagcttttgaactaaataccaaatccctttatctatatgggaatgaaaaactttatcgctatgctttagagatactcaaacagcttggttgtaaacaatactctataggctctgacggtcatattcctgaacatttttgttatgaatttgatagacttcaaggtctgctaaaggactatcaaattgatgaaaatcatttgata

SEQ ID NO: 9900 - protein, 116 aa, Streptococcus agalactiae
MEFAIGRVEAHVLAHFDYGFRKLNLDVEDLKPFETQLKRIFIKMLSKGLAFELNTKSLYLYGNEKLYRYALEILKQLGCKQYSIGSDGHIPEHFCYEFDRLQGLLKDYQIDENHLI

SEQ ID NO: 9901 - DNA, 552 bp, Streptococcus agalactiae
atgctacgagcattaaaagaagatttttttctaaccttaacctctttaaaaaatcaattttgggtttacattggaactggtatcttaatccaaactttagttgcttatttagtaaaaggaattctgagttttatctttcgtcggatattgatattgtcaaatactcccgcagtgactaaagacaattggactttactttttaatcatcccttagctttattactctttatactttatatcgtaatcctaattgggttcatctatactgagttcgctatctatactattgccatactgaaaactgaattttctctcagtatcaaaaaatggctaacaatctttcctaaaaaaataaaatcacttttaggaccacagctaatttgggtatcaatctacttacttttgacaattcctctagctaaccttggtctaaggtcaagtatactagagcatcttaaaattcctgactttatttctggcgagttaacaaagacagtctttggaaagataggttactctacccttttactgcttatttgttacttaaacctt

SEQ ID NO: 9902 - protein, 184 aa, Streptococcus agalactiae
MLRALKEDFFLTLTSLKNQFWVYIGTGILIQTLVAYLVKGILSFIFRRILILSNTPAVTKDNWTLLFNHPLALLLFILYIVILIGFIYTEFAIYTIAILKTEFSLSIKKWLTIFPKKIKSLLGPQLIWVSIYLLLTIPLANLGLRSSILEHLKIPDFISGELTKTVFGKIGYSTLLLLICYLNL

SEQ ID NO: 9903 - DNA, 759 bp, Streptococcus agalactiae
atgccacactcaagttattactatcaagccgtggagtcagtatctgaaacggagtttgaagaaactattaaaagaattttcctcgatagcgagtccagatacggatccagaaaaatcaaaatatgcttgaataacgaaggtatcacactttcacgtcgtcggattcgacgcattatgaagcgactcaatttggtttctgtttatcagaaagccaccttcaaaccacattctagaggcaagaatgaagcccctattcccaaccacttagacaggcaatttaagcaagaaagaccactacaggccttagtcactgacttaacctatgttcgtgtaggcaatcgttgggcttatgtttgcctcatcattgacctatacaaccgtgaaatcatcggcctgtctcttggttggcacaagaccgctgaactcgttaagcaagccatacaaagcatcccttacgccctgaccaaagtcaagatgttccattcagatcgtggcaaagagtttgataatcagttaattgatgaaatattggaagcctttggaatcacacgttcgcttagtcaggctggttgtccttatgacaatgccgtagctgaaagtacgtatcgtgctttcaaaattgaatttgtttatcaagaaacctttcaattgctggaagaactagctcttaagactaaagactatgttcattggtggaattaccaccgcattcatggtagtctcaactaccaaacaccaatgactaaaagattaattgcc

SEQ ID NO: 9904 - protein, 253 aa, Streptococcus agalactiae
MPHSSYYYQAVESVSETEFEETIKRIFLDSESRYGSRKIKICLNNEGITLSRRRIRRIMKRLNLVSVYQKATFKPHSRGKNEAPIPNHLDRQFKQERPLQALVTDLTYVRVGNRWAYVCLIIDLYNREIIGLSLGWHKTAELVKQAIQSIPYALTKVKMFHSDRGKEFDNQLIDEILEAFGITRSLSQAGCPYDNAVAESTYRAFKIEFVYQETFQLLEELALKTKDYVHWWNYHRIHGSLNYQTPMTKRLIA

SEQ ID NO: 9905 - DNA, 258 bp, Streptococcus agalactiae
atggcttactaccaggcttgcacggaaaaagacattatccgctcaatgtctcgaaaaggaacacctgcagataatgcctgtattgaatggtttcacaccgtcctaaagactgaaaccttttatttccataataggagaaaatacaacaaagatagtataacaaatattgttaaaaattacattacattttataatgaaactagaattcaacagagattaaacgaccagtcgcctgtacagtacagaaaactgattgcc

SEQ ID NO: 9906 - protein, 86 aa, Streptococcus agalactiae
MAYYQACTEKDIIRSMSRKGTPADNACIEWFHTVLKTETFYFHNRRKYNKDSITNIVKNYITFYNETRIQQRLNDQSPVQYRKLIA

SEQ ID NO: 9907 - DNA, 231 bp, Streptococcus agalactiae
atgcattctttttctaatcctggatatccttatgataatgccgtaactgaagcatttttcaagtatttaaagcatagacaaatcaaccgaaaacattatcaaaatatcaaacaggttcaattagactgctttgaatacattgagaatttttataacaattacaacccacatacggctaatctaggactaacccctaatcagaaagaagaaaattattttaacgcaataaaa

SEQ ID NO: 9908 - protein, 77 aa, Streptococcus agalactiae
MHSFSNPGYPYDNAVTEAFFKYLKHRQINRKHYQNIKQVQLDCFEYIENFYNNYNPHTANLGLTPNQKEENYFNAIK

SEQ ID NO: 9909 - DNA, 1275 bp, Streptococcus agalactiae
atgtcagaattgctagataagatattatctcggaacaatatgctcgaagcttacaagcaagtgaaatcaaacaaaggttctgctggtatcaatggggtcactatcgagcagatggatgactatcttcaccaaaattggcgagaaaccaagcaactcatcaaagagaggagctataaacctcaaccggttctcagggttgaaatcccaaaaccaaacggaggagttcgtaacctaggtatcccgacggctatggatagaatgattcagcaggccatcgttcaagttttgagtccactctgcgaaaaacatttttcagagtatagctatgggttcagacccaatcgctcctgcgaaacagccattgttcagctacttgagtatttaaacgatggctacgagtggattgtggacattgacttggaaaagttcttcgatactgttccgcaagacagattgatgtccctggttcataatatcattcaagatggcgatacggagtcactgattcgtaagtacctccattcgggagttgttattaacggacagcgacataagactttagtcgggacacctcaaggcgggaatctatcacccctcctatctaatattatgcttaatgagttagacaaagggttggaaaagcgaggtcttcgctttgtccgttacgccgatgactgtgtcatcactgtcggaagcgaagcagctgctaagcgggtcatgcattcggtcagtagctatattgagaagcgattagggttgaaagtcaacatgactaagaccaagattgtcagaccgaacaaactcaaatacctcggatttggtttctggaaatctccaaaaggttggaagtgtcgtcctcaccaagacagcgttcagagctttaagcgaaaactgaagcaactgacgatgaggaaatggagcattgacctgataactcgcattgaacgattgaactgggtcattcgaggatggataaactatttctcgcttggcaatatgaagagtatcatgacacaaatagatgagcgtctgcgaacccgtattcgagtgattatctggaagcaatggaagaagaaagcaaagcgcctatggggactcttaaaactaggagttgctagatggatagccgataaagtttctggatggggtgaccactatcagttggtagctcagaagtcggtactcaaacgtgctatatcaaaaccagccctcgcaaagcgaggactggtcagttgcttagattactatcttgaacgacatgcgttaaaagttagt

SEQ ID NO: 9910 - protein, 425 aa, Streptococcus agalactiae
MSELLDKILSRNNMLEAYKQVKSNKGSAGINGVTIEQMDDYLHQNWRETKQLIKERSYKPQPVLRVEIPKPNGGVRNLGIPTAMDRMIQQAIVQVLSPLCEKHFSEYSYGFRPNRSCETAIVQLLEYLNDGYEWIVDIDLEKFFDTVPQDRLMSLVHNIIQDGDTESLIRKYLHSGVVINGQRHKTLVGTPQGGNLSPLLSNIMLNELDKGLEKRGLRFVRYADDCVITVGSEAAAKRVMHSVSSYIEKRLGLKVNMTKTKIVRPNKLKYLGFGFWKSPKGWKCRPHQDSVQSFKRKLKQLTMRKWSIDLITRIERLNWVIRGWINYFSLGNMKSIMTQIDERLRTRIRVIIWKQWKKKAKRLWGLLKLGVARWIADKVSGWGDHYQLVAQKSVLKRAISKPALAKRGLVSCLDYYLERHALKVS

SEQ ID NO: 9911 - DNA, 606 bp, Streptococcus agalactiae
atggttaagaaaaaagtaaagaaaaaaagtggttgtggtggatgtttaagtttaataatagtgataattattgttagtagtgttataaatttatttacaggttctgaaagcagtaatacttctaaaaagaataagacaaatcctagtggtgcgacaagtgcaaaagtcgttaaacacaaaaaaactgatgaagaacgagcagaagattatataaaaacgttaggattaaacccgagtgattatataaaagaaatggattattcaaaggttgattttaggggggatttatcatcagtatcaggtaattataataattttactgttgaaaacatcaatcaaacttttgaaaaaggtgataaatctttaaaagatattattgaaatttttggaaagcctgatacaatttgggttaattacgttgacaatcagtacaatactgatttgtactggaaaaaagatgacacagatgattctaattatattcatgcagaatggtctgagccaaaagatgaatatgatgttcaaagtttaagtggcacggcttcaaattcaggtactggcaagtttcagtcattcattggattagatggatttgagcctgcacag

SEQ ID NO: 9912 - protein, 202 aa, Streptococcus agalactiae
MVKKKVKKKSGCGGCLSLIIVIIIVSSVINLFTGSESSNTSKKNKTNPSGATSAKVVKHKKTDEERAEDYIKTLGLNPSDYIKEMDYSKVDFRGDLSSVSGNYNNFTVENINQTFEKGDKSLKDIIEIFGKPDTIWVNYVDNQYNTDLYWKKDDTDDSNYIHAEWSEPKDEYDVQSLSGTASNSGTGKFQSFIGLDGFEPAQ

SEQ ID NO: 9913 - DNA, 228 bp, Streptococcus agalactiae
atggcatttgaaccaaaaaattcggaactaacaaaagttctaaaagaaagtttagatgaagaaaagaaagaaattttctcatctgaaatgaatattagggactttgaacgtacaaaacaatatcaatttacacttcaaccttcagtccgaaaaaaaattgataggctatcaaaagaaaaaggctatcgttcagcatcatcttttataaatgacttttttaaaaatttg

SEQ ID NO: 9914 - protein, 76 aa, Streptococcus agalactiae
MAFEPKNSELTKVLKESLDEEKKEIFSSEMNIRDFERTKQYQFTLQPSVRKKIDRLSKEKGYRSASSFINDFFKNL

SEQ ID NO: 9915 - DNA, 759 bp, Streptococcus agalactiae
atgccacactcaagttattactatcaagccgtggagtcagtatctgaaacggagtttgaagaaactattaaaagaattttcctcgatagcgagtccagatacggatccagaaaaatcaaaatatgcttgaataacgaaggtatcacactttcacgtcgtcggattcgacgcattatgaagcgactcaatttggtttctgtttatcagaaagccaccttcaaaccacattctagaggcaagaatgaagcccctattcccaaccacttagacaggcaatttaagcaagaaagaccactacaggccttagtcactgacttaacctatgttcgtgtaggcaatcgttgggcttatgtttgcctcatcattgacctatacaaccgtgaaatcatcggcctgtctcttggttggcacaagaccgctgaactcgttaagcaagccatacaaagcatcccttacgccctgaccaaagtcaagatgttccattcagatcgtagcaaagagtttgataatcagttaattgatgaaatattggaagcctttggaatcacacgttcgcttagtcaggctggttgtccttatgacaatgccgtagctgaaagtacgtatcgtgctttcaaaattgaatttgtttatcaagaaacctttcaattgctggaagaactagctcttaagactaaagactatgttcattggtggaattaccaccgcattcatggtagtctcaactaccaaacaccaatgactaaaagattaattgcc

SEQ ID NO: 9916 - protein, 253 aa, Streptococcus agalactiae
MPHSSYYYQAVESVSETEFEETIKRIFLDSESRYGSRKIKICLNNEGITLSRRRIRRIMKRLNLVSVYQKATFKPHSRGKNEAPIPNHLDRQFKQERPLQALVTDLTYVRVGNRWAYVCLIIDLYNREIIGLSLGWHKTAELVKQAIQSIPYALTKVKMFHSDRSKEFDNQLIDEILEAFGITRSLSQAGCPYDNAVAESTYRAFKIEFVYQETFQLLEELALKTKDYVHWWNYHRIHGSLNYQTPMTKRLIA

SEQ ID NO: 9917 - DNA, 1197 bp, Streptococcus agalactiae
atggcaacaaaaagtagtaaaaaatacaaaggtgtttattgtgataataagggaaagatattttatcagattgatcttggaatcgacccagtaactggcaaaagggtacaaaagaaagctagaaaaaatcaatatggtaaaacctttgaaacaatgaaagaagcatatgacgaattagttcgtataaaatatgaatttgccaacaaagtcagtttagaaaattacaatatgacttttgaaaactatatgaacaaaatttatttaagagcatataagcaaaaggttcagtctgtgacatataagacggctcttcctcatcataaactttttattcaatattttggtttaaagccattaaaagcaataactcctagagattgcgaagcttttagattgcatatcatagagaattattctgaaaactatgcgaaaaatttatggtcaaggtttaaagcttgtatgggttatgcagaaagacttggctatatttcaaatatgccttgtaaagcattagataatcctagaggtaaacatccagaaactccattttggacctatgcggagtttcagacatttatcaaatcatttgacttacatgattatgaagaattgcaacgatttactgccatctggttatattatatgacaggtgtacgagtgagcgaaggtttatctttatgttgggaggatattgattttgataaaaaatttctaaaggtacatacaaccttagagaaagatgaaaatggtaattggtatcgtaaagaccaaacaaagactccagcaggtgaacgacttattgaattggatgatattactattgaagtacttcaagtttggcgaaaaaatcagtttgcaaatcaagatacagattttatcatttcaagatttggagatcctttttgcaaatcaaccatttgtcgcatcatcaaacggaaagctcaacaggtaggagttccagtaattacaggaaaaggtctcagacatagccatgcatcctatctaatcaatgtcttgaaaaaagatattttatatgtagccagacgtatgggacatgccgataaatcaacaactttgaatacttacagtcactggtttaatgctttagataaaacagtttctgaagaaatcacacaaaatatcaaaagtgcaggattggattcaattttatgccaaaattcctgccaaacttcaaat

SEQ ID NO: 9918 - protein, 399 aa, Streptococcus agalactiae
MATKSSKKYKGVYCDNKGKIFYQIDLGIDPVTGKRVQKKARKNQYGKTFETMKEAYDELVRIKYEFANKVSLENYNMTFENYMNKIYLRAYKQKVQSVTYKTALPHHKLFIQYFGLKPLKAITPRDCEAFRLHIIENYSENYAKNLWSRFKACMGYAERLGYISNMPCKALDNPRGKHPETPFWTYAEFQTFIKSFDLHDYEELQRFTAIWLYYMTGVRVSEGLSLCWEDIDFDKKFLKVHTTLEKDENGNWYRKDQTKTPAGERLIELDDITIEVLQVWRKNQFANQDTDFIISRFGDPFCKSTICRIIKRKAQQVGVPVITGKGLRHSHASYLINVLKKDILYVARRMGHADKSTTLNTYSHWFNALDKTVSEEITQNIKSAGLDSILCQNSCQTSN

SEQ ID NO: 9919 - DNA, 222 bp, Streptococcus agalactiae
atgtaccgacgtttaagggatttgagagaagacaatgatttcactcaaaaatacgttgccgaaaagctttcgtttacccactctgcttattcaaaaattgagagaggagaacgtattttatcggcagatgtaataataaaactttcaaatctatataacgttagtacagattatttgttggggcaaactgactttccccaccgaataaagaataatttaaaa

SEQ ID NO: 9920 - protein, 74 aa, Streptococcus agalactiae
MYRRLRDLREDNDFTQKYVAEKLSFTHSAYSKIERGERILSADVIIKLSNLYNVSTDYLLGQTDFPHRIKNNLK

SEQ ID NO: 9921 - DNA, 1305 bp, Streptococcus agalactiae
atgtcagacttattatccctaccagacattaaaacaatagaaccgccacaagaaaatgaaaccgatatgatgtttaaagttgaagcagtcggaccacctgaacgttgtcctgaatgtggttttgacaagttgtacaaacacagttcaagaaatcaactaattatggatttgcccattcgtttaaagcgagtgggcttacatttgaaccgtagacgatacaagtgtcgtgaatgcggatctaccatatctgtagatgaaaagcgtagtatgaccaaaaggcttttaaagtccattcaagagcaatccatgtctaagacctttgtagaagtcgcagaaagcgttggtgttgacgagaaaaccattaggaacgtttttaaggactatgtggcactcaaagaacgtgaataccagtttgaaactcctaagtggcttgggatagacgagatacatattatccgtagacctcggcttgtattgactaatattgaacgcaggactatttatgacatcaagcctaaccgtaacaaggaaacagtcatccaacgtctttcagaaatcagtgacaggacttacattgagtacgtcacaatggatatgtggaagccctacaaagacgcagtgaacactatccttccacaagctaaagttgtcgtagataagtttcatgtagttagaatggctaatcaagccttagataacgtcagaaagtctttgaaagcccatatgagccaaaaagaaagacgtacccttatgcgtgaaaggtttatccttctaaagcgtaaacacgatctaaatgaacgtgaatcattcctcttagatacttggttaggtaatcttcctgctttaaaagaagcctatgaactcaaagaagagttttactggatatgggatactcctgatccagatgaaggtcatcttcgttatagtcaatggagacaccgttgtatgtccagcaactctaaagacgcatataaagacctcgtgagagccgtagacaactggcatgttgaaatattcaactactttgataaaaggctcactaatgcttatacggagtcaattaacagcattattaggcaggtagagcgaatgggtagaggttactcgtttgatgccttacgagccaaaatccttttcaatgagaagctccataaaaagcgtaagccacgatttaattcaagtgctttcaataaagctatgttatacgatactttcaattggtatgaagtgaatgatcacgacattacagacaacttaggtgtcgatttttccacacttattaagaatttggagaagggtgattta

SEQ ID NO: 9922 - protein, 435 aa, Streptococcus agalactiae
MSDLLSLPDIKTIEPPQENETDMMFKVEAVGPPERCPECGFDKLYKHSSRNQLIMDLPIRLKRVGLHLNRRRYKCRECGSTISVDEKRSMTKRLLKSIQEQSMSKTFVEVAESVGVDEKTIRNVFKDYVALKEREYQFETPKWLGIDEIHIIRRPRLVLTNIERRTIYDIKPNRNKETVIQRLSEISDRTYIEYVTMDMWKPYKDAVNTILPQAKVVVDKFHVVRMANQALDNVRKSLKAHMSQKERRTLMRERFILLKRKHDLNERESFLLDTWLGNLPALKEAYELKEEFYWIWDTPDPDEGHLRYSQWRHRCMSSNSKDAYKDLVRAVDNWHVEIFNYFDKRLTNAYTESINSIIRQVERMGRGYSFDALRAKILFNEKLHKKRKPRFNSSAFNKAMLYDTFNWYEVNDHDITDNLGVDFSTLIKNLEKGDL

SEQ ID NO: 9923 - DNA, 594 bp, Streptococcus agalactiae
atgttaaatcaatattttctgcattttgaagagagtaaaatagttactcccttatatgctttcgacattgattatctgaatattcctaaatatgtcggtctatcaaaggagcagattctggaaaactaccgcatcctcctgacctatttgaatatcccatggtttctcgcattggatatgccggatttccctagttcggctagtgggcttttccactttttcgaggtcaagaagctttttatgctggactacctgatcttgatcttttctggaatgggcacgctatggtttgtacgacatctaaataggagacgagaatcttggcggctcctaccctacttccgccagggaacccttattccccttgctatccttttggctctcctggttagcttcgacacgctgtttgtgcttttccataaagttttctttaacaatgacgcctggctcttcaatgccactactgatcctattatcttagctttacctgccgagttctttatgcacagtttcctcttggcctttggattaatcgaagtcttcctaatcctggggtacttcactactaaatatcgaatctctgccccaagccgt

SEQ ID NO: 9924 - protein, 198 aa, Streptococcus agalactiae
MLNQYFLHFEESKIVTPLYAFDIDYLNIPKYVGLSKEQILENYRILLTYLNIPWFLALDMPDFPSSASGLFHFFEVKKLFMLDYLILIFSGMGTLWFVRHLNRRRESWRLLPYFRQGTLIPLAILLALLVSFDTLFVLFHKVFFNNDAWLFNATTDPIILALPAEFFMHSFLLAFGLIEVFLILGYFTTKYRISAPSR

SEQ ID NO: 9925 - DNA, 1413 bp, Streptococcus agalactiae
atgggctatgtcgactactcaaaagaacctcgtagcgatattgcttttgtcgatatgaaatccttctatgcatctatcgaatgtgtagagagaggacttcacccgcttcatacttcactttgtgtgatgagtagggcagataattcagctggtctaattctagcttcttctccaatgttcaaaaaagtctttggtaaaggaaatgttggcagagcctacgacctcccctttgatgttcataccagaaaatttaactactaccgtgctaaaatttcaggattgccaacggatgcaaaatttgtttccttcatagaaaattgggccaagcgtacatttattgtgccaccgagaatggacttgtacattcaaaaaaatcttgaaatacaaaaagtatttcaaaattatgcagatccgacagatattctgccctattctattgatgaaggatttattgacttaacttcatcgctaaattattttgttgaagacaaatctctgagtcgcaaagataagttagatgtggtttcagcaaaaattcaacacgatatttgggaaaaaacgggtgtctattcaactgttggaatgagtaatgccaatccacttctagctaagttagcacttgataacgaagctaaaaccactgctaccatgcgtgccaattggtcttatgaagatgttgaaacgaaggtctggaatattcccaaaatgactgacttttggggaataggttcacgaacagaaaaacgactaaacaaattgggaatctacagcattaaagaattggccaactgtgaccctactatcttgaaaaaagaatttggtgttattggagtacaacattggtttcatgctaatggcatcgatgaaagtaatgtccatgaaccttatcgccctaaagcagtcgggattgggaattcgcaagtgctccataaagattacactcgtcaaagtgatatagagcttgtcctgcgtgagatggcagagcaagttgcgattcggctacgcagaagacataaaaaagcaactgtagtcgccataaatgtaggctattcaaatttcgaaaacaagaaatcaatcaatgttcagagaaaaattaacccaaataatcgtacgcttgtttttcaagatgaagttgtttctctctttcgttctaaatacgatggaggggcagttagaagcattgctgtaaggtacgatggattggtggatgaaaactttgctgtgatttctctttttgatgactttgaagaaagcgaaaaagaggaaaaattggagacaaccattgattccattcgtgatcgttttggatttcttgctgtacagaaagctagttctttattagaaaattcaagggcaatttctcgcagtagattagtcggcggacattccgctggaggattggagggtttaaaa

SEQ ID NO: 9926 - protein, 471 aa, Streptococcus agalactiae
MGYVDYSKEPRSDIAFVDMKSFYASIECVERGLHPLHTSLCVMSRADNSAGLILASSPMFKKVFGKGNVGRAYDLPFDVHTRKFNYYRAKISGLPTDAKFVSFIENWAKRTFIVPPRMDLYIQKNLEIQKVFQNYADPTDILPYSIDEGFIDLTSSLNYFVEDKSLSRKDKLDVVSAKIQHDIWEKTGVYSTVGMSNANPLLAKLALDNEAKTTATMRANWSYEDVETKVWNIPKMTDFWGIGSRTEKRLNKLGIYSIKELANCDPTILKKEFGVIGVQHWFHANGIDESNVHEPYRPKAVGIGNSQVLHKDYTRQSDIELVLREMAEQVAIRLRRRHKKATVVAINVGYSNFENKKSINVQRKINPNNRTLVFQDEVVSLFRSKYDGGAVRSIAVRYDGLVDENFAVISLFDDFEESEKEEKLETTIDSIRDRFGFLAVQKASSLLENSRAISRSRLVGGHSAGGLEGLK

SEQ ID NO: 9927 - DNA, 294 bp, Streptococcus agalactiae
atgaaattttttcaaaagaaaaaacaaaaccaggatcaattcaaacgactgattcatcgactatcagagatgtcagatagtgaactaaccaaagtagaacaactcctagatgtggtttttgatacaaattttaagcctgatacgagcgttgaattatctcaaagcgatataactgacgaggatcaaagtcttgataggtcaatccaggaagcgaaaaataaacttcacacggaacaattggaaaaaaacattgagaggtttagacaaggtaggcgagagagcaataataacaaa

SEQ ID NO: 9928 - protein, 98 aa, Streptococcus agalactiae
MKFFQKKKQNQDQFKRLIHRLSEMSDSELTKVEQLLDVVFDTNFKPDTSVELSQSDITDEDQSLDRSIQEAKNKLHTEQLEKNIERFRQGRRESNNNK

SEQ ID NO: 9929 - DNA, 6822 bp, Streptococcus agalactiae
atgaatcaagaagtcttactacaaatgatgagagccactattcctcgtgatagagccttgcttgaggcatttttatattaccaagcagagcattttgatgaggagtgggatagtcttattcatcagtttatgaccaataggcaagaaataaataagtctgttcaagtacttcactttgagacagatgtttcagcttttgtccaggctagtccttatgatactgctcatgatctattgacctatacacaagttttcggccaaagtggtcttcaaaaactagataaactatcgccgtctgaaaaaaacttggtgatagaagtggccttgttcaatctggccactcgttttcaattattggattccaatggacactaccaaaccatatcgccggattcactcttacaaaagagtaggggagctaatttggtcaatgtgtatcgtgtggctaataatttagcggatcgtattagtcgagatattgaacagtttctcttaacttacgagcctgagcttgaaactagagctgatgaaactgttctagaaaatgaagaaactgttgatgagcacaaaacaagtgttcatcaagcaatatcttttcgagaagagggctctctggttattgctagtttggatgtagatttgtctcaactagatgttcaaataggaaaaaccagtcatctgccagcttatgaagagttatccttacgacgtaaatttgagattctaacatattttgaccaaattcgaaatgaacgttccaaagtcccaagttttagacgaggtgattttgacacagagatggaaatgacaccagtctttgatggcgaggaattacttacttatctcgaagctgatggcagtccctatgagctgaaacgaacgctgactacagtcgaagaaaaggaattagaaaaaattggacaagccattaggatagaaaatcaagaaaaattgactcagctagggattgatttatctcagtttgacccagaccgagtcggtattttattggatgcagcaggtcgttttcgtttaaaaaatgcagaccttgctttactaggtggttatcccaaagcctcggtaactcaactagcccttgcgacagaactactccaaatgggactaagtcatgaaaaggttgaatttttctttggtagccagctttccattgaagagctgcgacaagttgcctacgcctttttataccaagaactcagcagagaagatgcggagcaatttgaaaaagataaaggtaatcagccagatttaactctcagagattggaaaagcaagctagagaaagctgagggaaaagaagtagttgatgaagaattcgcggaaaatccactggttcagagagtattggacacttatcctctggggtcattggtttcctataagggacaggactttgaggtcatgtcggtcagcgatgctcgattgaacggtttgattcggattgagttagtcaatgacttttcggatatcattgaacaaaatccagttctttatgtgaggacctgggaagaagtcagtcaggcacttcatcagccaaaggcagaaccacaaacagagttagaagaagcggaccaagaattaaacctattctcatttctggaagaggagccagttcagagtattggactattggaaccagatgattcagaaaatggtcataacgatactgatcttgaagaaacagataatcaaattcctgaagaggaagtcgtcgaaacaattccagagattccagtaacggacttttattttccagaagatttgacggacttttatcctaagactgctagagataaggttgagacaaacattgtggccattcgtttggtaaaaaatctagaagtagagcaccgcaatgcttcaccaagtgaacaagaactccttgccaagtatgtaggctggggtggactagccaatgaattttttgatgactataatccaaaattttctaaggaacgagaagaactgaagagcctagtcacagataaagagtattcggatatgaaacagtcctccctgacagcctattacacagacccatccctgatccgtcagatgtgggataagttggaaagagatggctttacaggtggcaaaatcctagatccttccatgggaacagggaatttctttgcggctatgccaaaacacttaagagaaaagagtgagttgtatggcgtagagttagatactattacaggagctattgccaaacaccttcatcccaatagtcatattgaaattaagggatttgagacggtggcttttaacgacaatagttttgatttggtgatttcaaatgtgccctttgccaatatacgaattgcggataataggtacgataggccttacatgattcatgactactttgtcaaaaagtcacttgatttgcttcatgatggtggacaagtagcgattatctcttccacaggaactatggataagcgaacagaaaacatcttacaagatattcgtgagacaactgaatttcttggtggggttcgactgcctgactctgcctttaaggccattgcaggaacgagtgtcacaacggatatgttattcttccagaaacacttagacaagggatatgtggcagacgatttagccttttcaggttccattcgctatgacaaggatagtcgcatttggctcaatccttattttgatggagaatacaatagccaggtgctaggaacctacgaggtcaggaattttaacggaggaacactttctgttaaggggactagtgatgacttgattgcaagtgttgaaacagctctaaatcacgttaaggccccaagagagattgatagaaatgaggtcatcattaacccagatgtgttgaccaaacaagtcaatgatacctccattccagctgaaatgagggaaaatctaggtcagtacagttttggttatcaggggtctacagtttactatcgagataacaaaggcattcgagtcggaaccaagacggaagaaatcagttactatgtcgatgaagagggcaacttcaaagcatgggacaccaaacattctcaaaagcagattgatcgctttaatgccttagaagtgactgataacactgctctggatgtctatgtgaccgatgatgcagccaaacgtggtcagtttaaggggtattataaaaagacagttttctatgaagctccattgtcttataaagaagtggcacgtatcaaaggaatggtcgatattcgcaatgcctaccaagaagttattgccattcaacgctattatgactatgataaggagacctttaaccacttgttaggcaaactcaatcgtacctatgatagctttgtcaaacactatgggtatttgaatagtgctgtgaaccgcaatctttttgatagtgatgataagtattcgcttcttgctagtttggaagatgaaagtctggatccaagtggaaagtctgttatctatactaaatcccttgcctttgagaaggctctagtgcgtcctgaaaaagaggttaaaaaggtgcatactgcccttgatgccttaaattcgagcttggctgacggacgaggtgttgatttcgcttatatgatgtctatctatcaggttgaatcgcagatgaccttgattgaggagttaggcgacctcattatgcctgatcctgagaagtatttgaatggagaattgacctatgtttctcgccaagactttctttcaggggatgtcgtcactaagttagaagtggtagatctattcgtcaaacaagacaatcaggactttaactggtcacattatgcgggacttctagaagctatcaaaccagcccgtattactttggcagacattgattatcgaatcggttcacgctggattcctctggctgtttatggaaaatttgcccaagaaacctttatggggaaagcctatgaactgtcagaccaagaagtagcgacagtcctagaagtcagtcccattgacggggttatcacttaccaatctaagtttgcctacacctattccaacgcaacggataggagtttaggtgtccctgcttcacgctatgatagtggtcgaaaaatctttgaaaatctcctgaattccaatcaaccaaccatcacaaaacaagttgtcgaaggggataagaaaaagaatgtgacggatgtagagaaaacaacggtcctgcgtgccaaggaaacacacctacaagaactctttcaaggttttgtagcaaagtatccagaagtccaacaaatgattgaagacacctataataggctctacaatcgtacggtatcaaagtcctatgatggtagtcatttaaccattgatggacttgctcagaatatctccttacgtcctcaccaaaagaatgccattcaacgaattgtcgaggaaaaacgtgctctactagctcatgaagttggttcaggtaaaacacttaccatgcttggggcaggattcaaactgaaagaactcggaatggtacataaaccactttatgtggtgccgtctagtctgactgctcagtttggtcaagaaatcatgaaatttttccctaccaagaaagtctatgtgactactaagaaagactttgccaaagccaaacgcaagcagtttgtgtcccgtattattacaggggactatgatgccattgtcattggggattcacaatttgagaagataccgatgagtcgtgaaaaacaggtcacctatatcaatgacaaacttgagcaactccgagaaatcaagctaggaagtgacagtgattacacggtgaaagaagcggaacgttcgattaagggattagaacaccagttggaagaactccaaaaactagagcgagatacctttattgagtttgaaaaccttggaattgattttctttttgtggatgaggctcatcacttcaagaatatccgtccaatcactggacttgggaatgtagctggaatcaccaacacaacttctaaaaagaacgtggatatggagatgaaggtgagacaagtacaggcagagcatggagatagaaatgtcgtttttgcgacaggaacaccagtttctaactctattagtgaacttttcaccatgatggattacattcaacctgatgtcttggaacgatacctggtatcaaattttgactcctgggttggggcttttgggaatatcgaaaactccatggaactagccccgacaggagataagtaccaacccaagaaacggttcaagaaatttgtcaaccttcctgaactcatgcgaatctacaaggaaactgccgatattcagacctcagacatgcttgatttaccagtaccggaagctaagattattgcggtggaaagcgagttaacgcaagctcagaaatactatttggaagagctggtaaagcgttcagacgctatcaagtcaggtagtgttgatccaagtagagataacatgcttaaaatcacaggagaagccagaaaactagctattgatatgcggttgattgaccctacttactccttatcggataatcagaaaatccttcaagtagtcgataatgtcgagcggatttaccgtgatggagctggagacaaagccactcagatgattttctcagatattggaacccctaaaagtaaggaagaagggtttgatgtctacaatgaacttaaggacttgtttgtcgatcgagggataccaaaagaagaaattgcctttgtccatgatgccaatactgatgagaagaaaaactctctgtcacgcaaggtcaatagtggagaagtacggattctcatggcttctacggaaaaagggggaacaggattaaacgtccaatctcgcatgaaagctgtccactatttagacgttccctggaggccctcagacattgtccagcgaaatggacgactaattcgacaaggaaacatgcaccaggaggtagatatttatcactatattactaaagggagctttgacaattacctctggcagacgcaggagaataagctaaagtatatcacccagataatgacctcaaaagatcctgtgagatcagctgaagacattgatgaacaaaccatgaccgcctcagactttaaggcattggcaactgggaacccttatctcaaactcaaaatggagttggaaaatgaactgacagttttagagaatcaaaaacgagcctttaatcgctccaaagacgagtatcgccataccatttcctatagcgagaagcacctccctattatggaaaaacggttgagtcaatatgataaagatattgcccaatctttggcaaccaagtcgcaagattttgtcatgcgatttgacaatcaagcaatggataatcgtgctgaagctggggactatctgcgaaaactcattacctataaccgctcagagaccaaggaagtcaggacacttgccagctttagaggatttgatttaaaaatgactacacgaggtgctagtgagcccttaccagaaaccatttctttaatgattgtaggtgataaccagtatactgtcgcccttgatttgaaatcagacgtgggaaccattcaacggattagtaatgccattgaccatattatagatgaccaagaaaagacgcaagagctggtaaaggatttaaaagataagctacgagtagccaaagtagaagttgataaagtctttccaaaggaagaggactatcagcttgtaaaggctaagtatgatgttttagctcccttggttgaaaaagaagcagagattgaagagatagatgcagctttggccaagtttagtgaagatacaacaccccaaaagaagcaacaaatagcactcgagata

SEQ ID NO: 9930 - protein, 2274 aa, Streptococcus agalactiae
MNQEVLLQMMRATIPRDRALLEAFLYYQAEHFDEEWDSLIHQFMTNRQEINKSVQVLHFETDVSAFVQASPYDTAHDLLTYTQVFGQSGLQKLDKLSPSEKNLVIEVALFNLATRFQLLDSNGHYQTISPDSLLQKSRGANLVNVYRVANNLADRISRDIEQFLLTYEPELETRADETVLENEETVDEHKTSVHQAISFREEGSLVIASLDVDLSQLDVQIGKTSHLPAYEELSLRRKFEILTYFDQIRNERSKVPSFRRGDFDTEMEMTPVFDGEELLTYLEADGSPYELKRTLTTVEEKELEKIGQAIRIENQEKLTQLGIDLSQFDPDRVGILLDAAGRFRLKNADLALLGGYPKASVTQLALATELLQMGLSHEKVEFFFGSQLSIEELRQVAYAFLYQELSREDAEQFEKDKGNQPDLTLRDWKSKLEKAEGKEVVDEEFAENPLVQRVLDTYPLGSLVSYKGQDFEVMSVSDARLNGLIRIELVNDFSDIIEQNPVLYVRTWEEVSQALHQPKAEPQTELEEADQELNLFSFLEEEPVQSIGLLEPDDSENGHNDTDLEETDNQIPEEEVVETIPEIPVTDFYFPEDLTDFYPKTARDKVETNIVAIRLVKNLEVEHRNASPSEQELLAKYVGWGGLANEFFDDYNPKFSKEREELKSLVTDKEYSDMKQSSLTAYYTDPSLIRQMWDKLERDGFTGGKILDPSMGTGNFFAAMPKHLREKSELYGVELDTITGAIAKHLHPNSHIEIKGFETVAFNDNSFDLVISNVPFANIRIADNRYDRPYMIHDYFVKKSLDLLHDGGQVAIISSTGTMDKRTENILQDIRETTEFLGGVRLPDSAFKAIAGTSVTTDMLFFQKHLDKGYVADDLAFSGSIRYDKDSRIWLNPYFDGEYNSQVLGTYEVRNFNGGTLSVKGTSDDLIASVETALNHVKAPREIDRNEVIINPDVLTKQVNDTSIPAEMRENLGQYSFGYQGSTVYYRDNKGIRVGTKTEEISYYVDEEGNFKAWDTKHSQKQIDRFNALEVTDNTALDVYVTDDAAKRGQFKGYYKKTVFYEAPLSYKEVARIKGMVDIRNAYQEVIAIQRYYDYDKETFNHLLGKLNRTYDSFVKHYGYLNSAVNRNLFDSDDKYSLLASLEDESLDPSGKSVIYTKSLAFEKALVRPEKEVKKVHTALDALNSSLADGRGVDFAYMMSIYQVESQMTLIEELGDLIMPDPEKYLNGELTYVSRQDFLSGDVVTKLEVVDLFVKQDNQDFNWSHYAGLLEAIKPARITLADIDYRIGSRWIPLAVYGKFAQETFMGKAYELSDQEVATVLEVSPIDGVITYQSKFAYTYSNATDRSLGVPASRYDSGRKIFENLLNSNQPTITKQVVEGDKKKNVTDVEKTTVLRAKETHLQELFQGFVAKYPEVQQMIEDTYNRLYNRTVSKSYDGSHLTIDGLAQNISLRPHQKNAIQRIVEEKRALLAHEVGSGKTLTMLGAGFKLKELGMVHKPLYVVPSSLTAQFGQEIMKFFPTKKVYVTTKKDFAKAKRKQFVSRIITGDYDAIVIGDSQFEKIPMSREKQVTYINDKLEQLREIKLGSDSDYTVKEAERSIKGLEHQLEELQKLERDTFIEFENLGIDFLFVDEAHHFKNIRPITGLGNVAGITNTTSKKNVDMEMKVRQVQAEHGDRNVVFATGTPVSNSISELFTMMDYIQPDVLERYLVSNFDSWVGAFGNIENSMELAPTGDKYQPKKRFKKFVNLPELMRIYKETADIQTSDMLDLPVPEAKIIAVESELTQAQKYYLEELVKRSDAIKSGSVDPSRDNMLKITGEARKLAIDMRLIDPTYSLSDNQKILQVVDNVERIYRDGAGDKATQMIFSDIGTPKSKEEGFDVYNELKDLFVDRGIPKEEIAFVHDANTDEKKNSLSRKVNSGEVRILMASTEKGGTGLNVQSRMKAVHYLDVPWRPSDIVQRNGRLIRQGNMHQEVDIYHYITKGSFDNYLWQTQENKLKYITQIMTSKDPVRSAEDIDEQTMTASDFKALATGNPYLKLKMELENELTVLENQKRAFNRSKDEYRHTISYSEKHLPIMEKRLSQYDKDIAQSLATKSQDFVMRFDNQAMDNRAEAGDYLRKLITYNRSETKEVRTLASFRGFDLKMTTRGASEPLPETISLMIVGDNQYTVALDLKSDVGTIQRISNAIDHIIDDQEKTQELVKDLKDKLRVAKVEVDKVFPKEEDYQLVKAKYDVLAPLVEKEAEIEEIDAALAKFSEDTTPQKKQQIALEI

SEQ ID NO: 9931 - DNA, 588 bp, Streptococcus agalactiae
atgtcaaaaaaagagattctactcgattttatagaaaagaacaatggcattgtcacaaacaaagattgtaaagcactaggtattccaacaatatatctgacaagactagagaaagaaggcattatcttccgagttgaaaaaggtattttcctaacccaaaacggagactatgatgaatactacttctttcaatatcgttttcctaaggctattttctcttatatttcggcactgtatctacaacagtttacagatgaaattccacaatattttgatgtgacagttcctagaggctaccgctttaatactcctccagctaatctaaacattcactttgtctctaaagaatacagcgagctgggaatgactactgtacctactcctatgggaaacaacgtaagggtatatgattttgaacgtattatttgtgattttgtaatacatcgagaaaagattgattccgaactctttgtcaagacacttcaatcttatgggaactatcctaaaaaaaatctagcaaaactctatgaatatgcgacaaaaatgaatactttagaaaaagttaaacaaactctggaggttctaata

SEQ ID NO: 9932 - protein, 196 aa, Streptococcus agalactiae
MSKKEILLDFIEKNNGIVTNKDCKALGIPTIYLTRLEKEGIIFRVEKGIFLTQNGDYDEYYFFQYRFPKAIFSYISALYLQQFTDEIPQYFDVTVPRGYRFNTPPANLNIHFVSKEYSELGMTTVPTPMGNNVRVYDFERIICDFVIHREKIDSELFVKTLQSYGNYPKKNLAKLYEYATKMNTLEKVKQTLEVLI

SEQ ID NO: 9933 - DNA, 240 bp, Streptococcus agalactiae
atgaatcaaaaactaacaggctttgtttacggagtggacgccagctccatgttctcccaggccatgtctctattacaaaaaggcttgattgcagtaggagcctttcttgtagtcatgggcattatcaacctttcaaccaacattaaagatggtgggccaggcgtccgaaatgccattttagaaattgttggtggtgtcatggtgggagccgcaggtgcttttgtgacacagattaccatt

SEQ ID NO: 9934 - protein, 80 aa, Streptococcus agalactiae
MNQKLTGFVYGVDASSMFSQAMSLLQKGLIAVGAFLVVMGIINLSTNIKDGGPGVRNAILEIVGGVMVGAAGAFVTQITI

SEQ ID NO: 9935 - DNA, 486 bp, Streptococcus agalactiae
atgtcatctgaacaacaagaacgtcaagcgatgcaatacgtagaaagaagtagtttattgacagtcagaaccctcttaaaactcttagaatggtcggctaggcaagccttagctcaagattcagcttataagattggggttcaaaaaatggaagaactccttcaaagtccttacgccattgaagcgattgatgttagtaaagacatactggataagccaatcgatgtggagaaatttaaggagttgatggagtcagaaaaactgccaatcgcaattagttggcaaaaagactatctctacttttatgccaaggataagaccttgctcgatcatcacttggatgaattgttgaagaaactgatgtctaatccagagaagctagaaggtttaacctttgataaaaccttggaccaagagatagaactggccaaagagaaaattagagtgacagaactttcggcagtaaaaaccaaggaggtgaccttg

SEQ ID NO: 9936 - protein, 162 aa, Streptococcus agalactiae
MSSEQQERQAMQYVERSSLLTVRTLLKLLEWSARQALAQDSAYKIGVQKMEELLQSPYAIEAIDVSKDILDKPIDVEKFKELMESEKLPIAISWQKDYLYFYAKDKTLLDHHLDELLKKLMSNPEKLEGLTFDKTLDQEIELAKEKIRVTELSAVKTKEVTL

SEQ ID NO: 9937 - DNA, 582 bp, Streptococcus agalactiae
atgataaggatagtgttgttttatctagccatacagcttaacggtcttctggtgagtttattcctgaaagagtatctgacaatagagggtatagtcttgctacaattggtcctattaagtgtgacttgcttagagattgcccgtcataaaactgttccattaaaaattgtgggcgtacaaaatcgcctaagttggttgcttcttggctttgtggctatggttgcttttgcagtcttcatcagtttcctatttccagttcagactaggaatcaagcagtattggtacaagtaggaaaacaggttcctcctattatctttttattgtttctggtcaatgcaagtattcttgaagagattgtttacaggcaattgctgtgggaaaaattgacattcccttttgaacaaataggcgtgaccagttttctctttgttctatcccatggacctaatcagttagggagttggctcatctatagctgtcttggcttgaccttggctgttgttcgattgaaaactgattgtatgacggcaatcgccttacatttactttggaatagtttggcttatgtcgtaactttcttg

SEQ ID NO: 9938 - protein, 194 aa, Streptococcus agalactiae
MIRIVLFYLAIQLNGLLVSLFLKEYLTIEGIVLLQLVLLSVTCLEIARHKTVPLKIVGVQNRLSWLLLGFVAMVAFAVFISFLFPVQTRNQAVLVQVGKQVPPIIFLLFLVNASILEEIVYRQLLWEKLTFPFEQIGVTSFLFVLSHGPNQLGSWLIYSCLGLTLAVVRLKTDCMTAIALHLLWNSLAYVVTFL

SEQ ID NO: 9939 - DNA, 231 bp, Streptococcus agalactiae
atgaatgaacgattttgggacaatttagaaatcattctggctgaaaaagacctcacttgggcagaactagctcgcaaagtattcaacggtcaatatgtttatccaagtgaatttaatcgcctctatcaaaaattacggcattacaaatctaatcgtctgatgccacaaataagatgggttgagcgtattgttctagtcttagatattgattatgaagatttatttaagagg

SEQ ID NO: 9940 - protein, 77 aa, Streptococcus agalactiae
MNERFWDNLEIILAEKDLTWAELARKVFNGQYVYPSEFNRLYQKLRHYKSNRLMPQIRWVERIVLVLDIDYEDLFKR

SEQ ID NO: 9941 - DNA, 93 bp, Streptococcus agalactiae
atgatttggtggatactaggtggaatctatctgatttctatcatcattttgattgttgaaatcatccgtgcaccagaaatggatgatcatata

SEQ ID NO: 9942 - protein, 31 aa, Streptococcus agalactiae
MIWWILGGIYLISIIILIVEIIRAPEMDDHI

SEQ ID NO: 9943 - DNA, 363 bp, Streptococcus agalactiae
atggcattaaacattgaaaatattattgctgaaattaaagaagctacaattcttgaacttaacgatcttgtaaaagctatcgaagaagaatttggtgtaactgctgctgctcctgtagctgctgccgctgctggtggtgaagctgctgctgctaaagactcatttgacgttgaattaacagctgctggagacaaaaaagttggcgttatcaaagttgttcgtgaaatcacaggcgaaggtcttaaagaagctaaagctatcgttgataacgcaccatcagttatcaaagaaggtgcttcagaagcagaagctaacgaaatcaaagaaaaacttgaagctgcaggtgcttcagttactcttaaa

SEQ ID NO: 9944 - protein, 121 aa, Streptococcus agalactiae
MALNIENIIAEIKEATILELNDLVKAIEEEFGVTAAAPVAAAAAGGEAAAAKDSFDVELTAAGDKKVGVIKVVREITGEGLKEAKAIVDNAPSVIKEGASEAEANEIKEKLEAAGASVTLK

SEQ ID NO: 9945 - DNA, 1023 bp, Streptococcus agalactiae
gtgctgggctttacttcggtgttccatttattattttctgctatatttatcacaaactacgttacaagaaatggtgatcttatgggaagatttaaagaacttttagagagtaaaaaaactctcatcctacatggtgccttggggaccgagcttgagagtagaggttgtgatgtttctgggaaactttggtcagccaaatatctgattgaggatccagcagctattcagaccattcatgaagattatattcgtgctggcgctgatattgtgacgacatcaacttatcaggcgactttacaaggactagctcaagttggtgtctctgaaagtcagacagaagatttgattcgcttgactgttcagttggcaaaagctgcgcgtgagcaagtttggaaaagtttgacaaaagaagaaaaatcagagagaatctatcctttgatttctggggatgttggtccctacgctgcctttttagcggatggctctgagtacactggactctacgatattgataagcaaggtcttaaaaacttccatcgccatcgtattgagcttcttttagatgagggtgttgacattctggcacttgaaaccattccaaacgctcaggaggctgaggctcttattgagctacttgccgaggatttccctcaggttgaggcttatatgtcattcacctctcaagatggtaagaccatctcagatggtagtgctgttgcagacttggcgaaagctattgatgttagcccacaggtcgtggcgctgggcattaactgttcaagtccatcgttagttgctgatttcttgcaagcaatagcagagcagactaacaagcctcttgtgacctatccaaactctggagaggtttatgatggggcaagccaatcttggcaatctagccctgatcattcacacaccctacttgaaaatacaagtgactggcaaaaacttggcgcccaagttgtcggaggttgttgccgaactagaccagctgatattgctgacctctctgcacatttaaaa

SEQ ID NO: 9946 - protein, 341 aa, Streptococcus agalactiae
MLGFTSVFHLLFSAIFITNYVTRNGDLMGRFKELLESKKTLILHGALGTELESRGCDVSGKLWSAKYLIEDPAAIQTIHEDYIRAGADIVTTSTYQATLQGLAQVGVSESQTEDLIRLTVQLAKAAREQVWKSLTKEEKSERIYPLISGDVGPYAAFLADGSEYTGLYDIDKQGLKNFHRHRIELLLDEGVDILALETIPNAQEAEALIELLAEDFPQVEAYMSFTSQDGKTISDGSAVADLAKAIDVSPQVVALGINCSSPSLVADFLQAIAEQTNKPLVTYPNSGEVYDGASQSWQSSPDHSHTLLENTSDWQKLGAQVVGGCCRTRPADIADLSAHLK

SEQ ID NO: 9947 - DNA, 1224 bp, Streptococcus agalactiae
atggctgggaatcgtaataacgatatgaatgtctattgttcattttgtggcaaaagccaagatgaagtaaaaaaaattattgcaggtaatggtgttttcatttgtaatgaatgtgtggccttatcacaagaaattattaaggaagaattagctgaggaagtactggctgatttagcagaagtaccaaaacctaaggaactattagaaatattaaatcaatatgttgtagggcaagatcgtgctaaacgtgctttagcagttgctgtctacaatcattacaagcgtgttagttataccgagagtagtgacgatgatgtagatttgcaaaaatccaacattttgatgattggtccaactggctcaggaaaaaccttcttagcacaaacactggctaaaagccttaatgtaccgtttgctattgcagatgcgacttcattgaccgaagcaggatacgttggagaagatgttgagaatattcttcttaaattgattcaagctgctgattataatgtcgaacgtgctgagcgtggtattatctacgttgatgaaatagataaaattgctaagaaaggcgaaaatgtttctatcacacgtgatgtgtctggtgaaggtgtacagcaagcccttcttaaaattattgagggtacggtagcaagtgttcccccacagggtgggcgtaaacatcctaaccaagaaatgattcaaattaataccaagaacatcctttttattgtcggtggtgcttttgatggtattgaagaccttgtgaagcaacgtttaggcgaaaaagttattggttttggacagacaagccgtaaaattgatgacaacgcttcttatatgcaagagataatttctgaggatattcaaaagtttggactgattccagagtttattggccgtttaccagtagttgcagcgttagaacttcttactgcagaagatctggttcgtattctgacagaaccacgcaatgctttggttaaacaataccaaaccttattatcttatgatggtgtagaattggaatttgaccaggatgctctattggctatcgctgataaggctatcgagcgcaagactggtgcacgtggtttacgttctattattgaagaaacgatgcttgatatcatgtttgaaattccaagccaagaagatgtaacaaaagttcgtatcacaaaggctgctgttgagggtactgacaagcctgttttagagacggct

SEQ ID NO: 9948 - protein, 408 aa, Streptococcus agalactiae
MAGNRNNDMNVYCSFCGKSQDEVKKIIAGNGVFICNECVALSQEIIKEELAEEVLADLAEVPKPKELLEILNQYVVGQDRAKRALAVAVYNHYKRVSYTESSDDDVDLQKSNILMIGPTGSGKTFLAQTLAKSLNVPFAIADATSLTEAGYVGEDVENILLKLIQAADYNVERAERGIIYVDEIDKIAKKGENVSITRDVSGEGVQQALLKIIEGTVASVPPQGGRKHPNQEMIQINTKNILFIVGGAFDGIEDLVKQRLGEKVIGFGQTSRKIDDNASYMQEIISEDIQKFGLIPEFIGRLPVVAALELLTAEDLVRILTEPRNALVKQYQTLLSYDGVELEFDQDALLAIADKAIERKTGARGLRSIIEETMLDIMFEIPSQEDVTKVRITKAAVEGTDKPVLETA

SEQ ID NO: 9949 - DNA, 492 bp, Streptococcus agalactiae
atgacaaagcaaataattgccatttgggctgaagatgaagaccatttgattggagttaatggcggtttaccatggaggcttcctaaagagttacatcacttcaaagaaacgaccatggggcaggctttgcttatgggacgaaagacctttgatggaatgaaccgtcgtgttttacctggtagagagacaatcatcttaacaaaagatgaacaattccaagcagatggagtgacagtcctaaatagtgttgaacaagttataaaatggtttcaggaacataataagaccttatttattgtaggtggtgcaagtatttataaagcatttctgccttattgtgaagcaatcataaaaactaaagttcatggaaaatttaaaggtgatacctattttcctgatgttaatctatctgagtttaaagttatctctagagattattttgaaaaggatgagcagaatgctcatgcttttactgtgacatattttgaaaaa

SEQ ID NO: 9950 - protein, 164 aa, Streptococcus agalactiae
MTKQIIAIWAEDEDHLIGVNGGLPWRLPKELHHFKETTMGQALLMGRKTFDGMNRRVLPGRETIILTKDEQFQADGVTVLNSVEQVIKWFQEHNKTLFIVGGASIYKAFLPYCEAIIKTKVHGKFKGDTYFPDVNLSEFKVISRDYFEKDEQNAHAFTVTYFEK

SEQ ID NO: 9951 - DNA, 561 bp, Streptococcus agalactiae
atgctaatcctattaccaatcaccgctgtctatagtcacaaccacttcggattacaagcagcacttggtacctcaatattcgtcacttctttatttttgatgtttttatcatcaagtatttaccactccatgacttataacagtcttcaaaaatatgttctacgcatgattgatcactctatgatttatattgctattgcaggtagttatactcctgtcgcattgtcacttattggcggctggttaggatatctcatcatttttttacaatgggggattacattatttggtatcctttataaaatcttcgctcccaaaatcaatgataaatttagccttgtactttacctcattatgggatggctggttatctttattttccctgctattatcacaaaaactggaccagctttttggggattactcttggctggtggtatttgctatactatcggtgcactcttttatgctcgcaaacgtccttatgatcacatgatttggcacctttttattctattagcttctattttacaatacattggaattgtctacttcatgcta

SEQ ID NO: 9952 - protein, 187 aa, Streptococcus agalactiae
MLILLPITAVYSHNHFGLQAALGTSIFVTSLFLMFLSSSIYHSMTYNSLQKYVLRMIDHSMIYIAIAGSYTPVALSLIGGWLGYLIIFLQWGITLFGILYKIFAPKINDKFSLVLYLIMGWLVIFIFPAIITKTGPAFWGLLLAGGICYTIGALFYARKRPYDHMIWHLFILLASILQYIGIVYFML

SEQ ID NO: 9953 - DNA, 438 bp, Streptococcus agalactiae
atggagaatcctcttcaaaaagcacgaatacttgttaatcaacttgaaaagtatttagatcattatgcaaaagaatatgatgttgaacatttagcgggtccacaaggacacctagtgatgtatctctataaacatcctgataaggatatgtctataaaagctgttgaagaaatcttacacatttctaagtctgtagcttctaatttggtaaaacggatggaaaaaaatggttttattgcgattgtaccatctaagacagataagcgtgtaaaatatctttatttgactcacttaggtaaaaaaaaggctacacaatttgaaattttcttagaaaaattgcatagtactatgttagcaggtattactaaagaagagattcgtaccaccaaaaaggttattaggacattagctaaaaatatggcaatggaaaatcttgat

SEQ ID NO: 9954 - protein, 146 aa, Streptococcus agalactiae
MENPLQKARILVNQLEKYLDHYAKEYDVEHLAGPQGHLVMYLYKHPDKDMSIKAVEEILHISKSVASNLVKRMEKNGFIAIVPSKTDKRVKYLYLTHLGKKKATQFEIFLEKLHSTMLAGITKEEIRTTKKVIRTLAKNMAMENLD

SEQ ID NO: 9955 - DNA, 507 bp, Streptococcus agalactiae
atgaaatggttcccacttgttggaggtataattgccttattagctggcttctatctctttataaatcctgtaacggttgttgcaactctgggttggttcattgctttatttatctttatttatggcatttcaaatttagtacgctacttgcaagctgattcttatcaccgtagcccttggtatctggttcagagtatccttgctattatttttggtatcattttactatccagctcagcaatgtcactttcaaatactgtcatgactattttagcatactggctactggtatctggtattttacgacttttgggtggtttccaaatgcaaaaaattaatttcccaggtgccaaatcctataaacgttcggcttatattgcactcattttaggtattattttactggttcaacctaccttatcagcagccatcattggaagatttgtagcctttatattaatagcaattggagcttcggctatttacacttttactcgtattaattat

SEQ ID NO: 9956 - protein, 169 aa, Streptococcus agalactiae
MKWFPLVGGIIALLAGFYLFINPVTVVATLGWFIALFIFIYGISNLVRYLQADSYHRSPWYLVQSILAIIFGIILLSSSAMSLSNTVMTILAYWLLVSGILRLLGGFQMQKINFPGAKSYKRSAYIALILGIILLVQPTLSAAIIGRFVAFILIAIGASAIYTFTRINY

SEQ ID NO: 9957 - DNA, 1206 bp, Streptococcus agalactiae
atgagattaaattatttgccttctgagtttcagaaggctttaccaatattaaaaaagataaaaaaagccggttatgaagcatactttgtaggtggtagtgttcgggatgttttacttgaccgtccaattcatgatgttgatatagcaacgtcatcttatccagaagaaacaaagcagatttttaaaaggacagttgatgttggtattgaacatggaacagtcttagtattggaaaaaggtggtgaatatgagattaccacttttaggactgaggaggtttatgttgattataggcgtccgagtcaggtcaattttgttaggtcgctagaagaagatctaaaacgtcgagatttcacagttaatgcctttgctttaaatgaagatggagaagttattgatctctttcatggattggatgatttagataatcaccttcttagagcagtaggactcgccagtgagcgttttaatgaagatgctcttcgaattatgcgtggtttgcgtttttctgctagtctaaattttgatatcgaaacaacaacttttgaggcaatgaaaaagcacgcgtcattattggagaaaatatctgttgagcgttcttttattgaatttgataaacttctattagcaccttattggcgtaaaggaatgctggcactaatagatagtcatgcttttaattatctaccatgcttaaaaaatagggaattacaattaagcgcctttttgtcccagttagataaagattttttatttgagacatcagaacaagcttgggcatcactcatcttgagtatggaagttgaacacacaaagacttttttaaaaaaatggaagacatcaactcactttcaaaaagatgttgagcatatagtggatgtttatcgtattcgtgaacaaatgggattgactaaagaacatctttatcgttatggaaaaactataataaaacaagcggaaggtattcgcaaagcaagaggcttgatggttgatttcgaaaaaatagaacaactagatagtgagttagcaatccatgataggcatgagatagttgtcaatggtggcaccttaatcaagaaattaggaataaaacctggtccacagatgggagatattatctctcaaattgaattagccattgttttaggacaactgattaatgaagaagaggctattttacattttgttaagcagtacttgatggat

SEQ ID NO: 9958 - protein, 402 aa, Streptococcus agalactiae
MRLNYLPSEFQKALPILKKIKKAGYEAYFVGGSVRDVLLDRPIHDVDIATSSYPEETKQIFKRTVDVGIEHGTVLVLEKGGEYEITTFRTEEVYVDYRRPSQVNFVRSLEEDLKRRDFTVNAFALNEDGEVIDLFHGLDDLDNHLLRAVGLASERFNEDALRIMRGLRFSASLNFDIETTTFEAMKKHASLLEKISVERSFIEFDKLLLAPYWRKGMLALIDSHAFNYLPCLKNRELQLSAFLSQLDKDFLFETSEQAWASLILSMEVEHTKTFLKKWKTSTHFQKDVEHIVDVYRIREQMGLTKEHLYRYGKTIIKQAEGIRKARGLMVDFEKIEQLDSELAIHDRHEIVVNGGTLIKKLGIKPGPQMGDIISQIELAIVLGQLINEEEAILHFVKQYLMD

SEQ ID NO: 9959 - DNA, 1923 bp, Streptococcus agalactiae
atggatttaaaagcaaccagtaaagaggctgcaattgatgaaatgattacaaaattagttgacacaggtgttgtgacaaactttgctatttttaaagatggtatcatgaagcgtgaggcacaaacatcaactggattaggtgatggtatcgctatgccacatagtaaaaatgctgccgttaaagaagctactgtcctttttgcaaaatctgcatcaggtgttgattacgaagcacttgatggacagccaactgatttattctttatgattgctgcgccagatggtgctaatgatacgcatttagctgccttggcagaactatctaaatatcttttaaaagaagggttcgctgatcaattacgtcaagcaaaaacgccagatgacattattgctacttttgatagtaatagcatttctcaagaaacagtagctccacaaacagtacaatcaacaagtaaaggttcagattatattgttgcagtaacagcttgcactacgggaattgcccacacgtatatggcagaagaagctttaaagaaaaaagcagctgaaatgggtgtaggtattaaagttgaaacaaatggcgcttctggtgtaggaaataagttgacttcaagtgatattgcaagggctaagggtgttattattgcagcagataaggctgtagagatggatcgttttgatggcaaacctttggtatcacgtccggtagctgatggtattaaaaaaagtgaagacttaattaacattattctcgataataaggcacaaacctatcatgcaaaaaatcaaaatgataaacaatcaggtgaatctgatggaaaatcaggcttaggctctgctttttataaacaccttatgggtggtgtatcacaaatgttaccattcgttattggtggtggtattatgattgcgattgctttcctttttgataacatacttggtgtaccaaaagaccaattaagtaatttaggttcataccatgaaattgcagccttattcaaaaatatcggtggcgcagcatttgcatttatgttaccagtattggcaggttatatcgcttattcaatagctgaaaaaccaggactagtagctggcttcgtagctggttcaattgcatcaagtggactggcattcggtaaagtaccttttgcagaaggtgggaaagcaaccttagcattagcaggtgtgccatcaggtttcttaggggctttagtaggtggtttcttagctggtggagttatcctactacttagaaaattactttcaggtctcccaaaatcgcttgaaggtattaaatcaattcttctatacccattgttaggtgttttgattacaggtttcttgatgttgctcgtaaacattccaatggcagctatcaacacagctcttaacactttcttacaaggtttatctggtagttcagcagtcttgatgggcttactagttggtggtatgatggctgtagatatgggtgggcctgttaataaagcagcttatgtttttggtacaggtactcttgcagcaactgttgcaaatggcggctctgttgttatggcagctgtaatggctggaggaatggttccaccgttagcagtatttgtggcaactttattatttaaagataaatttaataatgaagaacgtcaatctggtctaacaaatatcgttatggggttatcttttatcactgaaggtgctattccgtttggtgctgctgacccagctcgtgcaatccctagctttattgtaggttcagccttaactggagcacttgttggtttagctggtatcaagttgatggctcctcatggagggatttttgtcatcgcattaacaagtaatcctttactttatattctatttattctaattggagcggtagtctcaggtgtactctttggcttgttccgtaaaataaaa

SEQ ID NO: 9960 - protein, 641 aa, Streptococcus agalactiae
MDLKATSKEAAIDEMITKLVDTGVVTNFAIFKDGIMKREAQTSTGLGDGIAMPHSKNAAVKEATVLFAKSASGVDYEALDGQPTDLFFMIAAPDGANDTHLAALAELSKYLLKEGFADQLRQAKTPDDIIATFDSNSISQETVAPQTVQSTSKGSDYIVAVTACTTGIAHTYMAEEALKKKAAEMGVGIKVETNGASGVGNKLTSSDIARAKGVIIAADKAVEMDRFDGKPLVSRPVADGIKKSEDLINIILDNKAQTYHAKNQNDKQSGESDGKSGLGSAFYKHLMGGVSQMLPFVIGGGIMIAIAFLFDNILGVPKDQLSNLGSYHEIAALFKNIGGAAFAFMLPVLAGYIAYSIAEKPGLVAGFVAGSIASSGLAFGKVPFAEGGKATLALAGVPSGFLGALVGGFLAGGVILLLRKLLSGLPKSLEGIKSILLYPLLGVLITGFLMLLVNIPMAAINTALNTFLQGLSGSSAVLMGLLVGGMMAVDMGGPVNKAAYVFGTGTLAATVANGGSVVMAAVMAGGMVPPLAVFVATLLFKDKFNNEERQSGLTNIVMGLSFITEGAIPFGAADPARAIPSFIVGSALTGALVGLAGIKLMAPHGGIFVIALTSNPLLYILFILIGAVVSGVLFGLFRKIK

SEQ ID NO: 9961 - DNA, 741 bp, Streptococcus agalactiae
atgctaaagtcaaagagaaaagaaattatcttatcacgacttgagcaaaataagagtgttactttagatgaattaacgtctatcttagagacttctgaatctacagttcgcagggatttagatgaacttgaatctgcaggttttttaaaaagggtgcatggtggtgctgaattaccatactcacttggccaggaattaagtaatcaagaaaaagctatcaaaaacgttcaaaaaaaattggatattgctagacaaactgcaaagctgatagcaaagcaagatgttatatttattgatgccggaactacgacagaattattaattgattttctccctcacgagcaattaacggtggtgacgaattctattcatcatgctgcaaagttagttgatagagggataaaaacaatcattatcggaggagcggttaaacattcaacagatgctagtattggccaggtagccattaatcagattaggcagataacggttgacaaagcttttctggggatgaatggtatagatgaagtttatttaactacaccagatttagaagaagctgctattaaagaagctattattaataatagtcaacaaacctttattctaatggattcatctaaaattggacaagttacatttgctaaagtgaaagagataaatgacattaatttagtaactaataagactgattcagaacttatgacaataataaaagagaaaatgaaggtgattcaagta

SEQ ID NO: 9962 - protein, 247 aa, Streptococcus agalactiae
MLKSKRKEIILSRLEQNKSVTLDELTSILETSESTVRRDLDELESAGFLKRVHGGAELPYSLGQELSNQEKAIKNVQKKLDIARQTAKLIAKQDVIFIDAGTTTELLIDFLPHEQLTVVTNSIHHAAKLVDRGIKTIIIGGAVKHSTDASIGQVAINQIRQITVDKAFLGMNGIDEVYLTTPDLEEAAIKEAIINNSQQTFILMDSSKIGQVTFAKVKEINDINLVTNKTDSELMTIIKEKMKVIQV

SEQ ID NO: 9963 - DNA, 1632 bp, Streptococcus agalactiae
atgatgaaaaaaggacaagtaaatgatactaagcaatcttactctctacgtaaatataaatttggtttagcatcagtaattttagggtcattcataatggtcacaagtcctgtttttgcggatcaaactacatcggttcaagttaataatcagacaggcactagtgtggatgctaataattcttccaatgagacaagtgcgtcaagtgtgattacttccaataatgatagtgttcaagcgtctgataaagttgtaaatagtcaaaatacggcaacaaaggacattactactcctttagtagagacaaagccaatggtggaaaaaacattacctgaacaagggaattatgtttatagcaaagaaaccgaggtgaaaaatacaccttcaaaatcagccccagtagctttctatgcaaagaaaggtgataaagttttctatgaccaagtatttaataaagataatgtgaaatggatttcatataagtctttttgtggcgtacgtcgatacgcagctattgagtcactagatccatcaggaggttcagagactaaagcacctactcctgtaacaaattcaggaagcaataatcaagagaaaatagcaacgcaaggaaattatacattttcacataaagtagaagtaaaaaatgaagctaaggtagcgagtccaactcaatttacattggacaaaggagacagaattttttacgaccaaatactaactattgaaggaaatcagtggttatcttataaatcattcaatggtgttcgtcgttttgttttgctaggtaaagcatcttcagtagaaaaaactgaagataaagaaaaagtgtctcctcaaccacaagcccgtattactaaaactggtagactgactatttctaacgaaacaactacaggttttgatattttaattacgaatattaaagatgataacggtatcgctgctgttaaggtaccggtttggactgaacaaggagggcaagatgatattaaatggtatacagctgtaactactggggatggcaactacaaagtagctgtatcatttgctgaccataagaatgagaagggtctttataatattcatttatactaccaagaagctagtgggacacttgtaggtgtaacaggaactaaagtgacagtagctggaactaattcttctcaagaacctattgaaaatggtttagcaaagactggtgtttataatattatcggaagtactgaagtaaaaaatgaagctaaaatatcaagtcagacccaatttactttagaaaaaggtgacaaaataaattatgatcaagtattgacagcagatggttaccagtggatttcttacaaatcttatagtggtgttcgtcgctatattcctgtgaaaaagctaactacaagtagtgaaaaagcgaaagatgaggcgactaaaccgactagttatcccaacttacctaaaacaggtacctatacatttactaaaactgtagatgtgaaaagtcaacctaaagtatcaagtccagtggaatttaattttcaaaagggtgaaaaaatacattatgatcaagtgttagtagtagatggtcatcagtggatttcatacaagagttattccggtattcgtcgctatattgaaatt

SEQ ID NO: 9964 - protein, 544 aa, Streptococcus agalactiae
MMKKGQVNDTKQSYSLRKYKFGLASVILGSFIMVTSPVFADQTTSVQVNNQTGTSVDANNSSNETSASSVITSNNDSVQASDKVVNSQNTATKDITTPLVETKPMVEKTLPEQGNYVYSKETEVKNTPSKSAPVAFYAKKGDKVFYDQVFNKDNVKWISYKSFCGVRRYAAIESLDPSGGSETKAPTPVTNSGSNNQEKIATQGNYTFSHKVEVKNEAKVASPTQFTLDKGDRIFYDQILTIEGNQWLSYKSFNGVRRFVLLGKASSVEKTEDKEKVSPQPQARITKTGRLTISNETTTGFDILITNIKDDNGIAAVKVPVWTEQGGQDDIKWYTAVTTGDGNYKVAVSFADHKNEKGLYNIHLYYQEASGTLVGVTGTKVTVAGTNSSQEPIENGLAKTGVYNIIGSTEVKNEAKISSQTQFTLEKGDKINYDQVLTADGYQWISYKSYSGVRRYIPVKKLTTSSEKAKDEATKPTSYPNLPKTGTYTFTKTVDVKSQPKVSSPVEFNFQKGEKIHYDQVLVVDGHQWISYKSYSGIRRYIEI

SEQ ID NO: 9965 - DNA, 1242 bp, Streptococcus agalactiae
atgagtaaacgacaaaatttaggaattagtaaaaaaggagcaattatatcagggctctcagtggcactaattgtagtaataggtggctttttatgggtacaatctcaacctaataagagtgcagtaaaaactaactacaaagtttttaatgttagagaaggaagtgtttcgtcctcaactcttttgacaggaaaagctaaggctaatcaagaacagtatgtgtattttgatgctaataaaggtaatcgagcaactgtcacagttaaagtgggtgataaaatcacagctggtcagcagttagttcaatatgatacaacaactgcacaagcagcctacgacactgctaatcgtcaattaaataaagtagcgcgtcagattaataatctaaagacaacaggaagtcttccagctatggaatcaagtgatcaatcttcttcatcatcacaaggacaagggactcaatcgactagtggtgcgacgaatcgtctacagcaaaattatcaaagtcaagctaatgcttcatacaaccaacaacttcaagatttgaatgatgcttatgcagatgcacaggcagaagtaaataaagcacaaaaagcattgaatgatactgttattacaagtgacgtatcagggacagttgttgaagttaatagtgatattgatccagcttcaaaaactagtcaagtacttgtccatgtagcaactgaaggtaaactccaagtacaaggaacgatgagtgagtatgatttggctaatgttaaaaaagaccaggctgttaaaataaaatctaaggtctatcctgacaaggaatgggaaggtaaaatttcatatatctcaaattatccagaagcagaagcaaacaacaatgactctaataacggctctagtgctgtaaattataaatataaagtagatattactagccctctcgatgcattaaaacaaggttttaccgtatcagttgaagtagttaatggagataagcaccttattgtccctacaagttctgtgataaacaaagataataaacactttgtttgggtatacaatgattctaatcgtaaaatttccaaagttgaagtcaaaattggtaaagctgatgctaagacacaagaaattttatcaggtttgaaagcaggacaaatcgtggttactaatccaagtaaaaccttcaaggatgggcaaaaaattgataatattgaatcaatcgatcttaactctaataagaaatcagaggtgaaa

SEQ ID NO: 9966 - protein, 414 aa, Streptococcus agalactiae
MSKRQNLGISKKGAIISGLSVALIVVIGGFLWVQSQPNKSAVKTNYKVFNVREGSVSSSTLLTGKAKANQEQYVYFDANKGNRATVTVKVGDKITAGQQLVQYDTTTAQAAYDTANRQLNKVARQINNLKTTGSLPAMESSDQSSSSSQGQGTQSTSGATNRLQQNYQSQANASYNQQLQDLNDAYADAQAEVNKAQKALNDTVITSDVSGTVVEVNSDIDPASKTSQVLVHVATEGKLQVQGTMSEYDLANVKKDQAVKIKSKVYPDKEWEGKISYISNYPEAEANNNDSNNGSSAVNYKYKVDITSPLDALKQGFTVSVEVVNGDKHLIVPTSSVINKDNKHFVWVYNDSNRKISKVEVKIGKADAKTQEILSGLKAGQIVVTNPSKTFKDGQKIDNIESIDLNSNKKSEVK

SEQ ID NO: 9967 - DNA, 519 bp, Streptococcus agalactiae
atgaaaagaaaagaaattattgatgatgtgaccatgaaacgtgctattacacgtattacctacgaaattatagaacgtaacaaaaatttagataatattgtcttagcaggcattaaaacaagaggtgtttttttagccaaacgcattcaagaacgcttgaagcaattagaaaatttagatattcccgttggagaattggatactaaacctttccgtgatgatatgaaagttgaagttgacaccacaactatgccagttgacatcactgataaagatattatattaattgatgatgttctctatacaggtcgcactattcgagctgctattgataatcttgttagtttagggcgtccgagtcgtgtcagtttagctgtattaattgaccgtgggcatcgtgaactacctattcgtgcagattatgtggggaaaaatattccaacaagtcaatttgaagaaattctagttgaagtgatggaacatgatggttacgatcgtgtgagtattattgatccgagt

SEQ ID NO: 9968 - protein, 173 aa, Streptococcus agalactiae
MKRKEIIDDVTMKRAITRITYEIIERNKNLDNIVLAGIKTRGVFLAKRIQERLKQLENLDIPVGELDTKPFRDDMKVEVDTTTMPVDITDKDIILIDDVLYTGRTIRAAIDNLVSLGRPSRVSLAVLIDRGHRELPIRADYVGKNIPTSQFEEILVEVMEHDGYDRVSIIDPS

SEQ ID NO: 9969 - DNA, 888 bp, Streptococcus agalactiae
atggaaatcacaattaaaatagcaggagttaggctagataaagctttagcggataattctgaactgtcgcgtagtcaagctaatgaagaaattaaaaaagggattgtgttagtaaatggacaagtaaaaaaagcgaaatatactgttcaagaaggagatcggattacttttgatattcctaaagaggaagtactagattatcaagctgaaaatatccctttagatattatctatcaagatgatgacgttgctgtggttaataagccgcaagggatggttgttcacccttctgcaggccacagttcgggcaccttagttaacgccttgatgtatcatattaaggatttatcatcaattaatggcgttgttcgcccagggatcgttcatcgtattgataaagatacttctggtttattgatggttgcaaaaaatgatagagctcaccaagtgttggctgaagagttaaaagataaaaaatcgcttcgtaaatatttagcaattgtgcatggtaatttaccaaatgatcgaggtgtgattgaggctccgattggtagaagcgataaagatcgtaagaagcaagccgtgactgctaaaggtaagccagcaataactcgttttcatgttttagaacgttttggtgattataccttagttgaattgtcattggagacaggtcgaacacaccaaattcgggttcatatggcttatattggccatcctctagccggtgatcctgtctacggtccccgtaagactttagggggtaaaggacagtttttgcatgcacaaacactaggttttacgcaccctagtaacggagagaatttgattttttcagtagaggttccggaaatttttcagacaaccttagaaaagttgagaaaaaat

SEQ ID NO: 9970 - protein, 296 aa, Streptococcus agalactiae
MEITIKIAGVRLDKALADNSELSRSQANEEIKKGIVLVNGQVKKAKYTVQEGDRITFDIPKEEVLDYQAENIPLDIIYQDDDVAVVNKPQGMVVHPSAGHSSGTLVNALMYHIKDLSSINGVVRPGIVHRIDKDTSGLLMVAKNDRAHQVLAEELKDKKSLRKYLAIVHGNLPNDRGVIEAPIGRSDKDRKKQAVTAKGKPAITRFHVLERFGDYTLVELSLETGRTHQIRVHMAYIGHPLAGDPVYGPRKTLGGKGQFLHAQTLGFTHPSNGENLIFSVEVPEIFQTTLEKLRKN

SEQ ID NO: 9971 - DNA, 1152 bp, Streptococcus agalactiae
atgcgcttcatcaataagttaaaaaataatatggagcatgtactctccatttatccagatgtttcagtaaaaacagatcgtgatagaggacatgtatatctcaatggtacagattatcatgaagttgcagagtccttaaaagagatttttggtatccaagctttttctccatcttttaaagtagaaaaaaatgttgatacattggtaaaagctgtccaggaaattatgacttccgtttataaagatgggatgacttttaaaattaccgcaaaacgtagtgaccactcatttgaattggatagccgtgctctaaatcatactttaggagatgctgttttttcagtcttgccaaatattaaggctcagatgaagcaaccagatatcaatcttaaagtcgagatacgagatgaggctgcttatatttcatatgaggatattaggggtgcaggaggattaccagtaggaacatctggaaaagggatgctgatgttgtctggtgggattgattctccggtagcaggttacctagcgttaaaacgtggtgtagatatagaagcagtccattttgcaagtcctccttatactagcccaggtgcattgaaaaaagcacatgatttaacacgtaaattgacaaaatttggtggtaatattcaatttattgaagttccattcacagaaattcaagaggaaattaaggcaaaagctcccgaagcctacttgatgacgttaacacgtaggtttatgatgcgtattacagatcgtattcgtgaggaccgaaatggtcttgttattattaacggtgaaagtttaggacaggtggcaagccaaacgttagaaagtatgcaagctattaatgctgtcactgcaacaccgattattcgtcctgtggtcacgatggataagctagaaattattgatattgctcaaaaaatagatacttttgatatttcaattcaaccatttgaggattgctgtacgatttttgcaccagatcgcccaaaaactaaccctaaaattaagaatacagaacagtatgagaaacgtatggatgtagaaggtcttgtagagagggcagttgcagggattatggtaactactattcaacctcaagcagatagtgatgatgttgatgacttgattgacgatttatta

SEQ ID NO: 9972 - protein, 384 aa, Streptococcus agalactiae
MRFINKLKNNMEHVLSIYPDVSVKTDRDRGHVYLNGTDYHEVAESLKEIFGIQAFSPSFKVEKNVDTLVKAVQEIMTSVYKDGMTFKITAKRSDHSFELDSRALNHTLGDAVFSVLPNIKAQMKQPDINLKVEIRDEAAYISYEDIRGAGGLPVGTSGKGMLMLSGGIDSPVAGYLALKRGVDIEAVHFASPPYTSPGALKKAHDLTRKLTKFGGNIQFIEVPFTEIQEEIKAKAPEAYLMTLTRRFMMRITDRIREDRNGLVIINGESLGQVASQTLESMQAINAVTATPIIRPVVTMDKLEIIDIAQKIDTFDISIQPFEDCCTIFAPDRPKTNPKIKNTEQYEKRMDVEGLVERAVAGIMVTTIQPQADSDDVDDLIDDLL

SEQ ID NO: 9973 - DNA, 654 bp, Streptococcus agalactiae
atgcctcgcagtcttgaagaggctcaagaaatagatttatcaaaatttgatagtgttgatattattgaatggcgagctgatgccttaccaaaggatgacattattaatgtagctccagctatttttgagaaattcgcaggtcatgaaattatttttactcttcgtacaacgcgtgaaggtggtaatattgtcttatctgatgctgagtatgttgagttaatccagaaaattaattctatctacaatccagattatattgattttgagtatttttcacataaagaagtttttcaagaaatgctagaatttccaaatttagtcctgtcttatcacaattttcaagagacaccggagaatattatggagatattttcagaattaacagccctagcaccacgagttgtgaaaatcgcagtaatgccaaagaatgaacaagatgtcttagacgttatgaattacactcgcggtttcaagactattaatcctgatcaagtttatgcgacggtatctatgagtaaaattggacgtatttctcgttttgctggtgatgtaactggatctagttggacatttgcatatttagattcatctatcgcacccggacaaattactatttcagagatgaagcgtgtcaaagcattgcttgacgctgac

SEQ ID NO: 9974 - protein, 218 aa, Streptococcus agalactiae
MPRSLEEAQEIDLSKFDSVDIIEWRADALPKDDIINVAPAIFEKFAGHEIIFTLRTTREGGNIVLSDAEYVELIQKINSIYNPDYIDFEYFSHKEVFQEMLEFPNLVLSYHNFQETPENIMEIFSELTALAPRVVKIAVMPKNEQDVLDVMNYTRGFKTINPDQVYATVSMSKIGRISRFAGDVTGSSWTFAYLDSSIAPGQITISEMKRVKALLDAD

SEQ ID NO: 9975 - DNA, 792 bp, Streptococcus agalactiae
atgtctcacataaaagcagaaaacattatcgtatcttacgatcagaaagaaatcatcaataatctttccctcagtatacttaaccaaaaaataacaacgattattggtgccaatggatgtggaaagtctactcttttgaaggctctcacacgcatccataaaataaaagatggtactatcactattgatggtcatgatattgcacatttacccacaaaggaaattgctaagaagattgcacttctcccacaggtgttagaagcaactgaagggataacagtttatgaactaatatcttatggacggttcccacaccaaaaataccttggcaatttgacaaatgacgatcgcagtaaaatccattgggcgatggaaatgactaacgtagcgcaatttgctaatagagatgttgatgacctttcaggaggtcagaggcaaaaagtatggattgctatggctttagcacaagatacagatactatctttttagacgaacctacaacttatcttgacatgaatcatcaattagaagtcttagaattgctcaaaaaacttaatgacgaaacgcaaaaaacaattattatggtcctacacgacctaaacctgtctgcgcgctattctgattatctagttgcaatgaaaaccggtaaaattatctatgaaggtagtcctagtcagatcatgactaaagatattatcaaagatatttttaagattgatgctcatatcattcaggaccctattagtaaacaacctgttttgttatcttatcaattatcaactgatcaaaat

SEQ ID NO: 9976 - protein, 264 aa, Streptococcus agalactiae
MSHIKAENIIVSYDQKEIINNLSLSILNQKITTIIGANGCGKSTLLKALTRIHKIKDGTITIDGHDIAHLPTKEIAKKIALLPQVLEATEGITVYELISYGRFPHQKYLGNLTNDDRSKIHWAMEMTNVAQFANRDVDDLSGGQRQKVWIAMALAQDTDTIFLDEPTTYLDMNHQLEVLELLKKLNDETQKTIIMVLHDLNLSARYSDYLVAMKTGKIIYEGSPSQIMTKDIIKDIFKIDAHIIQDPISKQPVLLSYQLSTDQN

SEQ ID NO: 9977 - DNA, 582 bp, Streptococcus agalactiae
atgacaaatacacgtaaaatggtgacaatcgccattctttctgccttatcttttgtattgatgatggtttcatttccattaataccaggagcagaatttttaaaggttgatttttcaatccttccgatgttagttgcttttattttatttgatttgaaatcaagttatggtgtactcttattaagatcacttttaaaagttatacttgctaatcgtggtccagaaacgtttattggtttaccgatgaatatggttgctctagctttatttttagcaagtttcgctattttctggaaaaatagagagagtgcaaaagattttattaaagctagtctatttggtacagttagcttgaccgtatctatggtagctctcaactatgtctttgcgattcctttgtatgctatatttgctaactttgatatcagaacatttattggtgtaggcaattaccttttaacaatggttattccatttaatatcgttgagggaattttaatttcgattgttttctatctaacttacgtggcttgtttgccaatattagaaagatataaaaagactaatgttatctcgtcaaaa

SEQ ID NO: 9978 - protein, 194 aa, Streptococcus agalactiae
MTNTRKMVTIAILSALSFVLMMVSFPLIPGAEFLKVDFSILPMLVAFILFDLKSSYGVLLLRSLLKVILANRGPETFIGLPMNMVALALFLASFAIFWKNRESAKDFIKASLFGTVSLTVSMVALNYVFAIPLYAIFANFDIRTFIGVGNYLLTMVIPFNIVEGILISIVFYLTYVACLPILERYKKTNVISSK

SEQ ID NO: 9979 - DNA, 978 bp, Streptococcus agalactiae
ttgattgaaaattatttagaaaaagacatccttaatcaaataaaacttctaactttatgctatgattactacccttccattactctagacaaatcatgtcatcaacttggtttatctgaactacttattaggaaatattgtcatgatttaacaactttatttaacagtcaactctctctgaatatcgaaaagagtacaatagtctaccaatctaatggtgtaactagagaacaagctttcaaatatatttatcatcaatcacacgttttacaacttttaaaatttttgatcacgaatgattcaggcaggttacctttaacttactttagtgaaaaatttggactatcttgtgcaactgcttatcgcatacgaaaacatattagtccattactagaaaaacttggatttcagattgtcaaaaatactattaccggtgacgagtatcgaattcgctatttaatcgcatttttaaatgctcaatttggtatagaagtttatcccatgtctaagatggataaattgctcatcaaacgattgttattagaacactcaactacttttactgcttctcattacttcccaaatacatttattttctttgatacattgttgtctctatcatggaaacgtattaattataatgtagttgtcccttactcatcccttttcactgaactacaaaatatatttatctatgatacattacaatattgtgtcaaaaatgttattatagattcctttaaaattaatttaaaaaaagacgatatagactatatttttcttgcttaccttacttcccataactctttttctaatccaaattggactgagaagcgtatcgataatgtaatagctattttcgaaaattatcccaaattccaaaaattattacagccactcaaagatgctcttcccttatctggctcctatcatgatgagttggtaaaagttgctatctttttttccgaacatttattt

SEQ ID NO: 9980 - protein, 326 aa, Streptococcus agalactiae
MIENYLEKDILNQIKLLTLCYDYYPSITLDKSCHQLGLSELLIRKYCHDLTTLFNSQLSLNIEKSTIVYQSNGVTREQAFKYIYHQSHVLQLLKFLITNDSGRLPLTYFSEKFGLSCATAYRIRKHISPLLEKLGFQIVKNTITGDEYRIRYLIAFLNAQFGIEVYPMSKMDKLLIKRLLLEHSTTFTASHYFPNTFIFFDTLLSLSWKRINYNVVVPYSSLFTELQNIFIYDTLQYCVKNVIIDSFKINLKKDDIDYIFLAYLTSHNSFSNPNWTEKRIDNVIAIFENYPKFQKLLQPLKDALPLSGSYHDELVKVAIFFSEHLF

SEQ ID NO: 9981 - DNA, 924 bp, Streptococcus agalactiae
atggcaacatataatggtcaaggtttcatccacgatcagctagattcaattagaaatcaaacgttgagaccagactatgtcttaatgagggacgatggctctactgatgatactgtaaaggtggttgaagactatataaaagagcaccgtttagatggttggtcaataactagtaatgataaaaatttaggttggcgtttaaattttcgtcaattacttattgatgtgttagcctatgaggttgactatgtcttttttagtgatcaagatgacacatggtatcatcataaaaataagatgcaagttgatattatggaagaacgccaagatataaaccttcttagcgccgatattgatatcaaaaagttatcagaagaggctactattcccaataattttaagttcaatggtgaggaaacaatttctaagtatccattagacttttcatatcataactatcgtcaaggttggactttttgtttacgcaagtcgtttgttgatcaagtaatgactttttacagtgataatttaattttgtcacatgataatctttttgcaggggtatctggtgtcattggttcaggttacaatttaaacagaagtgttggtgaacataagcgacatgctgagaatgcaagtgggaatatcttgaatatgagctcaagttacgaaaggcatttacaagaactgtattttgttttgagttactatatcatccttgtaccatttttagaaaaaagtagctctagtcaattaagggaagctaaagcttatctggattttaatcagcaacgttataaaaatgctcaaaataaagattttgtagcaatacttaaacaaatgatgactaaaaaacggttctatgatagcttttcaaatcgcattcgtgacttggtgtttttattaaaagatataaaaaggagt

SEQ ID NO: 9982 - protein, 308 aa, Streptococcus agalactiae
MATYNGQGFIHDQLDSIRNQTLRPDYVLMRDDGSTDDTVKVVEDYIKEHRLDGWSITSNDKNLGWRLNFRQLLIDVLAYEVDYVFFSDQDDTWYHHKNKMQVDIMEERQDINLLSADIDIKKLSEEATIPNNFKFNGEETISKYPLDFSYHNYRQGWTFCLRKSFVDQVMTFYSDNLILSHDNLFAGVSGVIGSGYNLNRSVGEHKRHAENASGNILNMSSSYERHLQELYFVLSYYIILVPFLEKSSSSQLREAKAYLDFNQQRYKNAQNKDFVAILKQMMTKKRFYDSFSNRIRDLVFLLKDIKRS

SEQ ID NO: 9983 - DNA, 933 bp, Streptococcus agalactiae
atggtaaagacagcagttttaatggcgacatacaatggcgaaatatttatatctgaacaacttgattcaattcgccaacagacattaaaaccagattatgtattattgagggatgattgttcaacggatgaaacagtcaatgtcgtcaataactatatcgcaaaacatgagttagaaggctggaaaattgttaaaaacgacaaaaacttaggctggcgtttaaattttcgtcaattacttattgatgtgttagcctatgaggttgactatgtcttttttagtgatcaagatgatatttggtatcttgataaaaacgaacgacagtttgccattatgtcagataaacctcaaattgaggttttgagtgcagacgttgatatcaaaacgatgtctacagaagccagtgttccacattttctaactttttcttctagtgatagaatcagtcagtatcctaaagtatatgattatcaaacattccgtcccggatggaccattgctatgaagagagattttgcgcaagctatcgctgataattggacttttggagctaatatttcgcacgataatcttatcgagacaactgccagtattattggaaatggttataaccttaacgaaagcgtaggagttcatattcgatatggaggaaacgcaagtggtaatagcaaatttgttttgaattggaagtcgcctaaaacacaacatatcacaggattaaaaacatttgttgatttttacgaaaccatgcagaaggttgtcaacaaatatcaaaatgatgtcgctttaaatcaacgcttagcctttgaaaaagaaagattggaagcttctaaattgtcattaattcataatagtgcttttgtgattaaaaattggcgactctataactctaatagtggacgtatgagagatttattatttgcgtttaaaaag

SEQ ID NO: 9984 - protein, 311 aa, Streptococcus agalactiae
MVKTAVLMATYNGEIFISEQLDSIRQQTLKPDYVLLRDDCSTDETVNVVNNYIAKHELEGWKIVKNDKNLGWRLNFRQLLIDVLAYEVDYVFFSDQDDIWYLDKNERQFAIMSDKPQIEVLSADVDIKTMSTEASVPHFLTFSSSDRISQYPKVYDYQTFRPGWTIAMKRDFAQAIADNWTFGANISHDNLIETTASIIGNGYNLNESVGVHIRYGGNASGNSKFVLNWKSPKTQHITGLKTFVDFYETMQKVVNKYQNDVALNQRLAFEKERLEASKLSLIHNSAFVIKNWRLYNSNSGRMRDLLFAFKK

SEQ ID NO: 9985 - DNA, 1053 bp, Streptococcus agalactiae
atgattaaatttagtaataaaattgtacaagaagatttagcacttattagtaaccaaaattatattaattgggaaagaattgctaataaaggcgttttaataagtggttctaatagtatgttagcgagttatatggtatttttactagcctatctcaatgagacaagaaattaccaaacgcaaattattgcgacagctagaaacattgaaaaagcccgtgataaattttcagatttagttgggaaagattatttcaccttaattccttatgatgtagaagaacgcctagagtatgatggaaaagtggattacattatccatgcagcaagcaatgctagtccaactgctattttgagtaatcctgttagcatcataaaagctaatacaattggtacattgaatttattagactttgcaaaggaaaaaacaattgaaaacttcttgttcttatcaacgcgtgaagtatatggaacatctattaaagaagtgattgatgaagaagcttatggtggatttgatattttagctactagagcttgttacccagaaagcaaacgtatggctgaaactctactgcaaagttactatgatcaatataaggtaccctttactattgctcgtattgcacattcatttggtcctggtatggagcttggtaacgatggtcgtattatgaatgatcttttatcgaatgtcattgatggcaaagatatcgttttaaaaagtagtggtacagcagagcgtgctttctgttatttagcagatgctgtatcagggttatttactattttattaaatggtgaagttggtcaagcttacaatgtagcaaatgaagatcaacccattatgattaaggatttggcacaaaagttagttgatctcttttctgataaaaatatttcagtagtattcgatattcctaaaactatgagtgcaggttatagcaaaatggggagaacacgtctcactatggccaaattagaagcgttgggatggaagcgagaagtttctcttgaatctggaatattaaaaacagtacaagcatttgaggag

SEQ ID NO: 9986 - protein, 351 aa, Streptococcus agalactiae
MIKFSNKIVQEDLALISNQNYINWERIANKGVLISGSNSMLASYMVFLLAYLNETRNYQTQIIATARNIEKARDKFSDLVGKDYFTLIPYDVEERLEYDGKVDYIIHAASNASPTAILSNPVSIIKANTIGTLNLLDFAKEKTIENFLFLSTREVYGTSIKEVIDEEAYGGFDILATRACYPESKRMAETLLQSYYDQYKVPFTIARIAHSFGPGMELGNDGRIMNDLLSNVIDGKDIVLKSSGTAERAFCYLADAVSGLFTILLNGEVGQAYNVANEDQPIMIKDLAQKLVDLFSDKNISVVFDIPKTMSAGYSKMGRTRLTMAKLEALGWKREVSLESGILKTVQAFEE

SEQ ID NO: 9987 - DNA, 717 bp, Streptococcus agalactiae
atgaatattggagttatttttgcaggtggtgttggtcgtcgcatgaataccaaaggtaaaccaaagcaattcctagaagtgcatggtaaacccattattgtacacacaattgatattttccaaaatacagaagctattgatgctgtagtagttgtctgtgtatcagactggctagattatatgaataatctggtagagcgtttcaaccttacgaaagtaaaagcagttgttgcaggtggagaaactggccaaatgtcaatttttaaggggcttgaagccgctgaacagctggctacagatgatgccgttgttttaattcatgacggagtacgtccattgattaatgaagaagttattaatgctaatatacagtcagtaaaagaaacaggaagtgcggtaacttcagttcgtgctaaagagacagttgttctagtcaatgattcttctaaaatatctgaagttgttgatcgtactcgttccttcattgctaaagcgccacaaagtttttatctatcagatatcctttctgttgaacgtgatgccattagcaaagggattactgatgcaattgattctagtactttgatgggtatgtacaatcgtgaactcactattgttgagggaccatatgaaaatatcaagataacaacaccagatgatttttatatgtttaaagctttgtatgatgctagagaaaatgaacaaatttatgggatg

SEQ ID NO: 9988 - protein, 239 aa, Streptococcus agalactiae
MNIGVIFAGGVGRRMNTKGKPKQFLEVHGKPIIVHTIDIFQNTEAIDAVVVVCVSDWLDYMNNLVERFNLTKVKAVVAGGETGQMSIFKGLEAAEQLATDDAVVLIHDGVRPLINEEVINANIQSVKETGSAVTSVRAKETVVLVNDSSKISEVVDRTRSFIAKAPQSFYLSDILSVERDAISKGITDAIDSSTLMGMYNRELTIVEGPYENIKITTPDDFYMFKALYDARENEQIYGM

SEQ ID NO: 9989 - DNA, 777 bp, Streptococcus agalactiae
atgttagcttatattgataaagttgcgcgtgataataaaattgaatattctttaggcggaggcagcctactgggagcaatgagacataaaggattcattccatgggatgacgatattgatttgatgctagaaagaagccagtatgagcgtttgatgaaagcattagctgatgctaataatagcgattttaaattgctacatcattctgttgaaaaaaatctatggccatttgccaagctgtatcacacaaagtcaatgtacttaagtaaaacagatagaattcatccttggacagggatttttattgatatcttcccacttgaccgattaccagagagtgcagaagaacgtcaaagattctttaaaaaagttcactctgctgctgcaaatttgatgtgtacgacttaccccaattttgctagcggttcccgaaagctttatgcaaatgcaaggctaattttggggctaccccgattcatcgcttatcacggccaagctaaaaaacgtgctgaaattgttgatcaagtgatggaaacatataataatcaagaggttccttacatgggttataccgattcaagatatcgcttgaaagaatattttccaagagaaattttttctgagtatgaagatgttatgtttgaaaacattaaaacccgaaaaattaaaaatgagcatgcttatctgaatcaattatatgggggtagttatatggaattacctccagaaagtaagagagaaagtcatagttattacacttggtactggaaagaaggt

SEQ ID NO: 9990 - protein, 259 aa, Streptococcus agalactiae
MLAYIDKVARDNKIEYSLGGGSLLGAMRHKGFIPWDDDIDLMLERSQYERLMKALADANNSDFKLLHHSVEKNLWPFAKLYHTKSMYLSKTDRIHPWTGIFIDIFPLDRLPESAEERQRFFKKVHSAAANLMCTTYPNFASGSRKLYANARLILGLPRFIAYHGQAKKRAEIVDQVMETYNNQEVPYMGYTDSRYRLKEYFPREIFSEYEDVMFENIKTRKIKNEHAYLNQLYGGSYMELPPESKRESHSYYTWYWKEG

SEQ ID NO: 9991 - DNA, 726 bp, Streptococcus agalactiae
atgaaaaaaattttactagtgatacctgcttataatgaagaaggtagtattgcaaagacagtccagactattgtagattttaaggcgtctcgctcactaccttttgagctggattatattgttattaacgatgggtcaaccgatggtactccagagttattagatagattgggtttaaatcatattgaccttgttcaaaatctaggtattggtggctgtgtgcagacaggatacttatacgctaatcgtaatcattacgatgttgccgttcaatttgatggtgatggtcaacatgatattagaagcattgaagatgttgttatgccaatcttaaatgacgaagcagattttgttattggttctcgctttgttgataaaaaacatcaaaattttcaatcgacagcaatgaggcgtcttggcataaatttaatatctgctgctataaaattaacgacgggacacaaagtctatgatacaacaagtggttatagggcagccaacgcggcgctaatagcttatttatcgtgtcattatccagtacaatacccagagcctgaatcaactgctcggattttgaaaaaaggctatcgtttgaaggaagtcacagctaatatgtttgaacgtgaggcaggtacttcaagtataagttccctaaaatcgattttttatatgacggatgttttaacatcaattattattgcagggtttattaaggaggatgataaa

SEQ ID NO: 9992 - protein, 242 aa, Streptococcus agalactiae
MKKILLVIPAYNEEGSIAKTVQTIVDFKASRSLPFELDYIVINDGSTDGTPELLDRLGLNHIDLVQNLGIGGCVQTGYLYANRNHYDVAVQFDGDGQHDIRSIEDVVMPILNDEADFVIGSRFVDKKHQNFQSTAMRRLGINLISAAIKLTTGHKVYDTTSGYRAANAALIAYLSCHYPVQYPEPESTARILKKGYRLKEVTANMFEREAGTSSISSLKSIFYMTDVLTSIIIAGFIKEDDK

SEQ ID NO: 9993 - DNA, 1152 bp, Streptococcus agalactiae
atgcaagatgttttcattataggaagtagagggttgccagctcgttacggtggttttgaaacttttgtttcagaattgattaatcatcaaaaaagtttcgacataaaataccatgttgcatgccttagtgataaagaacatcatactcattttaactttgctgacgctgattgttttactataaatcctccccaattagggccagcacgtgtgattgcttatgatattatggccattaattatgcccttgacttggttaagacacatgatttaaaagagcctattttttatattttaggaaatacaattggtgcctttatttggcattttgccaataaaatacataaagtcggtggcttattgtatgttaatccggatggtttagagtggaagcgatcaaagtggtctcgtcccacacagcgttatttaaaatacgccgaaaaatgtatgactaaaaatgcagacctaattatttctgataatattggtattgaaaattacattcaatctacctactctaatgtgaagacaaggttcattgcttacggtacagagattaattctaggaaattatcgtcagatgatccacgtgtcaaacagttgtttaaaaaatggaatattaagtctaagggttactatctaatcgttggtcgatttgtccctgaaaacaattatgaaacggctattagggagttcatggcttcagatactaagcgtgatttagttattatctgtaaccatcaaaataacccctactttgaaaagttgtccttaaagacaaaccttcaacaagataaaagagttaagtttgtaggtacgctctatgaaaaagatctgctggattatgttcgtcaacaagcctttgcttatattcatgggcatgaagttggcggtactaatccaggactgcttgaggctttagctaatactgatttgaatcttgttctagatgttgatttcaacaaatcagtagcaggtctctcaagtttttactgggctaaaaaagagggggatttagctaagcttattaacgatagtgatcaacaacaggatttatctacttacggtgatcgagcaaaagccattattcaagaaaactatacttggaaaaaaattgttgaagaatatgaggatttgtttttaaatgaaagt

SEQ ID NO: 9994 - protein, 384 aa, Streptococcus agalactiae
MQDVFIIGSRGLPARYGGFETFVSELINHQKSFDIKYHVACLSDKEHHTHFNFADADCFTINPPQLGPARVIAYDIMAINYALDLVKTHDLKEPIFYILGNTIGAFIWHFANKIHKVGGLLYVNPDGLEWKRSKWSRPTQRYLKYAEKCMTKNADLIISDNIGIENYIQSTYSNVKTRFIAYGTEINSRKLSSDDPRVKQLFKKWNIKSKGYYLIVGRFVPENNYETAIREFMASDTKRDLVIICNHQNNPYFEKLSLKTNLQQDKRVKFVGTLYEKDLLDYVRQQAFAYIHGHEVGGTNPGLLEALANTDLNLVLDVDFNKSVAGLSSFYWAKKEGDLAKLINDSDQQQDLSTYGDRAKAIIQENYTWKKIVEEYEDLFLNES

SEQ ID NO: 9995 - DNA, 375 bp, Streptococcus agalactiae
atgattaaagaactaaaagaatttttatttaagggtaatgttttagaccttgctgttgctgttattttaggtgcagcttttaatgctatcatcacttcacttgttaaagacgttattacaccgcttatccttaatcctgtattaaaagctgctggcgtttcaaatatcgcacagctttcatggaatggtgttgcttacggtaatttcttaagtgcagttattaatttcttaatcgttggtactactttattcttcatcgttaaagctgctaacaaggttatggctaagaaacctgctgaagaagaaattattgaagttgttgaaccaacacaagagcaattacttgctgaaatccgcgacttactcgctaacaaa

SEQ ID NO: 9996 - protein, 125 aa, Streptococcus agalactiae
MIKELKEFLFKGNVLDLAVAVILGAAFNAIITSLVKDVITPLILNPVLKAAGVSNIAQLSWNGVAYGNFLSAVINFLIVGTTLFFIVKAANKVMAKKPAEEEIIEVVEPTQEQLLAEIRDLLANK

SEQ ID NO: 9997 - DNA, 1017 bp, Streptococcus agalactiae
gtgtttttactattatgtattttatcgatgtggctcatgatttttggggttgcattctattactttgggtcgctacatcaatcattgacttcaaggattatttatcagtttgtacttactgttttgctaacgacaacagcttggttcatgggtgcctattttttagcatttgaaggtcattttaaaactgtctttcaattccaagaagcagatggtaaacaaattgtaaattgtttatttcaactttgtttcgccctttacgcagtagtaatgcttattgggtcaattattgatagagttcagacgaagcgacttttattagctgttgtttcttggcttttcttggtgtatacgcccttagcttatttaatttggaattcagagggtgtttttgcaaagatgggagtacttgatttttcaggcggaatgatcgttcatttatctgcagggctttcttcgtatattttagctcatgttattggcaagagtgaacatcagcacaataaggttaaaaatgatagtctctttttaggaatgatacttattacatttggttggtttggatttaatatgggtccagttggtgagtggaattcacaagccattatgatacttttaaatactatatttgctattataggtggtggtttggcgtggacattggctgctaagtggaatggtgaggaagagaaaacaggaagcttattgaatggcattattgttggtcttgtgacgagtacagcaggagttgggtatctcttaacttggcaattattagctgtaacattctttgcatccctcttcacctactttgtaacggattacgttgcgaaagcttttgccattgatgatgtcgtttcctcctttggaatgaatggtattgggggattgttgggaagtttaggagttggtctctttaaattatcacatatgccagttcaactgttagcattagctaccacaattcttttgtcaattataatgacctatatcatatctaaagcgatttttagaaaa

SEQ ID NO: 9998 - protein, 339 aa, Streptococcus agalactiae
MFLLLCILSMWLMIFGVAFYYFGSLHQSLTSRIIYQFVLTVLLTTTAWFMGAYFLAFEGHFKTVFQFQEADGKQIVNCLFQLCFALYAVVMLIGSIIDRVQTKRLLLAVVSWLFLVYTPLAYLIWNSEGVFAKMGVLDFSGGMIVHLSAGLSSYILAHVIGKSEHQHNKVKNDSLFLGMILITFGWFGFNMGPVGEWNSQAIMILLNTIFAIIGGGLAWTLAAKWNGEEEKTGSLLNGIIVGLVTSTAGVGYLLTWQLLAVTFFASLFTYFVTDYVAKAFAIDDVVSSFGMNGIGGLLGSLGVGLFKLSHMPVQLLALATTILLSIIMTYIISKAIFRK

SEQ ID NO: 9999 - DNA, 1245 bp, Streptococcus agalactiae
atggaaaaaaatacttggaaaaaattacttgttagtactgctgctctttcagtagttgcaggaggagcaattgctgctactcactctaactcagttgatgctgcttcaaaaacaactatcaaactttgggtcccaacagattcaaaagcgtcttataaagcaattgttaaaaaattcgagaaggaaaacaaaggcgttactgtaaaaatgattgagtctaatgactccaaagctcaagaaaacgtaaaaaaagacccaagcaaggcagccgatgtattctcacttccacatgaccaacttggtcaattagtagaatctggtgttatccaagaaattccagagcaatactcaaaagaaattgctaaaaacgacactaaacaatcacttactggtgcacaatataaagggaaaacttatgcattcccatttggtattgaatctcaagttctttattataataaaacaaagttaactgctgacgacgttaaatcatacgaaacaattacaagcaaagggaaattcggtcaacagcttaaagcagctaactcatatgtaacaggtcctcttttcctttctgtaggcgacactttatttggtaaatctggtgaagatgctaaaggcactaactggggtaatgaagcaggtgtttctgtccttaaatggattgcagatcaaaagaaaaatgatggttttgtcaacttgacagctgaaaatacaatgtctaaatttggcgatggttctgttcatgcttttgaaagtggaccatgggattacgacgctgctaaaaaagctgtcggtgaagataaaatcggtgttgctgtttacccaacaatgaaaatcggtgacaaagaagttcaacaaaaagcattcttgggcgttaaactttatgccgttaaccaagcacctgctggttcaaacactaaacgaatctcagctagctacaaactcgctgcatatctaactaatgctgaaagtcaaaaaattcaattcgaaaaacgtcatatcgttcctgctaactcatcaattcaatcttctgatagcgtccaaaaagatgaacttgcaaaagcagttatcgaaatgggtagctcagataaatatacaacggttatgcctaagttgagtcaaatgtcaaccttctggacagaaagtgctgctattcttagcgatacttacagtggtaaaatcaaatctagcgattaccttaaacgtctaaaacaattcgataaagacatcgctaaaacaaaa

SEQ ID NO: 10000 - protein, 415 aa, Streptococcus agalactiae
MEKNTWKKLLVSTAALSVVAGGAIAATHSNSVDAASKTTIKLWVPTDSKASYKAIVKKFEKENKGVTVKMIESNDSKAQENVKKDPSKAADVFSLPHDQLGQLVESGVIQEIPEQYSKEIAKNDTKQSLTGAQYKGKTYAFPFGIESQVLYYNKTKLTADDVKSYETITSKGKFGQQLKAANSYVTGPLFLSVGDTLFGKSGEDAKGTNWGNEAGVSVLKWIADQKKNDGFVNLTAENTMSKFGDGSVHAFESGPWDYDAAKKAVGEDKIGVAVYPTMKIGDKEVQQKAFLGVKLYAVNQAPAGSNTKRISASYKLAAYLTNAESQKIQFEKRHIVPANSSIQSSDSVQKDELAKAVIEMGSSDKYTTVMPKLSQMSTFWTESAAILSDTYSGKIKSSDYLKRLKQFDKDIAKTK

SEQ ID NO: 10001 - DNA, 1482 bp, Streptococcus agalactiae
atggaatggctctttattaaaccagatcaaatttctgactttgtaactacagaaaataattatcttacatcgtcaaagttattgcaaaaactacctcgaaaaatatctgctcttttgttgacagagcaaacttatggaccagagttatctagtttatcgtcattctttgaggtttatgaagtattttatcctaaagataaacatgctacggggataacagaagagtttttacgctcgaaaatggcccaacgatatgatagtagctctccagatcagctaattcgtcaattttataaagggctttttataggacaatacggagagaaacttcaagtttcacaaatacaaattagaaatgattttgaaggtgtagtaaactatcagggaaataactatcttgaattagaagggcaatttggtgagaactatagttttttgcttaattttgcttacaatattccattttcatcggatttttataatgagttatttttagaacacattatagagggtgatatagatattcgattggttatctcgttgattgttgatggttctgttgatgatattgctaaagagtggtactttgagaaggaagacctaaatcaacttatttctttagagtccgatattagtggtagccttgcagttaaactttttgctaagggaaagggtatcgttaagttaggtccattgcaccgtcgtaatggtagaggaggattgggcacatttctactaggaggagaacgtcacatagatgctataggtcatgaatttatgacttattttgatccagtagatttcaaaccacctctaactgtttatttttcgggatttcgttcagctgaaggctttgagggattctggatgatgaagagtatgaagactccattcatgttaatttgtgatccacgattacaaggtggtgccttttatataggaagcaaagaatatgaacaaaaaatagttgatgctattcaagaaaaactggcctttttaaattttagttctgatcagttaattttatccggactttcaatggggacttatggtgctacttaccatggtgctaagctaaatcctcatgctattattattggtaaaccaatatttaatttaggaacagttgctcaacgtgaaagattagagagaccagatggatttgctacttcattagatattcaactactcaatcaaggtgacttgaccagttcctcttctgagaagttaaataactatttttggaaatctatagaagaaggagatttttcaaatacgacttttgccttagcctatatgaaaaacgatgactatgatgcgactgccttttctgatttattgcaatattttagaggaaagaagcataagatattaggcagaggttgggatggccgacatggtgattgttctgcagaagttggtgcatggtttacaagtcagtataggcgaatgctatctaatgattttggaaggaaagaagaa

SEQ ID NO: 10002 - protein, 494 aa, Streptococcus agalactiae
MEWLFIKPDQISDFVTTENNYLTSSKLLQKLPRKISALLLTEQTYGPELSSLSSFFEVYEVFYPKDKHATGITEEFLRSKMAQRYDSSSPDQLIRQFYKGLFIGQYGEKLQVSQIQIRNDFEGVVNYQGNNYLELEGQFGENYSFLLNFAYNIPFSSDFYNELFLEHIIEGDIDIRLVISLIVDGSVDDIAKEWYFEKEDLNQLISLESDISGSLAVKLFAKGKGIVKLGPLHRRNGRGGLGTFLLGGERHIDAIGHEFMTYFDPVDFKPPLTVYFSGFRSAEGFEGFWMMKSMKTPFMLICDPRLQGGAFYIGSKEYEQKIVDAIQEKLAFLNFSSDQLILSGLSMGTYGATYHGAKLNPHAIIIGKPIFNLGTVAQRERLERPDGFATSLDIQLLNQGDLTSSSSEKLNNYFWKSIEEGDFSNTTFALAYMKNDDYDATAFSDLLQYFRGKKHKILGRGWDGRHGDCSAEVGAWFTSQYRRMLSNDFGRKEE

SEQ ID NO: 10003 - DNA, 1005 bp, Streptococcus agalactiae
atgcgagtacatattacaagtatatatgggcagtcaccgcgtagcattgcccttatatcacaaaaactagttaaggatgtcggacgtcaacttggttatgatgaaatgggaatctacttttataatgatcatgctgaaacgcatggtgaaagaagtactaggatggatggtatcattgcgggattaggcagaggggatattgttgtttttcaagtacctacatggaattcaacagaatttgatgaactttttctagataaattacaggcatacggtgctagaattataacttttgtacatgatattgttcccttaatgtttgagtctaatttttatttattagatagagtaattgacatgtataatcgttcggatgttgttattctacctacaaaagcgatgcatgattatctaattgaaaaagggatgactacctctaaagttctttatcaagaagtatgggatcatccagttaatatagacctccctcgtccagaatgtcaaaaagtccttagttttgcaggcgatattcaacgctttccctttgtcaatgactggaaggaaaatatcccgctcatctattatggagacggaagcagactcaattctgaggcaaatgttcatgctcagggatggaaagatgatgtagaattgatgctaagtctttctaagcggggaggatttggcctgtgttggagtgaagatagagaggagttagtcgagcgtcgttattcgaggatgaatgcctcgtataaattatctactttcttggctgctggacttccaattattgctaaccatgatatttcaagtagagactttatcaaacaacacggattaggatttacagttgaaacgctagaagaagctgttgaaaaaattaataatatggaaaaagagacttatgacagctatgtggaaaatgttgagaagatagcaactctcttgcgaaatggttatatcactaaaaaattgttgatagatgctgtgcatatgctttataga

SEQ ID NO: 10004 - protein, 335 aa, Streptococcus agalactiae
MRVHITSIYGQSPRSIALISQKLVKDVGRQLGYDEMGIYFYNDHAETHGERSTRMDGIIAGLGRGDIVVFQVPTWNSTEFDELFLDKLQAYGARIITFVHDIVPLMFESNFYLLDRVIDMYNRSDVVILPTKAMHDYLIEKGMTTSKVLYQEVWDHPVNIDLPRPECQKVLSFAGDIQRFPFVNDWKENIPLIYYGDGSRLNSEANVHAQGWKDDVELMLSLSKRGGFGLCWSEDREELVERRYSRMNASYKLSTFLAAGLPIIANHDISSRDFIKQHGLGFTVETLEEAVEKINNMEKETYDSYVENVEKIATLLRNGYITKKLLIDAVHMLYR

SEQ ID NO: 10005 - DNA, 618 bp, Streptococcus agalactiae
atgatagaaaattttttagaaaaaaatattcttaataaagttaaattacttactttatgttatgataccccctcactatccttagataccgcctgtaaccgactccacttatcaccagttgagcttaaaaactattgtcataaattaaatgttttatttggtcataaactttctatccatatccaaaaaaaacggattttatgtaagctaaataaacttactcaggaagatgccttaaaaatagtttataatgagtcaaacactttacaacttcttaaatttttaattgatgactcgtctgataaaaaatctctagtagcttttggaaatgatctcttcttatctcgttcttctgtctatcgtctgcgagaaaatttaattcctttaattaaagatttaggattatctttatctaaaaataccattgtaggtgacgaatatcgcattagatatctcatcgcatacctcactactaaatttggtattaaaatttacgatctgtctgctctagatattaagattattcgacaatttttatttgagagtggtactaatataagacctactacgcacctttctgatatctttgttttttttgatacgcttttcattttaacc

SEQ ID NO: 10006 - protein, 206 aa, Streptococcus agalactiae
MIENFLEKNILNKVKLLTLCYDTPSLSLDTACNRLHLSPVELKNYCHKLNVLFGHKLSIHIQKKRILCKLNKLTQEDALKIVYNESNTLQLLKFLIDDSSDKKSLVAFGNDLFLSRSSVYRLRENLIPLIKDLGLSLSKNTIVGDEYRIRYLIAYLTTKFGIKIYDLSALDIKIIRQFLFESGTNIRPTTHLSDIFVFFDTLFILT

SEQ ID NO: 10007 - DNA, 840 bp, Streptococcus agalactiae
atggaaacatatactttatcgaatactcttaacattcctaaaattggttttgggacatggcaactaactgaaggtgaagaagcttataaggcagtgactcatgctttaaaagttggttatactcatattgatactgctcagatttatggtaatgaacatagtgttggacgtgctataagagacagtggtttggcaagagaaagtatctttttgacaactaagatttggaatgacaaacatgactatcatttagccaaagcttctattgatgaatctctgcagaaattaggtgttgattatattgatcttcttttgattcattggccaaatccaaaagctcttcgtgaaaatgatgcgtggaaagctgggaatgcaggcacttggaaagcgatggaagaagcttataaagaaggaaaggtaaaagctattggtgtttcgaatttcatgaaacatcacttagaggctttatttgaaactgccgaaataaaacctatggttaatcaaattatcctagcaccaggttgtgctcaagaggatttggttcgcttctgtaaaggaaatgatatcttattagaagcttacagtccatttggaacaggtgctatttttgaaaatgaatctataaaagctattgctgaaaaatatggtaaatcagttgcgcaagtagctcttcgctggtcacttgataatggctttttaccattacctaagtcagcgactcccaaaaatattgaagcaaaccttgatatttttgattttcaattaaacgaagatgatattgctaccttaatacaactagattcaggtattaaacccaaagatccagataatgtctcattt

SEQ ID NO: 10008 - protein, 280 aa, Streptococcus agalactiae
METYTLSNTLNIPKIGFGTWQLTEGEEAYKAVTHALKVGYTHIDTAQIYGNEHSVGRAIRDSGLARESIFLTTKIWNDKHDYHLAKASIDESLQKLGVDYIDLLLIHWPNPKALRENDAWKAGNAGTWKAMEEAYKEGKVKAIGVSNFMKHHLEALFETAEIKPMVNQIILAPGCAQEDLVRFCKGNDILLEAYSPFGTGAIFENESIKAIAEKYGKSVAQVALRWSLDNGFLPLPKSATPKNIEANLDIFDFQLNEDDIATLIQLDSGIKPKDPDNVSF

SEQ ID NO: 10009 - DNA, 672 bp, Streptococcus agalactiae
atgacaaaagaagatatcaaaaaacaagttcgaagagcttttgattttcgtatggcgattcgtgtttataataataatgatattcctaaagaagatatggagtatattttagatactgcttggttgagtccttcttcagtcggtttagaaggctggcgatttttggtactagatagacaaacaattgcaaaatttcgagataaacttaaggaagttgcttggggagcacaatatcaactagatactgctagtcactttgttttactactagctgaaaaaggtgcttattataacgctgatagcatgattaacagtctcattcgacgtggtctaggtgatccagctgcccttgagagtaggatacctctctacaaatccttccaagaaaacgatatgaaaattgattctgaacgttctctttgggattggacagcaaaacaaacttatatcgcactcggtaatatgatgacggctgctgctatgatcggcgtagattcatgcccaattgaaggatttgactatgaaaaggtcaataatatccttagtaaagaaggattaatagacgataagaaagaagctatttcttgtatggtttcatttggttatcgtttgcgtgaacctaaacattcccgtgctaggaaagaacgccaagaagtcattacttgggttgag

SEQ ID NO: 10010 - protein, 224 aa, Streptococcus agalactiae
MTKEDIKKQVRRAFDFRMAIRVYNNNDIPKEDMEYILDTAWLSPSSVGLEGWRFLVLDRQTIAKFRDKLKEVAWGAQYQLDTASHFVLLLAEKGAYYNADSMINSLIRRGLGDPAALESRIPLYKSFQENDMKIDSERSLWDWTAKQTYIALGNMMTAAAMIGVDSCPIEGFDYEKVNNILSKEGLIDDKKEAISCMVSFGYRLREPKHSRARKERQEVITWVE

SEQ ID NO: 10011 - DNA, 1644 bp, Streptococcus agalactiae
atgacaagtaaagcattaatatggtctatattacagattgatagtgctagagcttataatagttttttatattaccttcagaaaatcccctggttgggaagaaaaatccctaaccgatggtttaaaaccgatgatataaaaggtgtagtactatttattcgtatcattttctttttcttaagaggttttggtcgttccataggttacgtactatattgttatgttttatcattttttgttagaagtggcatgaagcagttaaatattttaccgcaagaaggttttaccctaactttaacattgatggtgattacctctcttttaattgtcataaatttctatataaaacttatagaacctaatgatatgcaacaaactcatatgattcgccttttcagaattgagccatcgaggtatttccaatccgctgaacttttagaagccagtagtgaactattttttagaagtttgagctttggcatatttttccatttaaatcactttgctttttggcatggtttgacttttgctttatttttagcaggtagtcgccttggaatcaaggtgctctgtttacctttatatggtagaggtaaagaccaagagaatccagagtctttactaaatattttattttacttagggattggtataggagtcttcctttctctctttttccttcttcttggcaaacagttctctccatatccatttttttcatggtacaccggtattgcaggacttatcatatggttagttagttactatcgattaaaaacttattctaaacttaaccacttgacctaccttaccctaacgcatgagacgatgaaggagaaaattgcaaagattgataatatagagctgcttgggattgaaatgaaagatagggatataaatgtcagtgaactttctcccctgctatttgaaaatttatcaggtatttcatatttaaacgctatctttttaaaacggatgagtatatacttgcaaaggaaaattttggtacgtttagctgttttaagtgttctgtttggaatagaactccttttcctgctattttttaaagaaaagataaatattccgatgaatgagcatagtttttcaaaattcctatttttgagtgcagttccaggatatctaatatatatcggtgaatcctattcaaaattttgtttctatcatttggatcgtccattattaagatataatttctatcgtgaaagagaaaatatcttagcaaccttaaaaatacgtttcctttatagtataaaacttaatttccccatttttgtagctttaaacatatgttttggaacctattattttaattttttcacccctaagattgatcagattatcatattagtaattacacaagctatatcaatgattttatttagtttttactttttgtatctttatttcttcttacagccttttacagaaggattaaaatcaaagagtgctatgtataatattttaacctttattatatactatatgggatataagctatttacctttactaaatctataacgatgccaatattattagtaagcctaggaattatagttgttattttaattattggctatttagcagttgtagtatttgctccaaaaactttccgtttaaaaagt

SEQ ID NO: 10012 - protein, 548 aa, Streptococcus agalactiae
MTSKALIWSILQIDSARAYNSFLYYLQKIPWLGRKIPNRWFKTDDIKGVVLFIRIIFFFLRGFGRSIGYVLYCYVLSFFVRSGMKQLNILPQEGFTLTLTLMVITSLLIVINFYIKLIEPNDMQQTHMIRLFRIEPSRYFQSAELLEASSELFFRSLSFGIFFHLNHFAFWHGLTFALFLAGSRLGIKVLCLPLYGRGKDQENPESLLNILFYLGIGIGVFLSLFFLLLGKQFSPYPFFSWYTGIAGLIIWLVSYYRLKTYSKLNHLTYLTLTHETMKEKIAKIDNIELLGIEMKDRDINVSELSPLLFENLSGISYLNAIFLKRMSIYLQRKILVRLAVLSVLFGIELLFLLFFKEKINIPMNEHSFSKFLFLSAVPGYLIYIGESYSKFCFYHLDRPLLRYNFYRERENILATLKIRFLYSIKLNFPIFVALNICFGTYYFNFFTPKIDQIIILVITQAISMILFSFYFLYLYFFLQPFTEGLKSKSAMYNILTFIIYYMGYKLFTFTKSITMPILLVSLGIIVVILIIGYLAVVVFAPKTFRLKS

SEQ ID NO: 10013 - DNA, 597 bp, Streptococcus agalactiae
gtgtcaatgcttatgacaaaaataataggactgacaggagggatagcttctggaaagtcaacggtaacaaaaataatacgagaatcaggttttaaagtcatagatgcggatcaagtggttcataaattgcaagctaagggtgggaaactttaccaagctttattagaatggttgggtcccgagatacttgatgctgatggtgagttggatagaccaaagctttctcaaatgatttttgctaatccagacaatatgaagacatcagctaggctacaaaatagtatcattcgtcaagagttagcatgtcagcgcgaccaattaaaacaaacagaagagatatttttcatggatattcctttattgattgaagaaaagtatataaaatggtttgatgagatttggttggtatttgttgataaagaaaaacaattacaacgattaatggcccgtaacaactacagtcgagaagaagcagaattacgactttcacaccaaatgcctttaacagataaaaaaagtttcgctagtcttattattgacaataatggtgatttaataactttaaaagagcaaatattggatgctcttcaacgttta

SEQ ID NO: 10014 - protein, 199 aa, Streptococcus agalactiae
MSMLMTKIIGLTGGIASGKSTVTKIIRESGFKVIDADQVVHKLQAKGGKLYQALLEWLGPEILDADGELDRPKLSQMIFANPDNMKTSARLQNSIIRQELACQRDQLKQTEEIFFMDIPLLIEEKYIKWFDEIWLVFVDKEKQLQRLMARNNYSREEAELRLSHQMPLTDKKSFASLIIDNNGDLITLKEQILDALQRL

SEQ ID NO: 10015 - DNA, 846 bp, Streptococcus agalactiae
atggaaaaagaattaggaaaaacactaagaagattacgtaaaggaaaaaaagttagtatttcttctttagcagatgagcacctatccaagtcacaaatctcaaggtttgagagaggagagtcagaaattacttgtagtcgtttgcttaatattttagacaaactcaacatcactattgatgaatttgtgtcgattcattctaaggcgcacactcatttttttatccttttaaatcgagtaagaaaatattgtgctgaaaaaaatgtaactaaattagtggctctcttagaggatcataaccataaagactatgaaaagattatgattaaggctcttattttttcaattgatcaatcaatagagcctaatcaagaagaattagcacgcttaacagactatctttttacggtggagcagtggggatattatgaaattattctcttaggaaattgctcacgtctcattaattacaatactttatttttattgaccaaagaaatggttaattcgtttgcttattcagaacaaaataaaaccaataaaatcctagttacacaattagcaattaattgtctaatcatcagcattgatcactcttactttgagcatagccactacttaattgataaggttagatcattgttacaggatgaagttaatttctatgaaaaaactgttttcttatatgtaactggatactatcatttaaaacttggtgatacttcttcaggaaaagaagatatgaggaaagctttacagatttttaaatatttaggtgaagattcattttacaatacttataatgaacattattgtcaaaaagtacttggcaataataaagaatgc

SEQ ID NO: 10016 - protein, 282 aa, Streptococcus agalactiae
MEKELGKTLRRLRKGKKVSISSLADEHLSKSQISRFERGESEITCSRLLNILDKLNITIDEFVSIHSKAHTHFFILLNRVRKYCAEKNVTKLVALLEDHNHKDYEKIMIKALIFSIDQSIEPNQEELARLTDYLFTVEQWGYYEIILLGNCSRLINYNTLFLLTKEMVNSFAYSEQNKTNKILVTQLAINCLIISIDHSYFEHSHYLIDKVRSLLQDEVNFYEKTVFLYVTGYYHLKLGDTSSGKEDMRKALQIFKYLGEDSFYNTYNEHYCQKVLGNNKEC

SEQ ID NO: 10017 - DNA, 897 bp, Streptococcus agalactiae
atgacatttaagtcaggatttgtagcaattttaggtcgtccaaatgttggaaaatcaaccttcctaaaccatgttatgggacaaaaaattgctatcatgagtgataaagctcaaacaacacgtaataaaattatggggatttatacaacagaaactgagcaaattgttttcattgataccccaggaattcataaaccaaagaccgcccttggtgattttatggttgaatctgcttatagtactttacgtgaagttgaaacagttcttttcatggttcctgccgatgaaaagcgaggcaaaggcgatgatatgattattgaacgtcttaaggctgccaagattcctgttattttagtaatcaacaaaattgataaggttcatccagaccaacttttggaacagattgatgacttccgtagtcaaatggattttaaagaagtagtgccaatttctgcccttcaaggaaataatgtgccaaccctaatcaagttattgactgataatcttgaagaaggtttccaatatttcccagaagatcagattactgatcatccggaacgatttttagtatcagaaatggttcgtgagaaggtacttcatttaacgcaacaagaggttcctcactcagtagctgttgttgtcgaatccatgaaacgtgatgaagaaactgataaagtgcatattcgtgcaactatcatggttgaacgtgatagtcaaaaaggcattatcattggaaaacaaggtgctatgctcaagaaaataggaaaaatggcgcgccgtgatattgaacttatgttaggtgataaagtttacctagagacttgggtaaaagtcaagaaaaactggcgtgataaaaagcttgatttagctgattttggctataatgaaaaagagtat

SEQ ID NO: 10018 - protein, 299 aa, Streptococcus agalactiae
MTFKSGFVAILGRPNVGKSTFLNHVMGQKIAIMSDKAQTTRNKIMGIYTTETEQIVFIDTPGIHKPKTALGDFMVESAYSTLREVETVLFMVPADEKRGKGDDMIIERLKAAKIPVILVINKIDKVHPDQLLEQIDDFRSQMDFKEVVPISALQGNNVPTLIKLLTDNLEEGFQYFPEDQITDHPERFLVSEMVREKVLHLTQQEVPHSVAVVVESMKRDEETDKVHIRATIMVERDSQKGIIIGKQGAMLKKIGKMARRDIELMLGDKVYLETWVKVKKNWRDKKLDLADFGYNEKEY

SEQ ID NO: 10019 - DNA, 483 bp, Streptococcus agalactiae
atgattgatgaaactggacaagtttcagaagatatcaaaaagcaaactcttgatttgttagagtttgcagcacaaaaaacaggtaaagagaataaagaaatggctgtaacgtttgtcactaatgaacgtagccatgaattgaatttagagtatcgagataccgatcgtccgactgatgttatcagtttagaatataagcctgaggttgatatttcttttgatgaagaagatctggctgaaaatcctgaacttgctgagatgctagaagattttgattcttatattggtgaactttttatttctattgataaagctaaagaacaagcagaagagtacggtcactcttatgaacgtgaaatgggttttttagctgtacatggttttttgcatattaacggttatgatcattatacacccgaagaagaaaaagagatgttcagcttacaggaagaaattttaactgcttatggacttaaacgacaa

SEQ ID NO: 10020 - protein, 161 aa, Streptococcus agalactiae
MIDETGQVSEDIKKQTLDLLEFAAQKTGKENKEMAVTFVTNERSHELNLEYRDTDRPTDVISLEYKPEVDISFDEEDLAENPELAEMLEDFDSYIGELFISIDKAKEQAEEYGHSYEREMGFLAVHGFLHINGYDHYTPEEEKEMFSLQEEILTAYGLKRQ

SEQ ID NO: 10021 - DNA, 507 bp, Streptococcus agalactiae
atggaacgtgcgatttttgctggaggttgtttttggtgtatggtacaaccatttgaagaattagatggtattgaatctgttttatctggatacactggaggacatgttgagaatccaacttataaagaagtttgtagtaaaactactggacatacagaagctgttgaaattatttttaatcctgaaaaaatctcttatgcagatttagttgagttatattgggcacaaacagatccaacagacgcttttggtcagtttgaagatcgtggggataattatcgtcctgtcatcttttatgagaatgaagagcaacgtcagattgctcaaaaatcaaaagataagctacaagcttcgggtagatttgatagaccaattgtaaccagcattgagcctgctgatactttttacccagcagaagactatcatcaagcattctatcggactaaccctgctcgttacgccttgagtagtgccagaagacatgcatttctagaggagaactggcat

SEQ ID NO: 10022 - protein, 169 aa, Streptococcus agalactiae
MERAIFAGGCFWCMVQPFEELDGIESVLSGYTGGHVENPTYKEVCSKTTGHTEAVEIIFNPEKISYADLVELYWAQTDPTDAFGQFEDRGDNYRPVIFYENEEQRQIAQKSKDKLQASGRFDRPIVTSIEPADTFYPAEDYHQAFYRTNPARYALSSARRHAFLEENWH

SEQ ID NO: 10023 - DNA, 852 bp, Streptococcus agalactiae
atgaatacattattagcgacagtcataacaggcttagtaactgatgaaaacaaagatttttactttatccaaaaagatggctttacctttgcattatcaaagtcagaaggagagcatcacattggtgaaatggttaaaggattcgcctatacagatatgcaacaaaaagcacgtcttacaactaaagaaacatttgcgactcgagatcattatggttgggggacagttactgaggtacgtaaagacttgggagtatttcttgatactggtcttccagataagcaagtggttgtttctttggatgttcttcctgaattgaaagaactttggcctaaaaaaggtgatcgcctctacgtttgcttagatgttgataaaaaagatcgtctctgggctctccctgcagatcctgaagtgtttcaacgaatggcaacccctgcatataacaatatgcaaaatcaaaattggccagcaatcgtttatcgcttaaaattgtcaggaacttttgtttatctaccagaaaataatatgctcggctttattcaccctagtgaacgttacagtgaacctcgtttagggcaagtgctggatgcacgagttattggcttcagagaagttgatagaaccttaaatttatcattaaagcctcgttcttttgaaatgttagaaaatgacgcacaaatgattttaacgtatttagaaagtaacggaggattcatgactttaaatgataaatcttctccagaggaaattaaagctacttttggaatttccaaaggtcagtttaaaaaagcacttggaggactcatgaaagctaaaaagatcaaacaagatcagctaggtacagaattatta

SEQ ID NO: 10024 - protein, 284 aa, Streptococcus agalactiae
MNTLLATVITGLVTDENKDFYFIQKDGFTFALSKSEGEHHIGEMVKGFAYTDMQQKARLTTKETFATRDHYGWGTVTEVRKDLGVFLDTGLPDKQVVVSLDVLPELKELWPKKGDRLYVCLDVDKKDRLWALPADPEVFQRMATPAYNNMQNQNWPAIVYRLKLSGTFVYLPENNMLGFIHPSERYSEPRLGQVLDARVIGFREVDRTLNLSLKPRSFEMLENDAQMILTYLESNGGFMTLNDKSSPEEIKATFGISKGQFKKALGGLMKAKKIKQDQLGTELL

SEQ ID NO: 10025 - DNA, 678 bp, Streptococcus agalactiae
atgttggtttgtaatcatgtcggaaaaacatttggacgacaagaggttttaaaggactgtcattttcatcttaaaagaggagaaataattggtataatgggtaaaagtggcagtggtaaaagtagccttgcccgactcattataggactagatagtcctacttgtggttcgatatattttcaaggaaaaatttacacacctaaagatggtaaggcgcagattatccttgtttttcaagatgcgcttagttcggtcaatccatattttagtattgaggaaattttgaatgaagctttttatggaaaaaaaacaacttttgaattatgtcaaatattagaagcggtgggtttagatggaacttatctaaaatataaagctagacaacttagtggtggtcagctacagagagtttgtatcgctagagctttactcttaaagcctaaaattattatttttgatgaatccttaagtggattagacccagtaactcaaattaaaatgctacgtttattacaaaaaataaaacgccgttatgaattaagttttataatgatttctcatgaccctaaaatttgtcaagctatctgtaaccgggtctttctgataaaaaatggttatttagtagaagataatgaattcttgaagagagcgtgttctactaactgtttgaccaatctc

SEQ ID NO: 10026 - protein, 226 aa, Streptococcus agalactiae
MLVCNHVGKTFGRQEVLKDCHFHLKRGEIIGIMGKSGSGKSSLARLIIGLDSPTCGSIYFQGKIYTPKDGKAQIILVFQDALSSVNPYFSIEEILNEAFYGKKTTFELCQILEAVGLDGTYLKYKARQLSGGQLQRVCIARALLLKPKIIIFDESLSGLDPVTQIKMLRLLQKIKRRYELSFIMISHDPKICQAICNRVFLIKNGYLVEDNEFLKRACSTNCLTNL

SEQ ID NO: 10027 - DNA, 705 bp, Streptococcus agalactiae
atgggagaatcgctaactattattggtgagagtggttcagggaaaaccctcttggcaaaattattggttggtcacattccacaaggtatgacagttagaggaaacatattttttaagggagttgatttaggtaaactaactgtaaagcagtggcagaaattaaggggacgagatattgcctatttagtgcaaaatcccatgtctatgtttaatccttttcaaaaaattgaagcgcatattttggaaacaatccttagtcatgagaaatgttcaaagagagtagccttatctaaagcgttagaatggatgaaacgtttaaatttagatgatgcgatatccctgttaaaaaaatacccttttgagcttagtggaggaatgctacaaagaattatgttagccactatattatctcttgatcctcaggtaatcatattagatgagccgacctcagcggttgattgtcataattgttctactatatcagctattttgcaggaattgcaaaataatggaaaaaccttgattactgtaacgcatgattatcagttagctagagacctggggggacaattattagttataagtgagggagaagttgttgaacagggacaaacccaagctattttaagcaatcctcaacataactatacgaaagcactgacagtgcaaatggagtatgaaggagatattcttaatgttggtttg

SEQ ID NO: 10028 - protein, 235 aa, Streptococcus agalactiae
MGESLTIIGESGSGKTLLAKLLVGHIPQGMTVRGNIFFKGVDLGKLTVKQWQKLRGRDIAYLVQNPMSMFNPFQKIEAHILETILSHEKCSKRVALSKALEWMKRLNLDDAISLLKKYPFELSGGMLQRIMLATILSLDPQVIILDEPTSAVDCHNCSTISAILQELQNNGKTLITVTHDYQLARDLGGQLLVISEGEVVEQGQTQAILSNPQHNYTKALTVQMEYEGDILNVGL

SEQ ID NO: 10029 - DNA, 1596 bp, Streptococcus agalactiae
ttgagcattacttgtttattgatggtgactctgactgcatgccattcacaggatagcaaaagtcataaactaaacagtgataaactcacgcttgcttggggagaagactttggtgatgttaatccgcatcgctataaccctgatcagtttgttatccaggatatggtttatgaggggttggtacgatatggtgacaatgggaaaattgaaccagctttagcgaaaagctggagcattagtcaagatggaaaaacctacacttttaaattgagaaatgctaaatattctgatggcagtaactttaatgctgcgaatgtcaaacgtaattttgatagtattttttcgaagtctaatagaggtaatcataattggtttaatttaacgaatcaattggaaaattatcgtgccttgaatcaaagtacttttgaaattaaactgaaacaagcttatagtgctactttatatgatctctctatgattcgaccaattcgctttttatctgatagcgctttccctaaaggtgatgatacaactaagaagaatgtaaaaaaaccaattggaacgggtcaatgggttgtgaaaagtaaaaagcaaaatgaatatattaccttcaaacgtaatgagaattactggggaaagaaaccaaaattaaaagaagtaaccgtaaaagttatacccgatgctcagacgcgtgctttagcattcgaatcaggtgacgttgatttgatctatgggaatggcattattggtttagacacttttgcccaatatacgaaggacaagaaatatgtcacagctatttctcaacctatgtcaacaagacttttgttgctaaatgctaaggaaagtattttccaagataaaaaagttcgtcaggcaatgaatcatgctattgacaaggtttctattgctaagaacacctttagaggaacagaaaagccagcagacactattttttcaaaatcaacatctcactcagatgctaagttaaatccttatagctataatgttgataaagcaaatcagctattggatcaagctggttggaagatgggaaaagataaggttcgtgaaaaagatggtaaaactctaaccttacgtcttccttatatcgccactaaggcaactgataaagacctggtaacttatttccaaggagaatggcgtaaaatcggtattaatgtttctcttattgctatggaagaagatgattattgggctaatgctaaaaagggtaattttgatatgatgttaacctattcttggggagcaccatgggaccctcatgcttggatgtcggcattaactgccaaggcagatcatggacatccagaaaatatagctttagaaaatctagcaactaaaactgaaatggatagacttattaagtcagctctagtagatcctaaggaagaaaatgttgatagagactataagaaggttcttgaattattgcatgatgaggctgtatatatcccattaacttatcaatcggtgatttctgtttataggaaaggtgattttaaaaccatgcgttttgcgccagaagaaaattcattcccattacgctatatagaaaaaaacaatgtatctaag

SEQ ID NO: 10030 - protein, 532 aa, Streptococcus agalactiae
MSITCLLMVTLTACHSQDSKSHKLNSDKLTLAWGEDFGDVNPHRYNPDQFVIQDMVYEGLVRYGDNGKIEPALAKSWSISQDGKTYTFKLRNAKYSDGSNFNAANVKRNFDSIFSKSNRGNHNWFNLTNQLENYRALNQSTFEIKLKQAYSATLYDLSMIRPIRFLSDSAFPKGDDTTKKNVKKPIGTGQWVVKSKKQNEYITFKRNENYWGKKPKLKEVTVKVIPDAQTRALAFESGDVDLIYGNGIIGLDTFAQYTKDKKYVTAISQPMSTRLLLLNAKESIFQDKKVRQAMNHAIDKVSIAKNTFRGTEKPADTIFSKSTSHSDAKLNPYSYNVDKANQLLDQAGWKMGKDKVREKDGKTLTLRLPYIATKATDKDLVTYFQGEWRKIGINVSLIAMEEDDYWANAKKGNFDMMLTYSWGAPWDPHAWMSALTAKADHGHPENIALENLATKTEMDRLIKSALVDPKEENVDRDYKKVLELLHDEAVYIPLTYQSVISVYRKGDFKTMRFAPEENSFPLRYIEKNNVSK

SEQ ID NO: 10031 - DNA, 1164 bp, Streptococcus agalactiae
atgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacatgaaccaatcagagctgaactcctggcttgaaatggacacggttattggacggattggtggaaaggtccttctcaccttcaatgtcgccttctgtaacttcatctttgccaaactgatggattctaagacagctatcgaaactgctaaacacatacaggtcattaagaggacactctatgataacaagagagacttcttcgaactctttcctgttatcctaacggataatggtggggaattcgctagagtggatgatattgagatagatgtttgtggacagtctcaactcttcttttgtgaccctaatcggtctgaccagaaagcaagaatcgagaagaatcataccctcgtgagagacatactgcctaaggggacttccttcgacaacttgactcaagaggacattaatctggcactatctcatatcaacagcgttaagagacaggctctaaatggtaaaacggcttatgagctattctcttttacttacggaaaagacatcgcaagtatactcggtattgaggaaattactgcggaagacgtctgccaatctcccaaactattaaaagacaaaatc

SEQ ID NO: 10032 - protein, 388 aa, Streptococcus agalactiae
MTKHKHLTLLDRNDIQSGLDRGETFKAIGLNLLKHPTTIAKEVKRNKQLRESTKDCLDCPLLRKAPYVCNGCPKRRINCGYKKTFYLAKQAQRNYEKLLVESREGIPLNKETFWKIDRVLSNGVKKGQRIYHILKTNDLEVSSSTVYRHIKKGYLSITPIDLPRAVKFKKRRKSTLPPIPKAIKEGRRYEDFIEHMNQSELNSWLEMDTVIGRIGGKVLLTFNVAFCNFIFAKLMDSKTAIETAKHIQVIKRTLYDNKRDFFELFPVILTDNGGEFARVDDIEIDVCGQSQLFFCDPNRSDQKARIEKNHTLVRDILPKGTSFDNLTQEDINLALSHINSVKRQALNGKTAYELFSFTYGKDIASILGIEEITAEDVCQSPKLLKDKI

SEQ ID NO: 10033 - DNA, 882 bp, Streptococcus agalactiae
atgtatctagagagtatcgagctatactcaaacatcactaaagccgctgcacacctttttatttctcaaccttacctaagcaaagtgatcaagcaattagaaaatgagttagaaataaaactcatccagagccaaggacaccaaacctttttaacttatgctggacagagatatctattctacctaaaagaaattgatatgattgagcgtcaaatggccaaagaactatatctcatccgttctgataaaaaaggagaaatcacacttgggattaactctggcttagcaagttctattctggcaaatgtacttcccaaatttaacttggagcacccagaaatttctgtcaaattactcgaaaacaatcaaaatatttctgaacaattggtagcgagtggtgatattgacctagctgttgggatggctcctatcctttataaagatggaattgcatcaaccactatttaccgcgacgaattgtttttaatgatacctaccaccagccaactctacaacgctgaaaaacgtggacagattattccttttgaatatcctatttcagttctagacaatgaacctcttatcctaacaccattagagtacggaattggcaaaacaattgcacaattctatgagcttcatcacatgtcattaaatcagatgattacaactagtaccgttcctacagcagctagcctatctttgtcagggatgggagcaacatttgttccacaaactctcattcatcgctatttggataaagagtgcaatgtctaccattttcataagaataagttattttcagagtacattatgatttataaaaaagatgttgaattatctggaattgctctcctactttataaagcttttttaaccaag

SEQ ID NO: 10034 - protein, 294 aa, Streptococcus agalactiae
MYLESIELYSNITKAAAHLFISQPYLSKVIKQLENELEIKLIQSQGHQTFLTYAGQRYLFYLKEIDMIERQMAKELYLIRSDKKGEITLGINSGLASSILANVLPKFNLEHPEISVKLLENNQNISEQLVASGDIDLAVGMAPILYKDGIASTTIYRDELFLMIPTTSQLYNAEKRGQIIPFEYPISVLDNEPLILTPLEYGIGKTIAQFYELHHMSLNQMITTSTVPTAASLSLSGMGATFVPQTLIHRYLDKECNVYHFHKNKLFSEYIMIYKKDVELSGIALLLYKAFLTK

SEQ ID NO: 10035 - DNA, 2355 bp, Streptococcus agalactiae
atgattactgctcttgttttaacaattattctcttctttggtattatcagattaggtatttttggtattacagtctataacgtcatccgttttatggtaggtagcttggcttacttatttattgcggcaactttaatctacctttatttctttaaatggttgcgaaagaaagatagcttagtagcaggttttttgatagcttctttaggattattgattgagtggcatgcttaccttttctcaatgcctattttgaaagataaagaaattttgcgttcaactgctcgattaattgtgtctgatttaatgcaatttaaaatcactgtttttgccggtggaggtatgttgggtgctttgatttacaagccaattgcttttctcttttctaatattggtgcctatatgattggtgttctcttcatcattttgggtctctttttaatgagttctctggaagtttatgacatcgtcgaatttattagagcttttaaaaataaagtggcagagaagcacgagcaaaataaaaaggagcgttttgctaagcgagagatgaaaaaagcaatcgctgaacaagagcgcatagagcgtcaaaaagctgaagaagaagcttatttagcttcggttaatgtagaccctgaaacgggtgagattctagaggatcaagctgaggacaatttggatgatgcgctaccacctgaggtaagtgaaacatcaactccggtatttgagccagagatccttgcttatgagacatcgcctcaaaatgatcctttaccagtagagccgacaatttatttagaagactatgattcgccgattcctaatatgagagaaaatgatgaggaaatggtttatgatttagatgatgatgtagatgatagtgatatagaaaatgtcgactttacacctaaaacgacactggtttataaattaccaacgatagatttatttgcaccagataagcctaaaaatcaatccaaagaaaaggatttagtccgaaagaatatcagagttttagaagaaacatttagaagttttggtatcgatgtaaaagtagaacgtgctgaaattggaccatcagttactaaatatgaaattaaaccagcagttggagttcgtgtgaatcgtatttcaaatctatctgacgacctagctcttgctcttgcagcaaaagatgtgcgtatagaaacaccaattcctggaaaatcattaataggtattgaagttcctaactcagaaattgcaacggtttctttccgcgaactttgggaacaatctgatgccaatcctgaaaaccttttagaagtaccactaggaaaagctgttaacggcaatgctcgcagttttaacttagctagaatgccgcatcttttggtagctggttcaactggttcaggtaaatctgtggcagttaatggaattatttcaagtattttgatgaaggcacgtccagatcaagttaagtttatgatgattgatcccaaaatggttgaattatctgtttataatgatattccacatttattaatccctgttgtaaccaatccgcgtaaagcaagtaaggcactccaaaaagttgttgatgaaatggaaaatcgatacgagttatttagcaaaattggtgtgcgtaatatagcaggttataatacaaaggttgaagagtttaatgcttcctctgagcaaaaacaaatacctttgcctttaatcgttgtcattgtagatgaattggctgacttgatgatggttgctagtaaagaagttgaagatgctattattcgtttggggcaaaaagcacgtgctgcaggtatccatatgattcttgcaactcaacgtccatccgtagatgttatttctggtttgattaaagcaaatgttccgtcgcgtattgcatttgctgtttcaagtggtactgatagccgtacgatccttgatgaaaatggtgctgaaaagctcttgggacggggtgacatgctctttaagcctattgatgagaatcatccagtacgactacaaggttcctttatttcagatgatgatgttgaaaggatcgttggttttatcaaagaccaagccgaggctgactatgatgatgcctttgatcctggagaagtatctgaaacagataacggctctggtggtggcggcggagtacctgaaagtgatcctctttttgaagaagccaagggactcgttttagagacgcaaaaagcaagtgcctcaatgattcaacgccgattgtctgttggtttcaatagagcaacaagactaatggaagaattagaagcagcgggggttattggtccagcagaaggaaccaagccacgaaaagttttaatgactccaactccgagtgaa

SEQ ID NO: 10036 - protein, 785 aa, Streptococcus agalactiae
MITALVLTIILFFGIIRLGIFGITVYNVIRFMVGSLAYLFIAATLIYLYFFKWLRKKDSLVAGFLIASLGLLIEWHAYLFSMPILKDKEILRSTARLIVSDLMQFKITVFAGGGMLGALIYKPIAFLFSNIGAYMIGVLFIILGLFLMSSLEVYDIVEFIRAFKNKVAEKHEQNKKERFAKREMKKAIAEQERIERQKAEEEAYLASVNVDPETGEILEDQAEDNLDDALPPEVSETSTPVFEPEILAYETSPQNDPLPVEPTIYLEDYDSPIPNMRENDEEMVYDLDDDVDDSDIENVDFTPKTTLVYKLPTIDLFAPDKPKNQSKEKDLVRKNIRVLEETFRSFGIDVKVERAEIGPSVTKYEIKPAVGVRVNRISNLSDDLALALAAKDVRIETPIPGKSLIGIEVPNSEIATVSFRELWEQSDANPENLLEVPLGKAVNGNARSFNLARMPHLLVAGSTGSGKSVAVNGIISSILMKARPDQVKFMMIDPKMVELSVYNDIPHLLIPVVTNPRKASKALQKVVDEMENRYELFSKIGVRNIAGYNTKVEEFNASSEQKQIPLPLIVVIVDELADLMMVASKEVEDAIIRLGQKARAAGIHMILATQRPSVDVISGLIKANVPSRIAFAVSSGTDSRTILDENGAEKLLGRGDMLFKPIDENHPVRLQGSFISDDDVERIVGFIKDQAEADYDDAFDPGEVSETDNGSGGGGGVPESDPLFEEAKGLVLETQKASASMIQRRLSVGFNRATRLMEELEAAGVIGPAEGTKPRKVLMTPTPSE

SEQ ID NO: 10037 - DNA, 234 bp, Streptococcus agalactiae
atgacatttgaagaaattttaccaggtttaaaagcaaagaaaaaatatgtacgtacaggttgggggggcgctgaaaattatgttcagttatttgatacccttgaagttaatgggaaagtactacaggctacaccttattttcttattaatgttactggtgaaggtgaaggtttttccatgtgggcaccaacaccatgtgatgttttagcagaggattggatcgaggtcaatgac

SEQ ID NO: 10038 - protein, 78 aa, Streptococcus agalactiae
MTFEEILPGLKAKKKYVRTGWGGAENYVQLFDTLEVNGKVLQATPYFLINVTGEGEGFSMWAPTPCDVLAEDWIEVND

SEQ ID NO: 10039 - DNA, 1203 bp, Streptococcus agalactiae
gtgagttcgattgattcgttattgcaccttgattatgaagcgtatgaaattatcgttgtggatgacggttccagtgacaatacttcagatgttctcaaggaagagtttgcattaatgaaaatctcgaatacgattgattcaattattgctactcaaacttgtaaagatgtctttcagagacaggttggtaaggttaaactgacactcattgttaaagaaaatggtggcaaaggggatgccttaaatatggggatcaatgctgctaattacgattattttctatgtctagatgcagattctatgttgcaggtagattctttgagtcaaattagcaaatccatacaggtagatccgacggttatagcagtgggagggctcgtccaagttgcccaaggtgttaagattgagcaggggaaagtagcatcttatcgtttgccttggagaattattccttgtgcacaagcacttgagtatgattcatcatttttaggagctcgaatctttttagactatttaagagctaatttaattatttcgggggctttcggtctttttaagaaagaccttgttaaagcggtgggaggatatgacacccagactctaggagaagatatggagttggtgatgaaattacatttcttctgtcgtaataataatattccttatcgtatttgttatgaaacagatgctgtttgttggagtcaagcaccaacgaatttaggggatttacgtaaacagagacgccgatggtatcttggcttgtaccaatgtttaaaaaaatataaaagtatttttgccaattatcgctttggagctgtaggatcaatttcttatatttactatattttatttgaattactgaccccttttatagaatgttttggtattgtcattatatttttgtccttattatttaatcaattaaacatcccattctttatatcattggtgagcctttatatcttttactgtgttttaattacattaagctctttcttacaccgtatttattctcagcaactagtaataggaattttagatattgttaaagtattttatattgctgtttttaggtatcttatcctacatcctgtattaacttttgttaaggttgcaagtgttattggctataaaaataaaaaaatggtttgggggcatattacgagagagaaacaaatgaaggattttgaaacaagtgttact

SEQ ID NO: 10040 - protein, 401 aa, Streptococcus agalactiae
MSSIDSLLHLDYEAYEIIVVDDGSSDNTSDVLKEEFALMKISNTIDSIIATQTCKDVFQRQVGKVKLTLIVKENGGKGDALNMGINAANYDYFLCLDADSMLQVDSLSQISKSIQVDPTVIAVGGLVQVAQGVKIEQGKVASYRLPWRIIPCAQALEYDSSFLGARIFLDYLRANLIISGAFGLFKKDLVKAVGGYDTQTLGEDMELVMKLHFFCRNNNIPYRICYETDAVCWSQAPTNLGDLRKQRRRWYLGLYQCLKKYKSIFANYRFGAVGSISYIYYILFELLTPFIECFGIVIIFLSLLFNQLNIPFFISLVSLYIFYCVLITLSSFLHRIYSQQLVIGILDIVKVFYIAVFRYLILHPVLTFVKVASVIGYKNKKMVWGHITREKQMKDFETSVT

SEQ ID NO: 10041 - DNA, 693 bp, Streptococcus agalactiae
atgaacgaagttcttagacaggaaaaaaaatatttaatatcacttgaagattactatcttttatctaagaaattttcccaagtaatgacgctcgattcgcatagttcagacgacggctatactatccgttcgctatactttgattctttagaagatgttgattggcaagaaaaggaagatggtgttgagatacgaagaaagattcgtttgcgcaattatggtagtcaaagcaattttgcgaaattagaaatgaaacaaaaacaaggtgctaatcaaaaaaagcgctctctaaaattaagcaagacagatgctcaagcgctgattaatggtaacaatagtgttttattaaattatccggatacatttgctgcggagtgttattcaaggataacaacgcaactttatcaacctaaaacggttattgagtaccaaagaaaagcttttgttgctaaggaaaacaatatccgaatcacctttgaccaccatataataggtacagaggctagttatgatattttctcagaggatttaaatcaaaattatttattagatccttatcttgttattttagaagttaaatataatggatttttattgtcttatattaaagaactcttagattcggtagatagaagtgaactttcagcgagtaagtattgtttaggaagagctgttagtaaacattatcgtttt

SEQ ID NO: 10042 - protein, 231 aa, Streptococcus agalactiae
MNEVLRQEKKYLISLEDYYLLSKKFSQVMTLDSHSSDDGYTIRSLYFDSLEDVDWQEKEDGVEIRRKIRLRNYGSQSNFAKLEMKQKQGANQKKRSLKLSKTDAQALINGNNSVLLNYPDTFAAECYSRITTQLYQPKTVIEYQRKAFVAKENNIRITFDHHIIGTEASYDIFSEDLNQNYLLDPYLVILEVKYNGFLLSYIKELLDSVDRSELSASKYCLGRAVSKHYRF

SEQ ID NO: 10043 - DNA, 1995 bp, Streptococcus agalactiae
atgacagaaaaaaaatcattttacattactaccccaatttattacccatcaggtaaattgcacatcggttctgcctatacaacgatagcatgtgatgttttggcacgttacaaacgcatgatgggctttgatgttcagtatttgactggtcttgatgagcatggtcagaaaattcaacaaaaggctgaagaagcaggcattacaccacaggaatatgttgatggcatggctgaaagtgtcaaaacattatgggaacttttagatatttcctatgacaaattcatccgtacaacagatacttaccatgaagaagcggttgctaaaatttttgaacaattgttggcacaaggggacatctatcttggtgagtataccggatggtattctgtttcagatgaagaattttttactgaaagccaattagcagaagtttatcgtgacgaaaacggtaatatgattggtggtgttgcgccatctggtcatgaagttgaaaaagtttctgaagaatcttatttcttccgcatgagcaaatatgcagatcgtttaaaagcgtactacgctgagcatccagaatttattcagccagatggtcgtatgaatgaaatgcttaaaaactttatagaaccaggtttagaagatttagcagtgtctcgtacaacttacacatggggagttcaggtaccatcaaatccaaaacatgttatttatgtctggattgatgctttgatgaactatatttctgctcttggttatggttggtctgacgatctcagtcaatatcataaattttggccagcagacattcatatgattggtaaagatattcttcgtttccactctatttattggcctatcatgttgatggcgctggatttgccattaccaaaacgtctagttgctcatggttggtttgtgatgcaagatggtaaaatgtctaaatcaaaagggaatgtcgtttatccagaaatgttagtagagcgttttggtcttgatccactccgttattatctcatgcgttcattgcctgttggttcagacggaacttttacgccagaagattatgttggacgtattaactatgaacttgctaatgatttaggaaaccttctcaaccgcactattgctatggttaacaagtatttcgatggagaagtaccaaggtttgctgttgcaactgactttgatgccgatttagcttctgttgcgacagatagtattgaaaactatcataaacaaatggaagcggtggatttcccacgtgcccttgaagctgtatggaatcttatttcacgaactaacaaatatattgatgaaacagcaccgtgggtacttgcaaaagacgaaacagatcgtgataagttagcagctgtaatgagtcatttagttgctagtctacgtgttgttgctcacctcattcaaccgttcatgatggaaacttccgatgccattatggaacaacttggtttaggggcaacattcgatcttgaaaaattgacttttgctgatctaccagaaggtgttcgagttgttgcaaaaggttcaccaattttcccaaggttggatatggaagacgaaattacttatatcaaagaacaaatgaatgctggaaaagcaccagtggaaaaggagtgggttcctgaagaagttgaattgacatcaagcaaaggtcaaatcaagtttgaggattttgacgctgttgaaatccgcgttgcagaagtaattgaagttgagaaagtggaaggttctgataaacttcttcgtttccgtctagatgctggtgatgagggccatcgtcaaatcttatcagggattgcaaaattttacccaaatgaacaagagttagtagggaaaaaactccaaattgttgctaacctcaaaccacgtaaaatgatgaaaaaatatgtcagtcaaggcatgattctctcagcagaacatgatggtaaattgacagtgttgacggtcgattcagcagtggcaaatggatcaattattggt

SEQ ID NO: 10044 - protein, 665 aa, Streptococcus agalactiae
MTEKKSFYITTPIYYPSGKLHIGSAYTTIACDVLARYKRMMGFDVQYLTGLDEHGQKIQQKAEEAGITPQEYVDGMAESVKTLWELLDISYDKFIRTTDTYHEEAVAKIFEQLLAQGDIYLGEYTGWYSVSDEEFFTESQLAEVYRDENGNMIGGVAPSGHEVEKVSEESYFFRMSKYADRLKAYYAEHPEFIQPDGRMNEMLKNFIEPGLEDLAVSRTTYTWGVQVPSNPKHVIYVWIDALMNYISALGYGWSDDLSQYHKFWPADIHMIGKDILRFHSIYWPIMLMALDLPLPKRLVAHGWFVMQDGKMSKSKGNVVYPEMLVERFGLDPLRYYLMRSLPVGSDGTFTPEDYVGRINYELANDLGNLLNRTIAMVNKYFDGEVPRFAVATDFDADLASVATDSIENYHKQMEAVDFPRALEAVWNLISRTNKYIDETAPWVLAKDETDRDKLAAVMSHLVASLRVVAHLIQPFMMETSDAIMEQLGLGATFDLEKLTFADLPEGVRVVAKGSPIFPRLDMEDEITYIKEQMNAGKAPVEKEWVPEEVELTSSKGQIKFEDFDAVEIRVAEVIEVEKVEGSDKLLRFRLDAGDEGHRQILSGIAKFYPNEQELVGKKLQIVANLKPRKMMKKYVSQGMILSAEHDGKLTVLTVDSAVANGSIIG

SEQ ID NO: 10045 - DNA, 1095 bp, Streptococcus agalactiae
atgtcagaaaatcctgatgcctatattattcgtagtcaaaatttgcataatcaggatttcccaagtaacctcaaagctattgctagggcgggtgcaggaacaaataatattcctattgaagaggcaagtgcacagggaatagtcgtgtttaataccccaggtgcaaatgctaatgctgtaaaagaagcggtcattgctgccttattactttcagctcgtgattatttaggagctaaccgatgggttaatactctaactggaacagatattcccaaacaaattgaagcaggaaagaaagcttttgctggtaatgaaattgcaggaaaaaaattgggagttatcggccttggtgccattggagctagaattgcgaatgatgctagacgcttaggaatgacagttcttggttatgatccctatgtttcaattgaaacagcttggaatatttcaagccatgttcaaagggttaaagagattaaggatatttttgaaacttgtgactatatcacaattcatgttcccttaacaaatgaaactaagcatacttttgatgcgaaagctttttcaatcatgaaaaaaggaactacgattatcaactttgctcgtgcagaattagtcaataaccaagagctatttgaagcgatagaaactggtgttgtcaagcgctatattactgattttggagacaaagaattattaaaccaaaaaggaattacagtctttcctcatgtaggcggatcaacagatgaggcagagctaaattgtgctattatggcaagtcaaaccattcgttgttttatggagacaggagaaatcactaattcagttaatttccccaatgtacatcaaattcaaaccgcaccatttcgtattactttaattaacaagaatgttcctaacattgtggctaaaatttcaactgctgtatcagagttaggtataaatattgataacattattaaccgttcaaagggtgactacgcctacacactaatagatttagatgaaacggataataacaagatttctactttaattgaagaatttgaaggtgatgagaatatcgtccgtgtacgtttaattgcaaaacaacaa

SEQ ID NO: 10046 - protein, 365 aa, Streptococcus agalactiae
MSENPDAYIIRSQNLHNQDFPSNLKAIARAGAGTNNIPIEEASAQGIVVFNTPGANANAVKEAVIAALLLSARDYLGANRWVNTLTGTDIPKQIEAGKKAFAGNEIAGKKLGVIGLGAIGARIANDARRLGMTVLGYDPYVSIETAWNISSHVQRVKEIKDIFETCDYITIHVPLTNETKHTFDAKAFSIMKKGTTIINFARAELVNNQELFEAIETGVVKRYITDFGDKELLNQKGITVFPHVGGSTDEAELNCAIMASQTIRCFMETGEITNSVNFPNVHQIQTAPFRITLINKNVPNIVAKISTAVSELGINIDNIINRSKGDYAYTLIDLDETDNNKISTLIEEFEGDENIVRVRLIAKQQ

SEQ ID NO: 10047 - DNA, 546 bp, Streptococcus agalactiae
atgcaaatcagattagcttttccaaatgaaattgaccaaattatgcttcttattgaggaagcgcgtgccgaaattgctaaaacaggaagtgatcaatggcaaaaagaagatggataccctaatcgtaacgatattattgatgatatcttgaacggttatgcttgggttggtattgaagatgggatgctagcgacttatgcggctgtcattgatggtcatgaagaggtttatgatgctatttatgagggaaaatggctccatgataaccatcgctatcttacatttcatcgtattgcgatctcaaatcaatttcgtggtagaggactagcacagacattccttcaagggttaattgaaggtcataaaggacctgattttcgttgcgatactcatgaaaaaaatgtcactatgcagcatattctaaataaattaggctatcaatattgtggtaaagtacctctagatggggtacgattggcttatcagaagataaaagaaaagggagaaacgagcatctatcgtgagattgatgaaagaaatcccatg

SEQ ID NO: 10048 - protein, 182 aa, Streptococcus agalactiae
MQIRLAFPNEIDQIMLLIEEARAEIAKTGSDQWQKEDGYPNRNDIIDDILNGYAWVGIEDGMLATYAAVIDGHEEVYDAIYEGKWLHDNHRYLTFHRIAISNQFRGRGLAQTFLQGLIEGHKGPDFRCDTHEKNVTMQHILNKLGYQYCGKVPLDGVRLAYQKIKEKGETSIYREIDERNPM

SEQ ID NO: 10049 - DNA, 516 bp, Streptococcus agalactiae
atgatttatgcaggagctcaaaaaaatattggacctgctggtgtaacggtagttattatccgtgaagatatgattaatgaggaaccaactttatcatcaatgttggattataagattcagtcagatgctggttctctttataatacgccgcctgcttacagtatttacattgctaaattagtctttgaatgggtgaaaagtctaggtggtgttgatgctatggaaaaagctaatcgtgaaaaatcaggacttctctatgattatattgattcctcagaattttatagtaatcctgtcagagataaaaagagtcgttctctatgtaacattcctttcataactattaataaagatttagatgaaaaatttgtaaaggaagcgacagaacgtggatttaaaaatattaaaggacatcgttcggtaggtggtatgagagctagcctttataatgcctttcctaaacaaggtgtcatcgaattaattgattttatgaaaacatttgaagcagaaaataca

SEQ ID NO: 10050 - protein, 172 aa, Streptococcus agalactiae
MIYAGAQKNIGPAGVTVVIIREDMINEEPTLSSMLDYKIQSDAGSLYNTPPAYSIYIAKLVFEWVKSLGGVDAMEKANREKSGLLYDYIDSSEFYSNPVRDKKSRSLCNIPFITINKDLDEKFVKEATERGFKNIKGHRSVGGMRASLYNAFPKQGVIELIDFMKTFEAENT

SEQ ID NO: 10051 - DNA, 861 bp, Streptococcus agalactiae
atgcaagttcaaaaaagttttaaatcaaatatacattacggaacactctatctagtcccaactccaattggtaatctagatgatatgacttttcgtgccattaggattttaagagaagttgattttatttgtgcagaggatacacgaaatacgggacttttactcaagcactttgatattactactaaacaaattagttttcacgaacacaatgcttacgataaaatctctgggttaattgatttgttaaaagaagggaaatctttagcccaagtatctgatgcaggaatgccctctatttctgacccaggacatgaccttgtcaaggctgctattgaaggggatatcccagttgtatctataccaggagctagcgctggtattactgctctcatcgcttcaggtttagctccacaacctcatattttttatggcttcttacctcgtaagaaaggtcaacaaataactttctttgaaacaaagcaagattaccctgaaacacaaatcttttatgagtcaccgtttcgagtctctgatacgctaaaacacatgaaagagatttacggagatcgccaagttgttttagtacgcgaattgacgaaactctatgaagagtatcaaagaggaaccattagtcaacttttagagcatattgaaaaggtccctctcaaaggtgaatgcttaattattgttgatggtaagagagataccgagcgagtgaaagacagtagccaacaagatccactagtattagtaaaagaatatatcgctaatggtgataaaactaatcaagcgataaaaaaagtagcaaaagaatttaatctcaatagacaagaactctatgctagtttccatgattta

SEQ ID NO: 10052 - protein, 287 aa, Streptococcus agalactiae
MQVQKSFKSNIHYGTLYLVPTPIGNLDDMTFRAIRILREVDFICAEDTRNTGLLLKHFDITTKQISFHEHNAYDKISGLIDLLKEGKSLAQVSDAGMPSISDPGHDLVKAAIEGDIPVVSIPGASAGITALIASGLAPQPHIFYGFLPRKKGQQITFFETKQDYPETQIFYESPFRVSDTLKHMKEIYGDRQVVLVRELTKLYEEYQRGTISQLLEHIEKVPLKGECLIIVDGKRDTERVKDSSQQDPLVLVKEYIANGDKTNQAIKKVAKEFNLNRQELYASFHDL

SEQ ID NO: 10053 - DNA, 633 bp, Streptococcus agalactiae
atgaaaaaaggactaatgatttcttttgagggcccagatggtgcgggtaaaacaaccgttttagaagctgttttacccttgctcagagaaaaattatcacaagatattctcaccaccagagagcctggtggcgtaactatttcagaagaaattcgtcatattattttagatgttaaacacacgcaaatggataaaaaaacagagctattgctttacatggctgctcgacgccaacatctagtggaaaaggtactcccagctctagaagaagggaaaatagtcctaatggatcgttttattgatagttctgttgcctatcagggatcaggaagaggattagataagtcacatataaaatggcttaatgactatgcgactgatagtcataaacctgatttaactttatattttgatgttccttctgaagtaggtttagagcgtattcaaaaaagtgttcaaagggaggtaaatcgtctagatctcgagcaattagatatgcatcaacgcgtccgtcaaggttaccttgaattggcggattcggagccaaaccgcattgtgacgattgatgcctcccaacagctagatgaagtaatagctgagacattctctattattttagatcgtatcaaccaa

SEQ ID NO: 10054 - protein, 211 aa, Streptococcus agalactiae
MKKGLMISFEGPDGAGKTTVLEAVLPLLREKLSQDILTTREPGGVTISEEIRHIILDVKHTQMDKKTELLLYMAARRQHLVEKVLPALEEGKIVLMDRFIDSSVAYQGSGRGLDKSHIKWLNDYATDSHKPDLTLYFDVPSEVGLERIQKSVQREVNRLDLEQLDMHQRVRQGYLELADSEPNRIVTIDASQQLDEVIAETFSIILDRINQ

SEQ ID NO: 10055 - DNA, 549 bp, Streptococcus agalactiae
atgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatgggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgat

SEQ ID NO: 10056 - protein, 183 aa, Streptococcus agalactiae
MTKHKHLTLLDRNDIQSGLDRGETFKAIGLNLLKHPTTIAKEVKRNKQLRESTKDCLDCPLLRKAPYVCNGCPKRRINCGYKKTFYLAKQAQRNYEKLLVESREGIPLNKETFWKIDRVLSNGGQEGPTYLSYPQNQRSRSEFFNRLSTHQERLPIHHTNRPTQSCEVQKKAKEHTPSYSKSD

SEQ ID NO: 10057 - DNA, 744 bp, Streptococcus agalactiae
gtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacatgaaccaatcagagctgaactcctggcttgaaatggacacggttattggacggattggtggaaaggtccttctcaccttcaatgtcgccttctgtaacttcatctttgccaaactgatggattctaagacagctatcgaaactgctaaacacatacaggtcattaagaggacactctatgataacaagagagacttcttcgaactctttcctgttatcctaacggataatggtggggaattcgctagagtggatgatattgagatagatgtttgtggacagtctcaactcttcttttgtgaccctaatcggtctgaccagaaagcaagaatcgagaagaatcataccctcgtgagagacatactgcctaaggggacttccttcgacaacttgactcaagaggacattaatctggcactatctcatatcaacagcgttaagagacaggctctaaatggtaaaacggcttatgagctattctcttttacttacggaaaagacatcgcaagtatactcggtattgaggaaattactgcggaagacgtctgccaatctcccaaactattaaaagacaaaatc

SEQ ID NO: 10058 - protein, 248 aa, Streptococcus agalactiae
MSSSTVYRHIKKGYLSITPIDLPRAVKFKKRRKSTLPPIPKAIKEGRRYEDFIEHMNQSELNSWLEMDTVIGRIGGKVLLTFNVAFCNFIFAKLMDSKTAIETAKHIQVIKRTLYDNKRDFFELFPVILTDNGGEFARVDDIEIDVCGQSQLFFCDPNRSDQKARIEKNHTLVRDILPKGTSFDNLTQEDINLALSHINSVKRQALNGKTAYELFSFTYGKDIASILGIEEITAEDVCQSPKLLKDKI

SEQ ID NO: 10059 - DNA, 798 bp, Streptococcus agalactiae
atggtatatggcattattaagctgattaattttgctcatggggacatctatatgatgggcgctttcatgggctattatttgattaatcatcttcatcttaattttttcctagctttattaattgcaatgctggggtctgctttcctaggtgttgtaattgaatatttagcttatcgtccactgagaaaatcaactagaattgccgcgttaattacagctattggtgtttcttttcttttggagtacgggatggtataccttgttggagcggatactagggcatttccgcaagccattcatactgttaaatataatttaggaccgataactataaccaatgttcagctcatcattttaggtattgcgctattactaatgcttactttacagttcatcgttcaaaaaactaaaatggggaaagctatgagagctttatcagtggatagcgatgccgcacaattgatgggaattaatgttaaccgtaccattagttttacatttgcgctggggtctgctttagctggagcaggtggagtactgattgggctttattataattctgttcaacctcttatgggggtaactccagggttgaaagcatttgttgcagctgtcttaggtggtattggtatcattccgggagcggctatcggtggttttgttattggcattttagaaactttagcgactgcacttggtgtgtcagattttcgagatggtatcgtttatgctattttaattctcattttcttgatccgtccagcaggaattcttggaaaaaatattaaggagaaggtc

SEQ ID NO: 10060 - protein, 266 aa, Streptococcus agalactiae
MVYGIIKLINFAHGDIYMMGAFMGYYLINHLHLNFFLALLIAMLGSAFLGVVIEYLAYRPLRKSTRIAALITAIGVSFLLEYGMVYLVGADTRAFPQAIHTVKYNLGPITITNVQLIILGIALLLMLTLQFIVQKTKMGKAMRALSVDSDAAQLMGINVNRTISFTFALGSALAGAGGVLIGLYYNSVQPLMGVTPGLKAFVAAVLGGIGIIPGAAIGGFVIGILETLATALGVSDFRDGIVYAILILIFLIRPAGILGKNIKEKV

SEQ ID NO: 10061 - DNA, 588 bp, Streptococcus agalactiae
atgattccagtagttattgaacaaacaagtcgtggtgaacgttcttatgatatttactcacgtcttttaaaagatcgtattattatgttgacaggccaagttgaggataatatggccaatagtatcattgcacagttattgtttctcgatgcacaagataatacaaaggatatttacctttatgtcaatacaccaggtggttcagtatcggctggacttgctattgtggacaccatgaacttcattaaatcggacgtacagacgattgttatggggatggctgcttcgatgggaaccattattgcttcaagtggtgctaaaggaaaacgttttatgttaccgaatgcagaatatatgatccaccaaccaatgggcggaacaggcggaggtacacagcaatctgatatggctatcgctgctgagcatcttttaaaaacgcgtcatactttagaaaaaatcttagctgataattctggtcaatctattgaaaaagtccatgatgatgcagagcgtgatcgttggatgagtgctcaagaaacacttgattatggctttattgatgctattatggaaaataataatttacaa

SEQ ID NO: 10062 - protein, 196 aa, Streptococcus agalactiae
MIPVVIEQTSRGERSYDIYSRLLKDRIIMLTGQVEDNMANSIIAQLLFLDAQDNTKDIYLYVNTPGGSVSAGLAIVDTMNFIKSDVQTIVMGMAASMGTIIASSGAKGKRFMLPNAEYMIHQPMGGTGGGTQQSDMAIAAEHLLKTRHTLEKILADNSGQSIEKVHDDAERDRWMSAQETLDYGFIDAIMENNNLQ

SEQ ID NO: 10063 - DNA, 516 bp, Streptococcus agalactiae
atgttaatgggctatgaagtgtctcgtgatttgcctttagaagatgttgaaatccaaacaccagtagcgacaactgtacaaaaacaattagctgggaaaaagttagcaattgttccaattttacgtgcaggtattggtatggttgatggtttcttaagccttgtgccagctgctaaagttggtcatatcggtatgtatcgtgatgaagagactttccaaccagtcgaatatttagttaagttacctgaagatattgatcaacgtcagatttttgtagttgatccaatgcttgctacaggtgggtctgctattttagcagtagattctctaaaaaaacgtggcgcagctagtatcaaattcgtttgtttagtagcagctccagaaggagtggcagcacttcaagaagcacatccagatgtagatatttataccgctgctttggatgaaaaactcaacgaacatggctacattgttcctggactcggagatgctggggatcgcttatttggtacaaaa

SEQ ID NO: 10064 - protein, 172 aa, Streptococcus agalactiae
MLMGYEVSRDLPLEDVEIQTPVATTVQKQLAGKKLAIVPILRAGIGMVDGFLSLVPAAKVGHIGMYRDEETFQPVEYLVKLPEDIDQRQIFVVDPMLATGGSAILAVDSLKKRGAASIKFVCLVAAPEGVAALQEAHPDVDIYTAALDEKLNEHGYIVPGLGDAGDRLFGTK

SEQ ID NO: 10065 - DNA, 1425 bp, Streptococcus agalactiae
atgattcgtttccttctctcaaaacttttgctaattgaagctgctcttctagcgattcctctaactgttggacttatttaccgtgaaccgcaaagtgtcatgatgagtatagtcattaccatgattattttaatcatccttggattactgggttctctctttaaacctaaaaattatcatatctacactaaagaaggcatgttaattgttgcactctgctggatactttggtccttctttggcgcccttccatttgttatttcagggcaaatccctaatattatcgatgctttctttgaagtatcttctggttttacgacaacaggagcaactattcttgatgacgtcagtgtcttatcacccgcgctcttattttggcgtagctttacccatcttatcggtggaatgggggttttagtatttgcccttgccatcatggaaaattctaaaaatagccatttagaggttatgagagctgaagttcctggacctgtatttggtaaagttgtctcgaaacttaaaaaaactgcacaaattttgtatttgttatatcttcttatgtttgcagtatttgcagtaatattatattttgcaggtatgcctttctttgatagtattatcatagcgatgggaactgcaggtacaggtggttttgcagtttacaatgatagcattgctcattataatagtcctctgataactaacttagtttctattggtatgcttatcttcggggttaactttaatctttactatcttcttttactccgaaaaattaaagcattctttggtgatgaggaactaaaaacctatctccgcatcgtggcaatagcaactttcatgattgctctaaacgtcatcggtatgtatgataattttcgacaaggcctcgaacatattttctttgaagtatcagctattattacgacaactggttttggcgtgactgatatcactcgttggcctttgttttcacaggttattttgctattcttgatgtttatcggtggttctgctggctctacagctgggggctttaaagtcatgcgtagcttaatcctagcaaagattgcacgtaaccaagtattgtctacactctatcctaatagagtcatgtcactacacattaataaaagcgttctagataaaaatacacaacatggtgttttaaaatatctaactatctatttagctatcttcatggcactcgttcttgttttaacgcttgatactaatgattttttggttgttatcagtgctgcagcctcatgttttaacaacataggcccactcttaggtagcaatgaaactttctcattctttagtccattctcaaaactccttctttcatttgctatgatagcaggacgtttagaaatataccctgttttattgatgtttattcctaaaacatggtcaaaacta

SEQ ID NO: 10066 - protein, 475 aa, Streptococcus agalactiae
MIRFLLSKLLLIEAALLAIPLTVGLIYREPQSVMMSIVITMIILIILGLLGSLFKPKNYHIYTKEGMLIVALCWILWSFFGALPFVISGQIPNIIDAFFEVSSGFTTTGATILDDVSVLSPALLFWRSFTHLIGGMGVLVFALAIMENSKNSHLEVMRAEVPGPVFGKVVSKLKKTAQILYLLYLLMFAVFAVILYFAGMPFFDSIIIAMGTAGTGGFAVYNDSIAHYNSPLITNLVSIGMLIFGVNFNLYYLLLLRKIKAFFGDEELKTYLRIVAIATFMIALNVIGMYDNFRQGLEHIFFEVSAIITTTGFGVTDITRWPLFSQVILLFLMFIGGSAGSTAGGFKVMRSLILAKIARNQVLSTLYPNRVMSLHINKSVLDKNTQHGVLKYLTIYLAIFMALVLVLTLDTNDFLVVISAAASCFNNIGPLLGSNETFSFFSPFSKLLLSFAMIAGRLEIYPVLLMFIPKTWSKL

SEQ ID NO: 10067 - DNA, 792 bp, Streptococcus agalactiae
atggatagtaggcctattggctttctagattctggtgtaggtggtttaacggttgttaaggaaatgttccgtcaacttccagaagaggaagtaatcttcattggagatcaggctagagctccgtatggtcctagacctgctcaacagattagagagtttacctggcagatggttaacttcttattgactaaaaatgttaagatgattgttatagcttgtaatacagcaactgcagttgcctggcaagaaattaaagaaaaactagacatccctgttttaggcgttattttaccaggagctagcgcagctatcaaatcaactaatttagggaaagttggtattataggtactcccatgactgttaaatcagatgcttatcgtcaaaaaattcaagctttgtctccaaatactgctgtggtatcccttgcttgtccgaaatttgttccaattgtggaatcaaatcagatgtcttctagtttagccaaaaaggtggtttatgaaacgttgtccccattagttggtaaattagatactttaattttaggttgcacgcattatcccctattacgtcccatcattcaaaatgttatgggggctgaggttaaattaattgatagtggcgcagaaaccgttcgtgatatttctgttttattgaactattttgagataaaccataattggcaaaataaacacggtggtcatcacttttacacaaccgccagcccaaaaggttttaaagaaattgcagaacaatggcttagtcaagaaataaatgtggagcgtatcgtatta

SEQ ID NO: 10068 - protein, 264 aa, Streptococcus agalactiae
MDSRPIGFLDSGVGGLTVVKEMFRQLPEEEVIFIGDQARAPYGPRPAQQIREFTWQMVNFLLTKNVKMIVIACNTATAVAWQEIKEKLDIPVLGVILPGASAAIKSTNLGKVGIIGTPMTVKSDAYRQKIQALSPNTAVVSLACPKFVPIVESNQMSSSLAKKVVYETLSPLVGKLDTLILGCTHYPLLRPIIQNVMGAEVKLIDSGAETVRDISVLLNYFEINHNWQNKHGGHHFYTTASPKGFKEIAEQWLSQEINVERIVL

SEQ ID NO: 10069 - DNA, 564 bp, Streptococcus agalactiae
atgtttccacaaaatatgattgccatcatgcaaaaaatgccagggttgtattttggagcaatcatcttagaattggttttagtctttgttgctagtggagcggcgcgtcgaaacacaccagctgcattaccattatttttgatttattcagctttgaatgggtttactttaagtttcattatcgcaaggtacacgcaaactacagttcttcaagcttttataacatctgcggctgttttctttgcaatggctttgattggagctaagactaaaaaagatttatcaggtatgcgtaaagcgttaatggctgctttaattgggattttaattgcaagtcttgttaatttatttatcggtagtgggggtatgagttatatcattagtatcgtatgtgtcatcatcttttctggattgattgcttacgataaccaaatgattaaatatgtctacaatagccaaggcggccaagtcgcagatggttgggcagtttcgatggcactaagcctttatcttgattttattaatctattcttaaatattcttcgtctttttgcacgaaatgat

SEQ ID NO: 10070 - protein, 188 aa, Streptococcus agalactiae
MFPQNMIAIMQKMPGLYFGAIILELVLVFVASGAARRNTPAALPLFLIYSALNGFTLSFIIARYTQTTVLQAFITSAAVFFAMALIGAKTKKDLSGMRKALMAALIGILIASLVNLFIGSGGMSYIISIVCVIIFSGLIAYDNQMIKYVYNSQGGQVADGWAVSMALSLYLDFINLFLNILRLFARND

SEQ ID NO: 10071 - DNA, 501 bp, Streptococcus agalactiae
atgaaaaagtatcaagacgataaggacttcatggatttggtcggtcaccttattgaccatccacgtttccaaaaactcgaagctattgtccaacatcatcactcaactcgcttagagcattctataaatgttagttatacaagttataaaattgctaagaagtttggttgggatgcgagtagtactgctcgaggtggtttactacatgatttcttttattatgattggcgtgtaacgaaatttaacaagagccatgcctgggttcatccaaggatagcggttcgtaatgcgcgaaaattaactgatttaaacgctagagaagaagatattattttgaagcacatgtggggagcgactattgcaccgccacgttataaagaaagttatattgtgactatggttgataagtattgggcagtacgagaggcttctcgtccactcaaacgtatttttaagaaacctatccgttttagtcgcaaattcttaggtagtcataatcat

SEQ ID NO: 10072 - protein, 167 aa, Streptococcus agalactiae
MKKYQDDKDFMDLVGHLIDHPRFQKLEAIVQHHHSTRLEHSINVSYTSYKIAKKFGWDASSTARGGLLHDFFYYDWRVTKFNKSHAWVHPRIAVRNARKLTDLNAREEDIILKHMWGATIAPPRYKESYIVTMVDKYWAVREASRPLKRIFKKPIRFSRKFLGSHNH

SEQ ID NO: 10073 - DNA, 276 bp, Streptococcus agalactiae
atgaaaaaagttcatttaattgtctcagggcgcgttcaaggagtcggatttcgctatgcaacttattccttagctttagaaataggtgatatttacggtcgcgtttggaataacgatgatggaactgttgaaattttagcacaatctacagattcaaataaaatgacacaatttattcagaaaattcgaaaaggaccttcaaaatggtctaaagtaacttatgttgatattaaactagataacttcgatgattttaatgactttaaaatgagtaat

SEQ ID NO: 10074 - protein, 92 aa, Streptococcus agalactiae
MKKVHLIVSGRVQGVGFRYATYSLALEIGDIYGRVWNNDDGTVEILAQSTDSNKMTQFIQKIRKGPSKWSKVTYVDIKLDNFDDFNDFKMSN

SEQ ID NO: 10075 - DNA, 798 bp, Streptococcus agalactiae
atggccaacctcattacttatttcgctcaacaccaagggcttggttttggtgtcgctatcattattgtaaccgtcatcgtacgtgtcgttatcttaccacttggactttatcagtcttggaaagctagctatcaagctgaaaaaatggcatactttaagcctttatttgaacctattaatgaacgactacgcaatgctaaaacacaagaagaaaaattagcagctcagacagaattaatgacagctcaacgtgagaatggccttagcatgtttggcggtattggctgcttgccattactcattcagatgccatttttctcagctattttctttgctgcacgctatactcctggagtctctagtgcaaccttcttgggacttaacttaggtcaaaagagtctgacacttactgtcattatcgccattctttattttgtacaatcttggttgtcaatgcaaggtgttccagatgaacaacgtcagcaaatgaaaacaatgatgtatctgatgccaataatgatggtattcatgtctattagtttacctgctagtgttgcgctttattggtttattggtggtattttcagtattatccagcagctagttacgacttatgtacttaagcctaaactacgccgaaaagtagaagaagaatatactaaaaatcctcctaaagcctacaaagctaataacgcacgaaaagatgttacaaattcaactaaagccactgaatctaatcaagcaattattacatctaaaaaaacaaatcgtaacgccggaaaacaaaaaagacgggga

SEQ ID NO: 10076 - protein, 266 aa, Streptococcus agalactiae
MANLITYFAQHQGLGFGVAIIIVTVIVRVVILPLGLYQSWKASYQAEKMAYFKPLFEPINERLRNAKTQEEKLAAQTELMTAQRENGLSMFGGIGCLPLLIQMPFFSAIFFAARYTPGVSSATFLGLNLGQKSLTLTVIIAILYFVQSWLSMQGVPDEQRQQMKTMMYLMPIMMVFMSISLPASVALYWFIGGIFSIIQQLVTTYVLKPKLRRKVEEEYTKNPPKAYKANNARKDVTNSTKATESNQAIITSKKTNRNAGKQKRRG

SEQ ID NO: 10077 - DNA, 501 bp, Streptococcus agalactiae
atgattattagaaatggttgcctagaggatttacagcaagtcattagtattgaacaaataaatttttcagaagcagaggctgcgagtaaaaaagcaatgcaagaacgtttaacgataatgactgatacttttttagttgcagagattaatggtcgtttagcaggttacattgaaggaccggttattaaaggtcggtacttaacggacgatttattccataaagtttctgaattccctgtaagggtaggtggtttcataggaattactagtctatcaatacatcctgattttaaaggtcaggggattggtacagcattattagcagcgatgaaagacctggttgtttctcaagaacgagatggtataagtttaacttgccatgatgatttaatttccttctatgaaatgaatggatttaaagatgagggagaatctgactccaaacatggtggttcgctttggtataatatgatttggaataatccaacacgatcaatttgt

SEQ ID NO: 10078 - protein, 167 aa, Streptococcus agalactiae
MIIRNGCLEDLQQVISIEQINFSEAEAASKKAMQERLTIMTDTFLVAEINGRLAGYIEGPVIKGRYLTDDLFHKVSEFPVRVGGFIGITSLSIHPDFKGQGIGTALLAAMKDLVVSQERDGISLTCHDDLISFYEMNGFKDEGESDSKHGGSLWYNMIWNNPTRSIC

SEQ ID NO: 10079 - DNA, 711 bp, Streptococcus agalactiae
atgacaccccaagcattttatcaagttctgatagagcatggtattacacttactgacaaacagaaaaaacaatttgaaacttattttagacttcttgttgaatggaatgagaaaattaacctaacagctattacagataaggaagaggtttacttaaagcacttctatgattctattgcgccgattttacaaggttatattgacaatagtcctcttagcattttagatattggtgctggtgcaggttttcctagtattcctatgaaaatcctttatcctgaaattgatattactattattgattcactgaataaacgcattaattttctaaacatattagctaatgaacttgaactttcaggagttcacttcttccatgggcgcgctgaggactttggtcaagatagagtatttcgagctaaatttgatatcgtaacagctcgtgcagtagctaaaatgcaggttctagcagaattgacaataccttttcttaaagttaatggtcgcttgattgcactgaaagctgcagctgctgaagaggaattaatttctgcagaaaaagctttgaaaacactattttcacaagtaactgtaaataaaaattataagttacctaatggtgatgaccgaaatatcacaatcgttagcaagaaaaaagaaacgcctaataaataccctcgtaaagctggtactccaaacaagaagcctttg

SEQ ID NO: 10080 - protein, 237 aa, Streptococcus agalactiae
MTPQAFYQVLIEHGITLTDKQKKQFETYFRLLVEWNEKINLTAITDKEEVYLKHFYDSIAPILQGYIDNSPLSILDIGAGAGFPSIPMKILYPEIDITIIDSLNKRINFLNILANELELSGVHFFHGRAEDFGQDRVFRAKFDIVTARAVAKMQVLAELTIPFLKVNGRLIALKAAAAEEELISAEKALKTLFSQVTVNKNYKLPNGDDRNITIVSKKKETPNKYPRKAGTPNKKPL

SEQ ID NO: 10081 - DNA, 1377 bp, Streptococcus agalactiae
atgaaacatttctttgattacaagacaatgtctgtcgcacgtaaactcagcattagttttatcgctgttatcctattgggaagtattttactttcacttccaatttttcaatatgctaacgcccctaaaacacattacattgatcaccttttcacgactgtttcaatggtatgtgtaactggtttatctgtttttcctatcagtaaggtttataacggttgggggcagattgtagctattttactcatgcaaacagggggacttggtttagtaacactaatgtcgttgtcttactataccctaagacgtaaaatgtcgttaaatgatcagacccttttgcagtcagcgataacttataacagttcgacagatttaaaaaaatatctctatatgatttttaaagtaactttaactttagaagttttagcagccagcattttagccatagattttattcctcgatttggtttgggtcatggtatctttaatagtatattcttagctgtctcagccttttgtaatgccggttttgataatctagaggcaacgagcttagctcaatttaaactaaatcctttggttaacattatcgtttgtttcttgattatttcaggaggacttggatttgccgtatggaaagatttaattgaagctactatacaaacatctcacaagggaccaaaattaatcaagacatttccaaaacgcctcagcaaccattctaaactggttttaaaaacaacaaccattattttactaacaggaactttgctttcttggttgttagagtttggaaattttagaacaattgctaatttatctctacctaaacaactaatggtcagctttttccaaacagttacgatgcgtaccgctggattttcaactattgattatacccaaactgatttcgcaaccaaccttgtttatattatccaaatgttaattggaggagctcctggtggaacggcaggaggatttaaagtcactgttatcgccattttactcttactatttaaagccgaactgagtggccaaagccaagtgacttttcattatcgaacaattccttccagtattattaaacaaacactatcgattttaactttcttttttatcatacttattagcggctatctccttcttctggaactcaatccccatatagatcctttttctcttttctttgaggcatctagtgccttagcaaccgtgggtgtaacaatgaacactaccaatcaattaactctgggcggtcgaattgtaattatgttcctcatgtttattggtcgagtcggtccaattaccgtactgctatcaattcttcagaaaaaagagaaggaaattcactatgctgaaacagaaattattctaggt

SEQ ID NO: 10082 - protein, 459 aa, Streptococcus agalactiae
MKHFFDYKTMSVARKLSISFIAVILLGSILLSLPIFQYANAPKTHYIDHLFTTVSMVCVTGLSVFPISKVYNGWGQIVAILLMQTGGLGLVTLMSLSYYTLRRKMSLNDQTLLQSAITYNSSTDLKKYLYMIFKVTLTLEVLAASILAIDFIPRFGLGHGIFNSIFLAVSAFCNAGFDNLEATSLAQFKLNPLVNIIVCFLIISGGLGFAVWKDLIEATIQTSHKGPKLIKTFPKRLSNHSKLVLKTTTIILLTGTLLSWLLEFGNFRTIANLSLPKQLMVSFFQTVTMRTAGFSTIDYTQTDFATNLVYIIQMLIGGAPGGTAGGFKVTVIAILLLLFKAELSGQSQVTFHYRTIPSSIIKQTLSILTFFFIILISGYLLLLELNPHIDPFSLFFEASSALATVGVTMNTTNQLTLGGRIVIMFLMFIGRVGPITVLLSILQKKEKEIHYAETEIILG

SEQ ID NO: 10083 - DNA, 561 bp, Streptococcus agalactiae
atgggattgttaggaggtttattccttgttttaactagtcctagaggagttattgctaataaattagtatttggagttttagataaagttgtttctgtttttagagctctgcccttcattattcttcttgctttgattgcgccagtaactcgcgtaattgtaggaacaacacttggttcaccagcagctttggtacctctttctttggcagttttcccattttttgctcgtcaagttcaagttgttttagctgaacttgatggtggagttattgaggctgcacaagcctcaggtggaacactttgggatattattgtagtttatcttcgtgaaggtctaccagatttaattcgagtatcaacggttactttgatttctttagtaggtgaaacagctatggctggcgctattggtgcaggaggattgggttctgttgctattactaaaggatataactattctcgtgatgatattactttagtagcgactattctgattttattattaattttctttatccaatttttaggtgattttttaacacgtcgcttgagtcataaa

SEQ ID NO: 10084 - protein, 187 aa, Streptococcus agalactiae
MGLLGGLFLVLTSPRGVIANKLVFGVLDKVVSVFRALPFIILLALIAPVTRVIVGTTLGSPAALVPLSLAVFPFFARQVQVVLAELDGGVIEAAQASGGTLWDIIVVYLREGLPDLIRVSTVTLISLVGETAMAGAIGAGGLGSVAITKGYNYSRDDITLVATILILLLIFFIQFLGDFLTRRLSHK

SEQ ID NO: 10085 - DNA, 714 bp, Streptococcus agalactiae
atgggacgtaagtgggccaatattgttgccaaaaagactgctaaagatggtgctaactcaaaagtatacgctaaattcggtgttgaaatatatgttgctgcaaagcaaggtgaaccagaccccgagtcaaactcagctctaaaattcgttttggaccgtgctaagcaagcacaagttccaaagcatgttattgataaagcgattgataaagccaaaggaaacacagatgaaactttcgtagagggacgctatgaaggttttggtccaaatggttcaatgattattgtggatactttgacatcaaatgttaaccgtacggcagcaaatgtacgtactgcttacggtaagaacggtggcaatatgggagcttcaggatcggtatcctacttatttgataaaaaaggtgtcatcgtttttgctggtgatgatgctgacactgtcttcgaacaattacttgaagcggatgtagacgtagatgatgttgaagcagaagagggaacaataacagtttataccgccccaacagatcttcataaaggtatccaagcacttcgcgataatggtgtagaagaattccaagttactgaacttgaaatgattcctcaatcagaagtagtattggaaggtgatgaccttgaaacttttgaaaagcttattgacgcactcgaatcagatgatgatgttcaaaaagtttatcataatgtagcagatttc

SEQ ID NO: 10086 - protein, 238 aa, Streptococcus agalactiae
MGRKWANIVAKKTAKDGANSKVYAKFGVEIYVAAKQGEPDPESNSALKFVLDRAKQAQVPKHVIDKAIDKAKGNTDETFVEGRYEGFGPNGSMIIVDTLTSNVNRTAANVRTAYGKNGGNMGASGSVSYLFDKKGVIVFAGDDADTVFEQLLEADVDVDDVEAEEGTITVYTAPTDLHKGIQALRDNGVEEFQVTELEMIPQSEVVLEGDDLETFEKLIDALESDDDVQKVYHNVADF

SEQ ID NO: 10087 - DNA, 519 bp, Streptococcus agalactiae
atgacttgtgcacttttactaattgatatccaacaaggtattatggataagaaaccaaagcatttaacaaattttgcagtgcttttagatgatttacttttaagtgccaaaggttctaattgtgaagtgatatggataaggcatcatgataaggaattgcctcaaggttctccacagtgggaaatttgggaacagcgacatcttgtgacgcatcacaaaataattgataaaacttacaatagttgttttaaagatactcatttacatgattacttgcaaagtaagcatattagtcaattaatcatgatgggacttcaaacagaatactgttttgatacatcagtaaaagttgcttttgaatatggttatgatatctttattccacaaggtggacacctaacatttgatacaccaactttaagtggggattctattaaaaaacattacgagaatatttggcatcatcgttttgcgacaatggtagcaaaagatagcttattgaaattaataaacgaggaa

SEQ ID NO: 10088 - protein, 173 aa, Streptococcus agalactiae
MTCALLLIDIQQGIMDKKPKHLTNFAVLLDDLLLSAKGSNCEVIWIRHHDKELPQGSPQWEIWEQRHLVTHHKIIDKTYNSCFKDTHLHDYLQSKHISQLIMMGLQTEYCFDTSVKVAFEYGYDIFIPQGGHLTFDTPTLSGDSIKKHYENIWHHRFATMVAKDSLLKLINEE

SEQ ID NO: 10089 - DNA, 630 bp, Streptococcus agalactiae
atggcactcgaattgctaacaccatttacaaaagttgaattagaagagaaaaagcgagatactaaccgaaaacaaattggaattatgggaggaaattttaaccctgttcataacgcccaccttgttgttgcagatcaagtacgtcagcaattgtgtttagaccaagttctgttgatgcctgaatttcagccaccacatattgataaaaaagagacaattgatgaacagcatcgtctcaagatgcttgaattagcaatagaaggcattgatggtttatctattgaaccaattgaaattgaacgtaaaggtatcagctatacatacgatacgatgaagcttctaattgaaaaaaatccagatgttgattattatttcattattggggcagatatggtggaatatctacctaagtggcatcgtattgatgaacttgttaaaatggtgcagtttgttggtgttcaacgtccaaaatataaagctggtacatcatatcccgttatttgggtggatctgccattgatggatatctcatcaagtatgattcgtcaatttattaaaagtaatcgtcagcccaactatttactgcctagagaggtattagattatatcaggaaagaaggtctttacaaa

SEQ ID NO: 10090 - protein, 210 aa, Streptococcus agalactiae
MALELLTPFTKVELEEKKRDTNRKQIGIMGGNFNPVHNAHLVVADQVRQQLCLDQVLLMPEFQPPHIDKKETIDEQHRLKMLELAIEGIDGLSIEPIEIERKGISYTYDTMKLLIEKNPDVDYYFIIGADMVEYLPKWHRIDELVKMVQFVGVQRPKYKAGTSYPVIWVDLPLMDISSSMIRQFIKSNRQPNYLLPREVLDYIRKEGLYK

SEQ ID NO: 10091 - DNA, 531 bp, Streptococcus agalactiae
atgaaattgagtatagatgattataggccgaccttcgtggttgaggcagtttatgatttaagagcagaagatttattacgtcatggcattcgtgcggttttagttgatttagataatacactcattgcttggaataatccagatggtactgctgaggtgcgtgcatggttagatgagatgacaacagcggatatttcagttgtagtagtgtctaataacaatcatgctcgcgtagaacgtgcagtatcacgttttggtgtggattttgtaagtcgtgcgatgaaaccatttactcgtggtataaacatggcaattgagcgttatggctttgatcgtgacgaggtgattatggttggagatcaattgatgacagatattcgtgctagtcatcgcgcaggaataaagtccgtattggtaaaaccaattgttaaatctgatgcttggaataccaagttcaatcgcttacgtgaacgtcgcgtttggaaaaaaatagaagagaattacggtaaaatcgtatatcaaaaaggaatt

SEQ ID NO: 10092 - protein, 177 aa, Streptococcus agalactiae
MKLSIDDYRPTFVVEAVYDLRAEDLLRHGIRAVLVDLDNTLIAWNNPDGTAEVRAWLDEMTTADISVVVVSNNNHARVERAVSRFGVDFVSRAMKPFTRGINMAIERYGFDRDEVIMVGDQLMTDIRASHRAGIKSVLVKPIVKSDAWNTKFNRLRERRVWKKIEENYGKIVYQKGI

SEQ ID NO: 10093 - DNA, 885 bp, Streptococcus agalactiae
atgaccttagctgccggactagcatggggcatttctggaattagtggtcaatacttgatgtcgcacggagtacacgttaaccttttgacttctttacgattgttgataacaggtatctttctcttgtctttagctagatcaaaacaaaaggagcatttagtagcagcgtggaaacagccaaaatttttaaagcaggttttacttttttctatatttggtttagttttaaatcaatatgcttttctcagagcgattcatttaacaaatgctggaactgcaacggttttgcaatatatggcaccaatacttattttgagtattgtttgtatcctaaacagacaaagaccaacatcttttgaaataatagcaattgctatggcaattttaggaacctatatgattgcaacgcatgggaagttaggaagtttagctatcacaccgaaaggattaatgtgggggcttggttccgccattacttattctatttatattttattacctgtgaaacttattcatgaatggggaagtacgattgttattggttcaggaatgtttataggtgggattttatttagtttggtgacaaaagcgtggcaataccccttacaaattaatgtgatgagtatacttgcttatattggcattattggtattgggactatttttgcttacacttttttccttaaaggggttagtattgtaggtgctgtcaagggtagcttattagcatcggtagagccagtttcttcggtatttttgacagtacttgttttaggagaaattttttatccaatagatttacttgggatgctgtttatttttcttgctgtaactctaatctcttacaaagatttaattgcattgaagaaaatgaaacgagtaaga

SEQ ID NO: 10094 - protein, 295 aa, Streptococcus agalactiae
MTLAAGLAWGISGISGQYLMSHGVHVNLLTSLRLLITGIFLLSLARSKQKEHLVAAWKQPKFLKQVLLFSIFGLVLNQYAFLRAIHLTNAGTATVLQYMAPILILSIVCILNRQRPTSFEIIAIAMAILGTYMIATHGKLGSLAITPKGLMWGLGSAITYSIYILLPVKLIHEWGSTIVIGSGMFIGGILFSLVTKAWQYPLQINVMSILAYIGIIGIGTIFAYTFFLKGVSIVGAVKGSLLASVEPVSSVFLTVLVLGEIFYPIDLLGMLFIFLAVTLISYKDLIALKKMKRVR

SEQ ID NO: 10095 - DNA, 1239 bp, Streptococcus agalactiae
atggatatccatcaaaacatgcattttgatcgtaaaaattatttctatccagataatcctaaagcttatcaaatttcacagtttgatgagcctattggttacaatggttggattgaaatcgaattagaagatggtacacgaaaaaaaattcgtattgagcgtgcccacctcgaagaagatgcaggaaaaaatacacatgggacagatggttattcctatgttgaccttaatagacaaggtgttccactgattgaaattgtatcagaagctgatatgcgttctcctgaggaagcttatgcttatttgacagctctcaaagagattatccaatatactggaatttctgacgttaaaatggaagaaggttctatgcgtgtagatgccaatatttcacttcgtccttatggtcaagaagagtttggtactaaagcagaacttaagaaccttaactcattcaataatgtacgtaaaggtttgatacatgaagaaaaacgtcaagcacaagttttacgatctggtggtcaaattcagcaagagactcgtcgttttgatgaaacaacaggtgagactattttgatgcgtgtcaaggaaggctcatcagattatcgctatttccctgaaccagatttaccactatttgatatctcggatgaatggattgatcaagttcgtttagaattaccagaatttccacaggaacgtcgtgcgaaatatgtatcgtcttttggtctatcatcttatgatgctagccaattaacagctacaaaagcaacttctgatttctttgaaaaagctgttgctattgggggtgatgcaaaacaagtttccaattggttacaaggagaagtggcgcaatttcttaacagtgaatcaaaatcaatcgaagaaattggtctgactcctgagaatttggttgagatgattggcttgattgctgacggtacaatttcatccaaaattgctaaaaaagtttttgtgcatttagctaaaaatggtggttcagctgaagaattcgttaaaaaggctggtttagttcaaatttcagatcctgaagtattaatcccaattattcatcaagtctttgcagataatgaagctgctgtgattgactttaagtcaggaaaacgcaatgctgataaggccttcacaggttatctaatgaaagcaacaaaaggacaagctaatccacaagttgctctgaagctgttagcgcaagaattagcaaaattaaaagaagaa

SEQ ID NO: 10096 - protein, 413 aa, Streptococcus agalactiae
MDIHQNMHFDRKNYFYPDNPKAYQISQFDEPIGYNGWIEIELEDGTRKKIRIERAHLEEDAGKNTHGTDGYSYVDLNRQGVPLIEIVSEADMRSPEEAYAYLTALKEIIQYTGISDVKMEEGSMRVDANISLRPYGQEEFGTKAELKNLNSFNNVRKGLIHEEKRQAQVLRSGGQIQQETRRFDETTGETILMRVKEGSSDYRYFPEPDLPLFDISDEWIDQVRLELPEFPQERRAKYVSSFGLSSYDASQLTATKATSDFFEKAVAIGGDAKQVSNWLQGEVAQFLNSESKSIEEIGLTPENLVEMIGLIADGTISSKIAKKVFVHLAKNGGSAEEFVKKAGLVQISDPEVLIPIIHQVFADNEAAVIDFKSGKRNADKAFTGYLMKATKGQANPQVALKLLAQELAKLKEE

SEQ ID NO: 10097 - DNA, 495 bp, Streptococcus agalactiae
atgctaggtatcatagatgcaaaacctaaggttggttatttttatttaggacagtatcatgcttcaatagggacaagtcattttgaaaagatgacagtttcagaaattatggggatccctctgacagttcatcaaaaagattcagtttatgatgttattgtacatatttttatggaagatgctggttgtgcttttatcttggatgatgatgattttctctgtggagtcgtgtcacgtaaagatttactaaaaatcagtattggcggaggagatctttctaaaatgccaataggaatggtgatgacacgtatgccacacgtgacaactgttttagaaaatgaaagtctttttgcggcagctgataaattagtgagcagaaaagtggatagtctccctgtcgttcgtcatgataagcaatatcccgaaaaatttaaagtgatcgggaaattatctaaaacaatcctcgctagtttgtttttagaaataagagattat

SEQ ID NO: 10098 - protein, 165 aa, Streptococcus agalactiae
MLGIIDAKPKVGYFYLGQYHASIGTSHFEKMTVSEIMGIPLTVHQKDSVYDVIVHIFMEDAGCAFILDDDDFLCGVVSRKDLLKISIGGGDLSKMPIGMVMTRMPHVTTVLENESLFAAADKLVSRKVDSLPVVRHDKQYPEKFKVIGKLSKTILASLFLEIRDY

SEQ ID NO: 10099 - DNA, 783 bp, Streptococcus agalactiae
atgccgaatttattagaaaaaactagaaaaattacatccatcttacagcgttccgtagatagcttagatgccgaactaccatataatacaatggcggctcaattagctgatattattgactgtaacgcatgtattattaatggtggtggtaacttacttggctatgccatgaaatataaaacaaacactgaccgtgtggaagaattttttgaaacaaaacaattcccagattactatgttaaatctgctagtcgtgtttatgatacagaagctaacttatcagtagataatgatttgtcaattttcccagttgagacaaaggaaaacttccaagatggtattacaacaatcgctccaatttatggtggtggaatgcgcttgggaacatttattatctggcgtaatgataaagaatttagcgacgatgatttgattttagttgaaattgcaagcaccgttgttggtattcaattacttaaccttcaaacagaaaatctagaagaaaatattcgtaaacaaacagcggtgacaatggctatcaacactctatcttattcagaaatgaaagctgtagctgctatcttaggagaattagatggacttgaaggacgcctaacggcatctgttattgcagaccgtattggaattacacgttccgttattgtaaatgctcttcgtaaattggagtctgcgggaatcattgagagccgctcactcggtatgaagggaacatacctcaaagttattaacgaaggtatttttgacaaattaaaagaatataat

SEQ ID NO: 10100 - protein, 261 aa, Streptococcus agalactiae
MPNLLEKTRKITSILQRSVDSLDAELPYNTMAAQLADIIDCNACIINGGGNLLGYAMKYKTNTDRVEEFFETKQFPDYYVKSASRVYDTEANLSVDNDLSIFPVETKENFQDGITTIAPIYGGGMRLGTFIIWRNDKEFSDDDLILVEIASTVVGIQLLNLQTENLEENIRKQTAVTMAINTLSYSEMKAVAAILGELDGLEGRLTASVIADRIGITRSVIVNALRKLESAGIIESRSLGMKGTYLKVINEGIFDKLKEYN

SEQ ID NO: 10101 - DNA, 411 bp, Streptococcus agalactiae
atgtcacaaaaatatgaacgcatccttgtcgctattgatggatcaacagaatctgaacttgcttttgaaaaggcagttaacgttgctcttcgcaatgattctgaattaatcttgacacatgttatagatacacgtgctttacaaagctttgcgacatttgatacttatatctatgaaaaattagaaaaagaagcaaaagatgtccttgaggaatatgaaaaacaagctcgtgaaaaaggagcagataaagttagacaagtcattgaatttggtaatcccaaaacattacttgcacatgatattccagaaaaagaaaaagtagacttgattatggttggtgcaacaggtcttaatacctttgaacgtttcctatcggatcttcctcagaatacatccttcgtcacgctaaag

SEQ ID NO: 10102 - protein, 137 aa, Streptococcus agalactiae
MSQKYERILVAIDGSTESELAFEKAVNVALRNDSELILTHVIDTRALQSFATFDTYIYEKLEKEAKDVLEEYEKQAREKGADKVRQVIEFGNPKTLLAHDIPEKEKVDLIMVGATGLNTFERFLSDLPQNTSFVTLK

SEQ ID NO: 10103 - DNA, 891 bp, Streptococcus agalactiae
atgtccagcgccgataacccaatgaaatacgttgatttatcattagatgaccttgatttgactgttgtagattttctaaatcttcccagtcctcaaatcacccctcatcatatgcttgatatctatcactatctgaagcaacatgccagtaattttgatggtgttgtcattacgcatgggactgacactttagaagaaacagcatattttttagacacaatgatactccctaaaatcccaatcatcattaccggtgctatgagaagcacaaatgaacttggtagcgatggcgtttataattacctatcagccctccgtgtcgctaatagtactaaagctgccgacaagggggtgctagttgtcatgaatgatgagatacatgctgctaaatatgtcacaaaaacacatacaacaaacgtttcgacattccaaacccctacacatggcccccttgggattattatgaaacaagacctgcttttctttaaagcaactgaagagagagttcgttttgatttagataaaattacaggaactgttcctatcgtgaaagcatatgctggcatgggtgatagtggtatcattagctttttaaattctcaaaatattagcggattagttattgaagcactcggtgcagggaatatgcccccaaaagctgcacaagaaatcgaagaattaattgagcaaggtgtccctgttgttctagtgtctcgctgttttaatggtattgctgagccagtttacggatatgaaggtggcggagcaaaattacaagaatctggtgtcatgtttgttaaagaactaaacgctcccaaagccagactcaaattactcattgcactcaatgcaggtctcacagggcaaaatctaaaagactatattgaaggt

SEQ ID NO: 10104 - protein, 297 aa, Streptococcus agalactiae
MSSADNPMKYVDLSLDDLDLTVVDFLNLPSPQITPHHMLDIYHYLKQHASNFDGVVITHGTDTLEETAYFLDTMILPKIPIIITGAMRSTNELGSDGVYNYLSALRVANSTKAADKGVLVVMNDEIHAAKYVTKTHTTNVSTFQTPTHGPLGIIMKQDLLFFKATEERVRFDLDKITGTVPIVKAYAGMGDSGIISFLNSQNISGLVIEALGAGNMPPKAAQEIEELIEQGVPVVLVSRCFNGIAEPVYGYEGGGAKLQESGVMFVKELNAPKARLKLLIALNAGLTGQNLKDYIEG

SEQ ID NO: 10105 - DNA, 912 bp, Streptococcus agalactiae
atgttacaaaacattggacaaacaggcattcaagcaactcgaattgctttaggttgtatgagaatgagtgacttgaaaggaaaacaagctgaagaagtagttggaacagcattagatttgggtattaatttttttgatcatgctgatatttatgggggagggctatctgaattacgctttcgagatgcaatcaaacatttaaatgtcaatcgtgacaaaatgattattcaatctaaatgtgggatacgagaaggttactttgatttttctaaagagtatattttatcatcagtagatggtattttagaaagattagggacagaatatttagattttctcattcttcatcgtccagatgtattagttgagcctgaagaagtagcagaagcatttaccaaactgagggcagaaggtaaagtaaaacactttggtgttagcaatcaaaaccggtttcaaatggagttgttacaatcctaccttgacgagcccttagcagtgaatcaacttcagttatcgccagcacatacaccaatgtttgatgcagggttaaatgttaacatgttaaataaagcttcaattgaacatgatgatggcattgttgattattgtcgtcttaaaagagttaccattcaagcttggtctccatttcaaattgatttatctcgtggtttatttgttaatcatccggattataaggaattaaatgaaaccatagctaaactggcaaaaaactacaatgttagcagcgaagctattgtgattgcatggattttacgtcatcctgccaaaatgcaggcgattgttggttcaatgaatccatctcgtttaaaggcgattgataaggctaatgatatcgctttaacccgtaaagaatggtatgatatttaccgtagtgcaggtaatatattgcct

SEQ ID NO: 10106 - protein, 304 aa, Streptococcus agalactiae
MLQNIGQTGIQATRIALGCMRMSDLKGKQAEEVVGTALDLGINFFDHADIYGGGLSELRFRDAIKHLNVNRDKMIIQSKCGIREGYFDFSKEYILSSVDGILERLGTEYLDFLILHRPDVLVEPEEVAEAFTKLRAEGKVKHFGVSNQNRFQMELLQSYLDEPLAVNQLQLSPAHTPMFDAGLNVNMLNKASIEHDDGIVDYCRLKRVTIQAWSPFQIDLSRGLFVNHPDYKELNETIAKLAKNYNVSSEAIVIAWILRHPAKMQAIVGSMNPSRLKAIDKANDIALTRKEWYDIYRSAGNILP

SEQ ID NO: 10107 - DNA, 2526 bp, Streptococcus agalactiae
atggcaaatattctacgcactgttattgaaaatgacaagggtgaattaaaaaaattagataaaatagctaagaaagttgactcttacgcagatcatatggctgcgttatcagatgaagctttacaagcaaaaactccagaatttaaagaacgttatcaaaatggtgaaactttagatcaattgttaccggaagcgtttgcggtagttcgtgaagcttctaaacgtgtattaggtttatacccataccacgtccaaattatgggtggtatcgttcttcaccatggtgatattccagaaatgcgtactggtgagggaaaaactttaacagcgacaatgcctgtttatctaaatgctatctcaggattaggtgttcatgttattactgttaatgagtatttatcaacacgtgatgcgaccgaaatgggtgaggtttatagttggcttggattatctgtagggattaacttagcagctaagtcaccatttgaaaaacgcgaagcttacaattgtgatatcacatactcaactaacgcagaagtcggatttgactaccttcgagacaatatggttgttcgccaagaagatatggtgcaacgcccactcaactatgctttggttgatgaggttgactctgtattaatcgatgaagctaggacgccattgattgtttcaggtcctgtaagctctgagatgaaccaactgtatacacgtgcggacatgtttgtaaaaacgcttaatagcgatgattatatcattgatgttccaacaaaaacaattggtttatcagatacaggtattgacaaggctgaaaactatttccatctaaataacttgtatgatctcgaaaatgttgccttaactcactacattgataacgctcttcgagctaactatattatgttgttaaatattgattatgtggttagtgaagaacaagagattttaattgtggaccaatttaccggtcgtacgatggaaggacgtcgtttctcagatggcttacaccaagctattgaagcaaaagagtcagtgccaatccaagaagaatcaaaaacgagcgcttcaattacttaccaaaatatgttccgtatgtaccataaattagcaggaatgactggtactggtaagactgaggaagaagagtttcgtgaaatttataatatgcgcgttattcctatcccaacaaatcgtcctgttcaacgtatagatcattcagatctactttatccaactcttgactctaaatttagagcggtggtagcagatgtcaaagaacgttatgaacaaggacaacctgtactggttggtacagtagctgttgaaacgtcagacttaatttctagaaaattagttgctgctggagtaccacatgaagttttgaatgctaaaaatcactttaaagaagctcaaatcattatgaatgctgggcaacgtggtgctgttacaatcgcaaccaacatggctggtcgtggtactgatatcaagcttggtgaaggggttcgtgaacttggtggtttatgtgttattggtacagagcgtcatgaaagccgtcgtattgataaccagcttcgtggtcgttcgggtcgtcaaggagatccaggtgaatcacaattctatctttcgttagaagatgatttgatgcgtcgctttggtacagatcgtattaaagtggttcttgagcgaatgaatttagctgaagatgatacagttattaaatcaaaaatgttgacacgacaagttgaatcagctcaacgccgcgttgaaggtaataactatgacacacgtaaacaagtcttgcaatacgatgatgttatgcgtgaacaacgtgagattatttatgctaaccgtagagaagtgattactgctgagcgtgatttaggaccagagctcaaagggatgattaaacgtacgattaaaagagcagttgatgcacatagcagaagcgataaaaatactgcagcagaagctattgttaattttgcaagatcggcgttattagatgaagaagctatcacagtttcagaacttcgtggtctaaaagaggctgaaattaaagaacttctttatgaacgtgccttagctgtttatgagcaacaaattgctaaattaaaagatccagaagctattatcgaattccaaaaagtcttaatcttgatggtagtggataatcaatggacagagcatattgatgccttagatcaattacgtaactccgttggacttcgtggttatgctcaaaataacccaatcgttgagtatcaatcagaaggtttccgtatgttccaagatatgattggttcgattgagtttgatgtgacacgtacattgatgaaagctcaaattcatgaacaagagcgtgaacgtgcttctcaacatgctacgacaacagcagagcaaaatatctcggcacaacatgtacctatgaataatgaatcaccagaataccaagggattaaacgtaatgataaatgtccttgtggctctggcatgaagtttaaaaattgtcatggtctgagatgtttacaa

SEQ ID NO: 10108 - protein, 842 aa, Streptococcus agalactiae
MANILRTVIENDKGELKKLDKIAKKVDSYADHMAALSDEALQAKTPEFKERYQNGETLDQLLPEAFAVVREASKRVLGLYPYHVQIMGGIVLHHGDIPEMRTGEGKTLTATMPVYLNAISGLGVHVITVNEYLSTRDATEMGEVYSWLGLSVGINLAAKSPFEKREAYNCDITYSTNAEVGFDYLRDNMVVRQEDMVQRPLNYALVDEVDSVLIDEARTPLIVSGPVSSEMNQLYTRADMFVKTLNSDDYIIDVPTKTIGLSDTGIDKAENYFHLNNLYDLENVALTHYIDNALRANYIMLLNIDYVVSEEQEILIVDQFTGRTMEGRRFSDGLHQAIEAKESVPIQEESKTSASITYQNMFRMYHKLAGMTGTGKTEEEEFREIYNMRVIPIPTNRPVQRIDHSDLLYPTLDSKFRAVVADVKERYEQGQPVLVGTVAVETSDLISRKLVAAGVPHEVLNAKNHFKEAQIIMNAGQRGAVTIATNMAGRGTDIKLGEGVRELGGLCVIGTERHESRRIDNQLRGRSGRQGDPGESQFYLSLEDDLMRRFGTDRIKVVLERMNLAEDDTVIKSKMLTRQVESAQRRVEGNNYDTRKQVLQYDDVMREQREIIYANRREVITAERDLGPELKGMIKRTIKRAVDAHSRSDKNTAAEAIVNFARSALLDEEAITVSELRGLKEAEIKELLYERALAVYEQQIAKLKDPEAIIEFQKVLILMVVDNQWTEHIDALDQLRNSVGLRGYAQNNPIVEYQSEGFRMFQDMIGSIEFDVTRTLMKAQIHEQERERASQHATTTAEQNISAQHVPMNNESPEYQGIKRNDKCPCGSGMKFKNCHGLRCLQ

SEQ ID NO: 10109 - DNA, 714 bp, Streptococcus agalactiae
atgattattttgattattgcactggcaactattttgacatttgtcacatggatgttgattcgtccaaaagctctacggtatattctaggtcttctctcattagctttgttgtttgcctcagtttggatgttaacggatcactttattaatcatacaggtatgactattgaaactaagacaaagacacgtgagatttatagtgcgggtgatagtaaggctccatttggtctcatgatttataaagagattggtactcattcgagtaataatgttttagtttatcgaacagatttaaatcaaaaagaagcaaaagctcactttgttccaaatacaaaagaagtgacaagtgctgtgaaaaaatctgctagctaccaattagctgatgtgaaaaaagccacagtaacaacaaagactaaacgttatgtgtggaaagatagtctttcgaaactactttatggctttgcaggtgaaaatggagaattgatttctcagaaatcagttgctaaaataccacgaaaaacttggctagttttgactaaagagcagtccgaacacttagaatcggctgcggctaaactaaaagaacaaatgacttcgcaagcaaaagtaaacccagtgaaagctatggagataaagacattagctaagacaaatccagaagcttatgctgagatgcaagttaaagcattaaaagaagctcttaatataaaagaa

SEQ ID NO: 10110 - protein, 238 aa, Streptococcus agalactiae
MIILIIALATILTFVTWMLIRPKALRYILGLLSLALLFASVWMLTDHFINHTGMTIETKTKTREIYSAGDSKAPFGLMIYKEIGTHSSNNVLVYRTDLNQKEAKAHFVPNTKEVTSAVKKSASYQLADVKKATVTTKTKRYVWKDSLSKLLYGFAGENGELISQKSVAKIPRKTWLVLTKEQSEHLESAAAKLKEQMTSQAKVNPVKAMEIKTLAKTNPEAYAEMQVKALKEALNIKE

SEQ ID NO: 10111 - DNA, 2811 bp, Streptococcus agalactiae
atgataagaggagcaagagctcacaatttaaaaaatataagtgtcgacattccacgagacaagttagttgtcgttacgggactatcaggatcaggtaagtctagtttggcctttgacactatctatgcagaaggacaacgtcgttacgttgaaagtctttctgcttacgcgcgccaatttttgggaaatatggaaaagcctgatgtagattctattgatggccttagtccagctatttctattgatcagaaaacaacaagtaagaatcctcgctctactgttgggactgtaacagaaattaacgattatttacgtttgctttatgctcgtgttggaaccccatattgtatcaatggtcacggagccatcacagcatcttctgtagagcaaattgtggataaggtactagcgcttccagagcgaacaaagatgcaaattttagccccaattatacgtcgaaaaaaaggacaacacaaatcaacatttgagaaaatacaaaaagatggttacgttcgtgttcgtattgatggtgatattcacgatgttactgaggtgcctgaattatcaaaaagtaagatgcacaatattgatattgtagtagatcgattaattaataaagagggcattcgttcccgcttatttgattccgttgaagcggctctacgtttgtcggatggttatgtcgttattgatacaatggatggcaatgagttattgttttcagaacattattcttgtcctgaatgtggttttactgttcctgaattagagccacgccttttttcttttaatgctccctttggttcttgtccgacctgtgatggcttaggaattaagttagaagtagatatagatttggttattccagatagaagtaagacccttagagaaggggccttagttccttggaatccaatttcatcaaattattatccaacgatgctagagcaagctatgactcaatttggtgttgatatggatacgccatttgaaaaattaagcaaggcggagcaggacctagccctatatggttcaggcgaacgagagttccatttccattatattaacgattttggaggcgagagaaatattgatttgccttttgaaggggttgtcaataatattaatcgtcgttaccatgaaactaatagcgattacacacgcaatgttatgcgagaatatatgaacgagctaaaatgtaacacttgtcatggctatcgtctcaatgatcaagcactttgcgtaagagttgggggagaagaaggtcttaatattgggcaagtctcagatttatcgatagcagaccatttagaacttttagaaacattgcgtttatcttcaaatgaacaattaattgctcgaccaattatcaaagaaatccatgaccgtctaagtttcttaaataatgttggacttaattatttaaatctgtcacgttctgcaggaacactttccgggggcgagagtcaacgtattcgtttggctactcaaattgggtctaatttatcaggtgtcctttatgtacttgatgagccgtccattggacttcatcagcgagacaatgaccgtttgattgatagtcttaagaaaatgcgtgatttgggtaatacgcttattgttgttgaacatgatgaagatacaatgatggcagctgattggttaatcgatgtgggacctggcgctggtgcgtttggtggtgagattgtggcctctggtacaccgaagcaagtagctaaaaatactaaatctattacaggacaatatttgtcaggtaagaaagtgattcctgtgccatctgaacgaagagtaggtaatggtcgctttttagaaatcaaaggtgcggcagaaaacaacctacaaaatttagatgtcaagttccctctcggtaaatttattgccgtaactggtgtctcaggttctggaaaatcaaccttaattaatagtattttgaaaaaagctgttgcgcagaagcttaaccgtaactcagataaaccaggtaaatatgtttctttagaaggcattgaatatgttgatcgattgattgatattgatcaaagtccaattggtcggactccacgttctaatcccgcaacctatacaggtgtttttgatgatattcgtgatctttttgctcaaactaatgaggcaaagattcgaggttataaaaaaggacgcttctcatttaacgtcaaaggtggacgttgtgagtcttgttctggcgatggtatcatcaaaattgagatgcattttttaccagatgtctacgttccttgtgaagtatgccacggcacgcgctataatagtgagactctggaagtacattacaaagaaaaaaatattgcacaaattcttgatatgacagtgaatgatgcagttacattttttgcagctattcctaaaattgctcgtaagttacagactattaaggatgttggtttgggatatgtcactttggggcaaccagctacaaccttatcaggaggagaagctcagcgaatgaagctggcaagtgaattacataagcgttcgacaggtaagagtctttacatattagacgaaccaacaacggggcttcatgcagatgatattgctcgtttacttaaggttttggatcgttttgtagatgatggtaatacagtgcttgttattgagcataaccttgatgttattaaaactgctgaccacattattgatcttggccctgaaggaggtattggtggcggacaaattgtagctatcggaacaccagaagaagttgctgaaaatcctaaatcctatacaggatattatttaaaagagaagttagcaaga

SEQ ID NO: 10112 - protein, 937 aa, Streptococcus agalactiae
MIRGARAHNLKNISVDIPRDKLVVVTGLSGSGKSSLAFDTIYAEGQRRYVESLSAYARQFLGNMEKPDVDSIDGLSPAISIDQKTTSKNPRSTVGTVTEINDYLRLLYARVGTPYCINGHGAITASSVEQIVDKVLALPERTKMQILAPIIRRKKGQHKSTFEKIQKDGYVRVRIDGDIHDVTEVPELSKSKMHNIDIVVDRLINKEGIRSRLFDSVEAALRLSDGYVVIDTMDGNELLFSEHYSCPECGFTVPELEPRLFSFNAPFGSCPTCDGLGIKLEVDIDLVIPDRSKTLREGALVPWNPISSNYYPTMLEQAMTQFGVDMDTPFEKLSKAEQDLALYGSGEREFHFHYINDFGGERNIDLPFEGVVNNINRRYHETNSDYTRNVMREYMNELKCNTCHGYRLNDQALCVRVGGEEGLNIGQVSDLSIADHLELLETLRLSSNEQLIARPIIKEIHDRLSFLNNVGLNYLNLSRSAGTLSGGESQRIRLATQIGSNLSGVLYVLDEPSIGLHQRDNDRLIDSLKKMRDLGNTLIVVEHDEDTMMAADWLIDVGPGAGAFGGEIVASGTPKQVAKNTKSITGQYLSGKKVIPVPSERRVGNGRFLEIKGAAENNLQNLDVKFPLGKFIAVTGVSGSGKSTLINSILKKAVAQKLNRNSDKPGKYVSLEGIEYVDRLIDIDQSPIGRTPRSNPATYTGVFDDIRDLFAQTNEAKIRGYKKGRFSFNVKGGRCESCSGDGIIKIEMHFLPDVYVPCEVCHGTRYNSETLEVHYKEKNIAQILDMTVNDAVTFFAAIPKIARKLQTIKDVGLGYVTLGQPATTLSGGEAQRMKLASELHKRSTGKSLYILDEPTTGLHADDIARLLKVLDRFVDDGNTVLVIEHNLDVIKTADHIIDLGPEGGIGGGQIVAIGTPEEVAENPKSYTGYYLKEKLAR

SEQ ID NO: 10113 - DNA, 942 bp, Streptococcus agalactiae
atgaagcaaatgtttctttcaacggcaattgaatttaaagaaattgaaacattcgagccaggtgcttggataaatctggttaatccctcccaggaagaatccgaacaagtagctgatcaatttggtattgatattgatgatttacgtgctcccctcgatgtggaagaaacttcccgtatctcggttgaagatgattatactttagttattgttgacgttcctacctatgaagaacgcaataacaaaagttattatatgactattcctatgggcattatcgttactgacaacgctgttattactacttgcctagaacatttgacgctgtttgatcacttttatagacgacgtgtcaaaaatttttatacctttatgaagacacgttttgttttccaattgctttatcgcaatgccgaattatacttacaggctttgcgtactatcgataggcagagcgataaaattgaagcacaactagagagtgcaactcgaaatgagcaattgatcgatatgatggaattggaaaaatctattgtctatctaaaggcctctttaaaatttaatgagcgaatcgtcaaaaaattgaccagtagtaccagtagtttaaaaaaatacattgaagatgaagatctgcttgaagatacattgatcgaaactcagcaggctattgaaatggcaaatatctatgaaaatgtcttaaatgccatgacagaaacgactgcttcaatcatcggtaataatcagaataccattatgaaaaccttagccctagtaactatgacattggatattccaacggttattttttcggcgtatgggatgaactttcaaaataattggatgcctttgaatggtctcgcacatggctttatctatgttgttcttttggcctttttgatgagttcatttgttgtattttattttattcgtaaaaaatggttt

SEQ ID NO: 10114 - protein, 314 aa, Streptococcus agalactiae
MKQMFLSTAIEFKEIETFEPGAWINLVNPSQEESEQVADQFGIDIDDLRAPLDVEETSRISVEDDYTLVIVDVPTYEERNNKSYYMTIPMGIIVTDNAVITTCLEHLTLFDHFYRRRVKNFYTFMKTRFVFQLLYRNAELYLQALRTIDRQSDKIEAQLESATRNEQLIDMMELEKSIVYLKASLKFNERIVKKLTSSTSSLKKYIEDEDLLEDTLIETQQAIEMANIYENVLNAMTETTASIIGNNQNTIMKTLALVTMTLDIPTVIFSAYGMNFQNNWMPLNGLAHGFIYVVLLAFLMSSFVVFYFIRKKWF

SEQ ID NO: 10115 - DNA, 312 bp, Streptococcus agalactiae
atggcattagaagtaacagatgctacatttgtagaagaaactaaagaaggtttagtactcattgatttttgggcaacttggtgtggtccatgtcgtatgcaagcaccaatcttagaacagttatctcaagaaatcgatgaagatgaactcaaaattttgaaaatggatgttgatgagaatccggaaactgcccgtcagtttggtattatgtcaattccaacattgatgtttaaaaaagacggagaagtggttaaacaagttgcaggtgttcatactaaagaccaactgaaagctattattgctgaattgagt

SEQ ID NO: 10116 - protein, 104 aa, Streptococcus agalactiae
MALEVTDATFVEETKEGLVLIDFWATWCGPCRMQAPILEQLSQEIDEDELKILKMDVDENPETARQFGIMSIPTLMFKKDGEVVKQVAGVHTKDQLKAIIAELS

SEQ ID NO: 10117 - DNA, 2346 bp, Streptococcus agalactiae
atgaagagtatgaataacaagattttagaacagttagaatttaacaaagttaaggaattgatattaccttatctcaagacagaacaatcacaagaagaattatcagagctggagccgatgacggaggctcctaaaatagaaaaaagttttaatgaaatttctgacatggaacagatttttgttgaacatcactcatttggcatagtcagcctaagttcaatctctgagagtttaaaacgcttagagctttcagctgatcttaatattcaagaacttttggctatcaaaaaagttttacagagttcttcggatatgattcacttttattctgatttggataatgtttctttccaatctttggatcgtttgtttgaaaatttggaacaattccctaatctgcaagggtcttttcaagctatcaatgatggtggttttttagaacattttgcgagtccagaattagagcgtatccgtcgtcaattaacaaacagtgaacgacgggttcgtcagattttacaggatatgcttaaggaaaaagcagagcttttatcagagaatctaatcgctagtcgtagtggacgaagtgtcctaccagtaaaaaatacttatcggaatcgtatttctggtgtggttcatgacatctcttcttcaggaagtactgtttatattgagcctcgtgctgtagttacactaaacgaagagataacgcagcttagagctgacgaacgtcatgaagaaagtcgtattttacacgcattttcagacttgttaagaccccatgtcgccactattagaaataatgcatggattcttgggcatcttgattttgtaagggctaaatatctttttatgtctgataataaggcgacgatacctgagatttctaatgacagcacgttagcattaatcaatgttcgtcatcctctgttaagtaaccctgtggctaatgacttacattttgatcaagatttaactgcaattgtcatcactggtcccaatactggtggtaagacgattatgctaaaaacactcggtttagcacaattaatgggacagtctggtttgccagtattagcggataaaggtagtaaaattgcagtatttaacaatatctttgcagatattggcgatgagcaatctattgaacaaagtctatcaactttttctagtcatatgacgcacatagtcagtattttaaacgaggctgaccacaatagtttagtcctctttgatgaactgggagcaggaacggatcctcaagaaggtgctagtttggctatggctattttagaacaccttaggttaagtaatatcaaaacgatggcgaccacgcactatccagaattaaaagcttatgggattgagacaaattttgtagagaatgcgagcatggaatttgatgccgaaacgcttagccctacgtatcgctttatgcaaggagttcctggacgatcaaatgcatttgaaattgcttctcgccttggtttagctccatttattgttaaacaagctaagcagatgacagattctgactcagatgttaaccgtattattgaacagttagaggcacagacacttgagacacgtagaagactggatcatattaaagaagttgaacaagaaaacctcaaattcaatcgtgcggttaagaaactctataatgaattttcacatgagcgcgataaagagttagaaaaaatctatcaagaagctcaagaaattgtagatatggctttgaatgagagtgatactatcttaaaaaaactcaatgataagagccaattaaaacctcacgaaattatagatgctaaggcacaaataaaaaaattagcacctcaagttgatttatcaaaaaataaagtcttaaataaggctaaaaaaattaaagcagctcgtgctcctagaattggtgatgatattatagtgactagctatggacagcgaggtaccttaactagtcaattaaaagatggacgttgggaagcacaagtgggaattatcaaaatgacattaacacaagatgaatttacccttgttagagtccaagaagaacagaaagtcaaaagtaaacagattaatgtggttaaaaaggctgatagttctggaccaagagctcgacttgatcttagaggtaaaagatacgaagaagctatgcaagagttagataattttattgatcaagcattgcttaacaatatgggacaagttgatatcattcatggtattggtacaggcgttatccgtgagggagtgacaaaatatcttcgtcgtaataagcacgttaagcattttgcttatgccccacaaaatgcagggggatctggcgccacaattgtaacgttaggg

SEQ ID NO: 10118 - protein, 782 aa, Streptococcus agalactiae
MKSMNNKILEQLEFNKVKELILPYLKTEQSQEELSELEPMTEAPKIEKSFNEISDMEQIFVEHHSFGIVSLSSISESLKRLELSADLNIQELLAIKKVLQSSSDMIHFYSDLDNVSFQSLDRLFENLEQFPNLQGSFQAINDGGFLEHFASPELERIRRQLTNSERRVRQILQDMLKEKAELLSENLIASRSGRSVLPVKNTYRNRISGVVHDISSSGSTVYIEPRAVVTLNEEITQLRADERHEESRILHAFSDLLRPHVATIRNNAWILGHLDFVRAKYLFMSDNKATIPEISNDSTLALINVRHPLLSNPVANDLHFDQDLTAIVITGPNTGGKTIMLKTLGLAQLMGQSGLPVLADKGSKIAVFNNIFADIGDEQSIEQSLSTFSSHMTHIVSILNEADHNSLVLFDELGAGTDPQEGASLAMAILEHLRLSNIKTMATTHYPELKAYGIETNFVENASMEFDAETLSPTYRFMQGVPGRSNAFEIASRLGLAPFIVKQAKQMTDSDSDVNRIIEQLEAQTLETRRRLDHIKEVEQENLKFNRAVKKLYNEFSHERDKELEKIYQEAQEIVDMALNESDTILKKLNDKSQLKPHEIIDAKAQIKKLAPQVDLSKNKVLNKAKKIKAARAPRIGDDIIVTSYGQRGTLTSQLKDGRWEAQVGIIKMTLTQDEFTLVRVQEEQKVKSKQINVVKKADSSGPRARLDLRGKRYEEAMQELDNFIDQALLNNMGQVDIIHGIGTGVIREGVTKYLRRNKHVKHFAYAPQNAGGSGATIVTLG

SEQ ID NO: 10119 - DNA, 858 bp, Streptococcus agalactiae
ttgcaagaaaagataagaaccgatttagctcaacatcatataagtaataacaatccttatgtggtattttcagctaaaatatcaggagctactgttcttttatatacttctggaaaacttgtcttccagggttctaacgcttcacatatcgcccaaaagtatggttttattgagcaaaaagaaagttgttcctctgagagtcaagatattcccataattggtactgatgaagtgggaaatggctcttactttggtggactggcagtggtagctagttttgtaactcctaaggaccatgcttacctcaaaaaattaggtgttggtgattcaaaaacacttactgatcaaaaaattaagcaaatcgcgcctcttttggaaaaagcaattccacacaaagcattattgttatcgcctcaaaaatataatcaagtggttagtccaaataacaaacataatgctgtctccgtaaaagttgctttacacaatcaagctatcttccttcttcttcaagatggttttgaaccagaaaaaatcgttattgatgcttttactagctccaaaaactatcaaaattatttgaaaaatgaaaagaatcaatttaaacaaacgattactctggaagaaaaagctgaaaataaatatctagctgtagcggtcagttctattattgcacgtaatctattcttagaaaaccttaacaaattaagcgacgacgtaggatataaacttccaagtggagctggtcaccaatctgataaggtcgctagccaattactcaaagcttatggtatctcttcgcttgaacactgcgcaaaacttcattttgccaacaccaaaaaagcacaagcattattaaaa

SEQ ID NO: 10120 - protein, 286 aa, Streptococcus agalactiae
MQEKIRTDLAQHHISNNNPYVVFSAKISGATVLLYTSGKLVFQGSNASHIAQKYGFIEQKESCSSESQDIPIIGTDEVGNGSYFGGLAVVASFVTPKDHAYLKKLGVGDSKTLTDQKIKQIAPLLEKAIPHKALLLSPQKYNQVVSPNNKHNAVSVKVALHNQAIFLLLQDGFEPEKIVIDAFTSSKNYQNYLKNEKNQFKQTITLEEKAENKYLAVAVSSIIARNLFLENLNKLSDDVGYKLPSGAGHQSDKVASQLLKAYGISSLEHCAKLHFANTKKAQALLK

SEQ ID NO: 10121 - DNA, 1092 bp, Streptococcus agalactiae
atgttaatttttcctttaataaatgatacgtcgcgtaaaattatccacattgatatggatgctttttttgcatctgtggaagagcgtgacaatccctctcttaaaggaaagcctgttattattggttctgatcccagaaaaaccggcggcagaggggttgtttctacttgtaattatgaggctcgaaagtttggagttcattcagctatgtcttcaaaagaagcgtatgaacgatgccctcaagctatctttatttcgggaaattaccaaaaatatcgccaagtaggaatggaagtacgagatatatttaaaaagtatacggatttggttgaaccgatgagtatagacgaagcttatttagatgtaactgaaaataaaatgggaataaaatcagctgttaaacttgctaaaatgatacaatacgatatttggaatgatgtccatttgacctgttcagcgggtatttcctacaataaatttttggcaaaattggcttctgactttgagaaaccaaaaggacttaccctcatcctaccagatcaagctcaagatttcttgaagcccttaccaatagagaaatttcatggtgttggtaaacgctccgtcgaaaaattacatgctttaggggtttatactggtgaggacctcctttccttatctgaaatttctttaattgatatgtttggtcgtttcgggtatgacctttatcgtaaggcaagagggattaatgcttccccggtaaaacctgatagagttcgtaaatcaataggaagtgagaaaacctatgggaaattactatataacgaagcagatatcaaagctgagatttcaaagaacgttcagagagttgttgcttctctggagaaaaataagaaagttggtaagacaatcgttttaaaagttagatatgcggattttgaaacattgacgaaacgtatgacattagaagagtatactcaagattttcaaatcattgatcaagttgctaaagcgatatttgataccttagaagagtcagtttttggcatacgactcttaggtgttacagtaacgaccctggaaaatgaacatgaagctatctatttagatttt

SEQ ID NO: 10122 - protein, 364 aa, Streptococcus agalactiae
MLIFPLINDTSRKIIHIDMDAFFASVEERDNPSLKGKPVIIGSDPRKTGGRGVVSTCNYEARKFGVHSAMSSKEAYERCPQAIFISGNYQKYRQVGMEVRDIFKKYTDLVEPMSIDEAYLDVTENKMGIKSAVKLAKMIQYDIWNDVHLTCSAGISYNKFLAKLASDFEKPKGLTLILPDQAQDFLKPLPIEKFHGVGKRSVEKLHALGVYTGEDLLSLSEISLIDMFGRFGYDLYRKARGINASPVKPDRVRKSIGSEKTYGKLLYNEADIKAEISKNVQRVVASLEKNKKVGKTIVLKVRYADFETLTKRMTLEEYTQDFQIIDQVAKAIFDTLEESVFGIRLLGVTVTTLENEHEAIYLDF

SEQ ID NO: 10123 - DNA, 2310 bp, Streptococcus agalactiae
atggcaacagttaaaacaaacacagatatctttgaacaagcttgggaaggctttaaaggtgttgattggaaagaaaaagcaagtattgctcgcttcgttcaagcaaactatgcaccttacgatggagatgaaagcttcttagctggagcaactgaacgttcacttcacatcaaaaaagtgattgaagaaacaaaagctcactatgaagaaactcgcttcccaatggatactcgtgttgcttcaatttctgaattaccagctggttttatcgacaaagataacgagcttatctttggtattcaaaacgacgagcttttcaaattgaacttcatgcctaaaggtggtatccgtatggcggaaactacacttaaagaaaatggttatgaacctgatccagctgttcacgaaatcttcactaagtacgctacaacagtaaatgatggtatcttccgcgcttatacttctaacattcgtcgtgctcgccatgcacacactgttactggtcttccagacgcttattcacgcggacgtatcattggtgtatatgctcgtctagctgtttacggtgctgactacttgatgcaagaaaaagttaatgactggaatgcattgaatgatattgatgaagagtcaattcgtcttcgtgaagaaatcaaccttcaataccaagctcttggtgaagttgtaaaacttggtgacctttacggcgtagatgttcgtaaaccagccatgaacactaaagaagccattcaatgggtgaacattgctttcatggctgtatgtcgtgttatcaatggtgctgcaacatcacttggacgtgttcctattgtccttgatatctttgcagaacgtgacctcgctcgcggtacattcacagaatcagaaatccaagaatttgttgatgattttgtccttaaactccgtactgtaaaatttgctcgtactaaagcttatgatgccctttactcaggtgacccaacctttatcacaacttcaatggcaggtatgggagctgatggacgtcatcgtgttaccaaaatggactatcgtttcttaaatacacttgacaatatcggtaactcaccagaaccaaacttaactgttctttggtcagatcaattaccatatgctttccgtcgctactgtatgtcaatgagtcataaacactcttcaatccaatatgaaggtgtatcaacaatggctaaagaaggctacggtgaaatgtcatgtatttcatgttgtgtatctccacttgatccagaaaacgaagacaaacgtcacaaccttcaatattttggtgctcgtgttaacgttatgaaagcacttcttactggtcttaacggtggttatgatgatgttcataaagattacaaagtatttgacatcgacccaattcgtgacgaagtactcaactttgacactgtaaaagctaactttgaaaaatctcttgactggttgactgatacttatgttgatgcgatgaatatcatccactacatgactgataaatacaactatgaagctgtacaaatggcattcttaccttcacatgtacgtgctaatatgggatttggtatctgtggttttgcaaatactgtcgattcattatctgcgattaaatacgctactgttaaaccaatccgtgacgaagatggttacatctacgactacgaaacagttggtgacttcccacgttatggtgaagatgatgatcgtgttgactcaatcgctgaatggttacttgaagccttccatggacgccttgctaaacacaaactttataaagatgctgaagcaactgtttctcttcttacaatcacatcaaacgttgcttactctaaacaaactggtaactcaccggtacataaaggagtatatctcaatgaagatggtagtgtaaacctttctaaagtagaattcttctcaccaggtgctaacccttctaacaaagctaaaggtggctggttacaaaacttgaattcactttctaaacttgatttcgctcatgcaaatgatggtatttcattgacaactcaagtttctccacgcgctcttggtaaaacatttgatgaacaagttgataacttggtaacagtccttgatggttactttgaaaacggtggtcaacacgttaacttgaatgtcatggaccttaaagatgtctatgacaagattatgaatggtgaagatgttatcgttcgtatctcaggttactgtgtcaatactaaatatctaactcctgagcaaaaaactgagttgacacaacgtgtcttccatgaagtactttcaatggacgatgcattaactaac

SEQ ID NO: 10124 - protein, 770 aa, Streptococcus agalactiae
MATVKTNTDIFEQAWEGFKGVDWKEKASIARFVQANYAPYDGDESFLAGATERSLHIKKVIEETKAHYEETRFPMDTRVASISELPAGFIDKDNELIFGIQNDELFKLNFMPKGGIRMAETTLKENGYEPDPAVHEIFTKYATTVNDGIFRAYTSNIRRARHAHTVTGLPDAYSRGRIIGVYARLAVYGADYLMQEKVNDWNALNDIDEESIRLREEINLQYQALGEVVKLGDLYGVDVRKPAMNTKEAIQWVNIAFMAVCRVINGAATSLGRVPIVLDIFAERDLARGTFTESEIQEFVDDFVLKLRTVKFARTKAYDALYSGDPTFITTSMAGMGADGRHRVTKMDYRFLNTLDNIGNSPEPNLTVLWSDQLPYAFRRYCMSMSHKHSSIQYEGVSTMAKEGYGEMSCISCCVSPLDPENEDKRHNLQYFGARVNVMKALLTGLNGGYDDVHKDYKVFDIDPIRDEVLNFDTVKANFEKSLDWLTDTYVDAMNIIHYMTDKYNYEAVQMAFLPSHVRANMGFGICGFANTVDSLSAIKYATVKPIRDEDGYIYDYETVGDFPRYGEDDDRVDSIAEWLLEAFHGRLAKHKLYKDAEATVSLLTITSNVAYSKQTGNSPVHKGVYLNEDGSVNLSKVEFFSPGANPSNKAKGGWLQNLNSLSKLDFAHANDGISLTTQVSPRALGKTFDEQVDNLVTVLDGYFENGGQHVNLNVMDLKDVYDKIMNGEDVIVRISGYCVNTKYLTPEQKTELTQRVFHEVLSMDDALTN

SEQ ID NO: 10125 - DNA, 657 bp, Streptococcus agalactiae
atgaatcatcaaattttacaaaattacattaatagtcataatcttccaattatcgaaaaagactaccataaataccttacatttgaaagtttagaagaagactatacttatatcctaaaagatggtattgttaaacaaagtgttctctctaaatatggtactgagttcaatctgcgttatgtgacaggcttagaaatcacttctatcctaaatacagactactcccaacacatgggagaaccttacaacgttcgaatcgaatccgaaactgcccacttttacaaagtacgtcgctctaccttcctaaaagatatcaataatgatattgaactgcaaggatatgtgaaagatttctatcataaccgccttgaaaaatctatgaaaaaaatgcaatgtatgctcactaatggtcgaattggtgctatctccacacaattatatgacctcagtaagatgtttggtgaagaacgagataacggtgatatctatattaattttgttatcacgaacgaagaacttggtaaattttgcggaatatccacaggaagtagcgtgagccgcattttgaaacaactaaaagacgatcatattattcgtattgaaaaacaacatatcattattacaaatgttgagaaattaaaagatcatattgtattt

SEQ ID NO: 10126 - protein, 219 aa, Streptococcus agalactiae
MNHQILQNYINSHNLPIIEKDYHKYLTFESLEEDYTYILKDGIVKQSVLSKYGTEFNLRYVTGLEITSILNTDYSQHMGEPYNVRIESETAHFYKVRRSTFLKDINNDIELQGYVKDFYHNRLEKSMKKMQCMLTNGRIGAISTQLYDLSKMFGEERDNGDIYINFVITNEELGKFCGISTGSSVSRILKQLKDDHIIRIEKQHIIITNVEKLKDHIVF

SEQ ID NO: 10127 - DNA, 1746 bp, Streptococcus agalactiae
atgtttaaaatccctttgtttaaagaattaaagacagatcaatggataaaaccatttttcaaacaatataaagtttccttagtaattgctcttttccttggttttatgactttcttttctgccagtgctcttatgtttaattcgggctatctgattagtaagtcagcttcactaccgagtaatattcttctagtatatgttccaattgtactaacacgtgcttttggcattggacgtcctgtttttcgttatatagaacgcctaacgagtcacaattgggtattacgaatgacttcacagctgcgcttgaagctttaccattccttagaaagcaatgctatctttatgaagcgtgattttcgtttaggagatgttatggggcttttagcggaggatattaattatttgcaaaatttgtatcttaggacaatatttccaacgattatagcgtggatattatatagctttattattattgcaacaggcttcttttctctatggtttgctttaatgatgttgctttatttagctattatgatttttctttttccactttggtcgattttagctaatggtgctcgtcagactcgtgaaaaagaattaaaaaatcatctttatactgatttgacggataatgtcttaggtatttcagactggatttttagtcaacgtggtcaagagtacgtcgccttgcatgagcgttcggaaagtgaactcatggctgttcagaaaaaaattcgttcctttgataatcgtagagctcttattgtggaattagtttttggctttctagctattttggttattatttgggctagtaatcagtttattggtcacagaggtggcgaagctaactggattgcagcatttgttctaacagtatttcccttgtcagaggcatttgctggtttgtctgctgctgctcaagaaacaaataaatattctgattcaattcatcgtcttaatgaattatcagaaacgtattttgaaacaactcaaaatcagttgcctaataagccatacgatttttccgtcaagaatttaagtttccagtataagccacaagagaaatgggttttgcatcatttagatttggatattaaagaaggagaaaaaattgctattttagggcgtagtggttctggcaagagtaccttagccagtctacttcgtggcgacttgaaagcaagtcaaggggagattaccctaggcgatgctgatgtttcaatagttggtgattgcatttctaactatattggagtgatacaacaagcgccctacctttttaatacaaccctgctaaataacattcgcattggaaaccaagatgctagtgaagaagatgtatggaaagttcttgaacgagttggattgaaagagatggtcactgatttatcagatggtctctatacaatggttgatgaagctggacttaggttttcaggtggcgaaaggcatagaattgctttggctagaatcttactaaaagatgtcccaattgttatcttagatgagccaactgttggacttgatcctattactgaacaagccttactaagggtatttatgaaagaattggaaggtaagaccttagtttggattacacatcacttaaaaggtattgaacatgctgatcgtatcttatttatagaaaatgggcaattagagttggaaggttctcctcaagaattgtctcaaagtagccaacgttaccgtcagctgaaagcctctgatgatggtgatcta

SEQ ID NO: 10128 - protein, 582 aa, Streptococcus agalactiae
MFKIPLFKELKTDQWIKPFFKQYKVSLVIALFLGFMTFFSASALMFNSGYLISKSASLPSNILLVYVPIVLTRAFGIGRPVFRYIERLTSHNWVLRMTSQLRLKLYHSLESNAIFMKRDFRLGDVMGLLAEDINYLQNLYLRTIFPTIIAWILYSFIIIATGFFSLWFALMMLLYLAIMIFLFPLWSILANGARQTREKELKNHLYTDLTDNVLGISDWIFSQRGQEYVALHERSESELMAVQKKIRSFDNRRALIVELVFGFLAILVIIWASNQFIGHRGGEANWIAAFVLTVFPLSEAFAGLSAAAQETNKYSDSIHRLNELSETYFETTQNQLPNKPYDFSVKNLSFQYKPQEKWVLHHLDLDIKEGEKIAILGRSGSGKSTLASLLRGDLKASQGEITLGDADVSIVGDCISNYIGVIQQAPYLFNTTLLNNIRIGNQDASEEDVWKVLERVGLKEMVTDLSDGLYTMVDEAGLRFSGGERHRIALARILLKDVPIVILDEPTVGLDPITEQALLRVFMKELEGKTLVWITHHLKGIEHADRILFIENGQLELEGSPQELSQSSQRYRQLKASDDGDL

SEQ ID NO: 10129 - DNA, 390 bp, Streptococcus agalactiae
ttgaaacttggtcttgtctcagcaatgtttgctggaggagcattcgtagctcttggttctacacaaggtgtttcagcttcaactttcacagcaccgcaagcaacacctccaaaagcagaacgtcagttaacggattcagaactttatgaacgtgcccaaaaacaagtattgccaagatatatccaaggttctctctcaggtatccttaaccagcattcaacactttacaaacaacaaaatgcagcagtgacaccgcaagtatcaagccccaaatcagaacgtcagttaacagattcagaaatctatgaacgtgctcaaaaacaagtattgccaaattatattcaaggttctctctcaggtatcctcaaccaacattcaactttaaatgct

SEQ ID NO: 10130 - protein, 130 aa, Streptococcus agalactiae
MKLGLVSAMFAGGAFVALGSTQGVSASTFTAPQATPPKAERQLTDSELYERAQKQVLPRYIQGSLSGILNQHSTLYKQQNAAVTPQVSSPKSERQLTDSEIYERAQKQVLPNYIQGSLSGILNQHSTLNA

SEQ ID NO: 10131 - DNA, 534 bp, Streptococcus agalactiae
atgacagttgaaaagacggttagtgaattagctgaaattttaggggttagtcgtcaagcgatgaataacagagttaaaacactccctgaagaatgtgtggaaaagaatagtaaaggcgttacagttgttaatcgtgatggcttgattaaattggaagaaatctataaaaaaactattttggaagaggaaccaattgacgaagaagcatcaagacgagaacttttagaaattctcgttgatgagaagaatactgaaatcacacgtttatatgaacagttaaaagcaaaagatattcagattgcttcaaaagacgagcagttacatgtaaaagatattcaaatagcagagaaagataagcaattagatcaacaacagcaattgactttaactgctatggaagatacgcaacgtctgcaacttgagttaaatgaagctaaagcagaggttgaggagattcaagaagccaaagaagaaaaaattcaagaattagaagctgttaaaaaaagtttctttggacgtttcttcaataaaaaa

SEQ ID NO: 10132 - protein, 178 aa, Streptococcus agalactiae
MTVEKTVSELAEILGVSRQAMNNRVKTLPEECVEKNSKGVTVVNRDGLIKLEEIYKKTILEEEPIDEEASRRELLEILVDEKNTEITRLYEQLKAKDIQIASKDEQLHVKDIQIAEKDKQLDQQQQLTLTAMEDTQRLQLELNEAKAEVEEIQEAKEEKIQELEAVKKSFFGRFFNKK

SEQ ID NO: 10133 - DNA, 1125 bp, Streptococcus agalactiae
atgatggcagctatttcctcaaatttttacggcaacaaaacacttcttattgagaaaaataaacgtttaggcaaaaaactagctggaacaggtggtggccgctgtaatgttaccaataatggaaaccttgatgagctcttagctggtatacctggaaatggccgtttcctatatagcgtcttctcacaatttgataaccatgatattattaacttctttcaagacaacggcgtcacactaaaagaagaagatcatgggcgtatgttccctactactgataaatctcgtactatcattaacgcccttgaaaataaaataaaagaacttggtggtcaaattatgactgacacagaagttgtctctgtcaaaaagataggagattcattctatatcaaaactaaagatacacagttcgcatccgataaacttatcgtaacaactggtggtaaatcctatccgtctacaggttctactggtttcggtcatgacattgctcgtcactttaaattagaagtcacagatatggaagccgccgaaagccctcttttaactgattttccccataaaaaactacaaggtatctccttagatgatgtcactttgtcatttgaaaagcatattattacacacgatcttctctttactcattttggattatcaggaccagcagccttgcgaatttctagctttgtcaaaggcggagaaactatatacctagatgttttgcccaatatctctgttaaagaattggaaatacacttccaaaatgaaagagaaaaatctttgaaaaacgctcttaaaatacttcttcctgagcgtttagctgaattttacgctgaagacttacccgaaaaagtaaaacaagtatctgtaaaagacttagaaatgttaattcaaaaacttaaaaaacttcctattttagtaactggcaagatgtctctagcaaaatcctttgtaacaaaagggggagttgatcttaaagaaataaaccccaaaacacttgaaagtaaaaaggtagctggtttacattttgctggtgaagtcctagacatcaatgctcatacgggagggtttaacattacttctgccttatgtacaggctgggtagctggtagcttacactat

SEQ ID NO: 10134 - protein, 375 aa, Streptococcus agalactiae
MMAAISSNFYGNKTLLIEKNKRLGKKLAGTGGGRCNVTNNGNLDELLAGIPGNGRFLYSVFSQFDNHDIINFFQDNGVTLKEEDHGRMFPTTDKSRTIINALENKIKELGGQIMTDTEVVSVKKIGDSFYIKTKDTQFASDKLIVTTGGKSYPSTGSTGFGHDIARHFKLEVTDMEAAESPLLTDFPHKKLQGISLDDVTLSFEKHIITHDLLFTHFGLSGPAALRISSFVKGGETIYLDVLPNISVKELEIHFQNEREKSLKNALKILLPERLAEFYAEDLPEKVKQVSVKDLEMLIQKLKKLPILVTGKMSLAKSFVTKGGVDLKEINPKTLESKKVAGLHFAGEVLDINAHTGGFNITSALCTGWVAGSLHY

SEQ ID NO: 10135 - DNA, 765 bp, Streptococcus agalactiae
gtgagtagtcatgaagcaggagccatagaattttcagggcataaggtattgactttaccttctcataatgggaaattactcgcaagcgaagtcgcaacttatattgagactttttatgctgatggtaattaccaacacatggtttttccaggaatggtttatatatcacatccaacagaatatggaacactttatagtaaagcagaactagaagagttatcgaagatttgtaaacattatcaaatccccttatttattgacggtgctcgtctggggtatggtttggctgcgaaagatacagatgttgatttcccaacgattgcagccttatcagatgttttttatattggtggaaccaaaatgggggctcttgctggggaagcagttgttttcacaaagaaaaatcgtccaaaacagtttactacaattgtaaagcagcatggtgcgttattagccaagggaagattgctggggcttgcttttgatcgtttctttacggataacctttacttaaaaattggaaagcatgcgatcgacttagcagaggaattaaaaatcattttagaagaaaaaggttactcattctatttaaaatcaccaactaatcaacaatttattattgtagaaaatacaaaactagcagatttagcaaagaatgtagcttatagtttttgggaaaaatatgatgaccatcatactgtaatacgtctagcaactagttggtcaactagtcgcgaagatgtaactgctttaagaaatgtcttg

SEQ ID NO: 10136 - protein, 255 aa, Streptococcus agalactiae
MSSHEAGAIEFSGHKVLTLPSHNGKLLASEVATYIETFYADGNYQHMVFPGMVYISHPTEYGTLYSKAELEELSKICKHYQIPLFIDGARLGYGLAAKDTDVDFPTIAALSDVFYIGGTKMGALAGEAVVFTKKNRPKQFTTIVKQHGALLAKGRLLGLAFDRFFTDNLYLKIGKHAIDLAEELKIILEEKGYSFYLKSPTNQQFIIVENTKLADLAKNVAYSFWEKYDDHHTVIRLATSWSTSREDVTALRNVL

SEQ ID NO: 10137 - DNA, 405 bp, Streptococcus agalactiae
atggaatcatcagaacaagcactggctatatggagcgtactatctgatgtctatgacaaatctccgtggagtttatcgcagatttcagaagatttaaaaaaagattcaacagattatttttttgtttataatgacggtgaagtcattggttttttggctcttcaacaattggtaggtgaagtagaaattactaatattgctgttaaaaaaaattatcaaggtaaaggttatgcttaccagttaatgtcaatgatcgctgatatagaggtgccagtttttcttgaggttcgttattcaaatatcgtagcacaaaaactttatgagaggtgtggttttgtagttttaagaaagcgcaaaaattattaccatgatccaattgaagatgctatagtgatgcgcaaggga

SEQ ID NO: 10138 - protein, 135 aa, Streptococcus agalactiae
MESSEQALAIWSVLSDVYDKSPWSLSQISEDLKKDSTDYFFVYNDGEVIGFLALQQLVGEVEITNIAVKKNYQGKGYAYQLMSMIADIEVPVFLEVRYSNIVAQKLYERCGFVVLRKRKNYYHDPIEDAIVMRKG

SEQ ID NO: 10139 - DNA, 780 bp, Streptococcus agalactiae
atgataaaaatatttgatacccatacccaccttaacgtagaaaattttgaaggaaagatagacgaggaaattaatttagctagcgaactcggtgttacaaaaatgaatgttgtcggctttgaccaagataccatttcaaaatctttggaattatcttcccaatatgcacaggtatatagcacaataggatggcatccaactgaagctggttcttatgatgataatattgagtcaatgattatcagtcatttagaaaatcccaaggttattgcacttggtgaaattggtctggattattattggatggaggatcccaaagatattcagatcgaggtgtttaagcgtcaaattgaactttcaaaagagtataaccttccttttgtcgttcatacacgtgatgcgttagaagacacttatgaagtcattaaggaatctggagttgggccttttggtggtataatgcactctttttctggttctttggaaatggctcagaaatttattgatttagggatgatgatttccttttctggtgttgtgacctttaagaaggcattagatgtacaagaagctgcacgagagttgccattagataagatattagtggaaacagatgctccttatttggctcctgtacctaaaagaggtcgagaaaacaaaaccgcttatacgagatatgtcgttgaaaaaatagcagagctacgaggcataactgtggaagaggtagcggaggctacataccaaaatgcagtaaggatatttagacttgatgaaaaaaat

SEQ ID NO: 10140 - protein, 260 aa, Streptococcus agalactiae
MIKIFDTHTHLNVENFEGKIDEEINLASELGVTKMNVVGFDQDTISKSLELSSQYAQVYSTIGWHPTEAGSYDDNIESMIISHLENPKVIALGEIGLDYYWMEDPKDIQIEVFKRQIELSKEYNLPFVVHTRDALEDTYEVIKESGVGPFGGIMHSFSGSLEMAQKFIDLGMMISFSGVVTFKKALDVQEAARELPLDKILVETDAPYLAPVPKRGRENKTAYTRYVVEKIAELRGITVEEVAEATYQNAVRIFRLDEKN

SEQ ID NO: 10141 - DNA, 390 bp, Streptococcus agalactiae
atgaagtcaataaaattacttagttttattgtaataatccttttagggcttggtttcactgtaggaggtttaaaagtgactgaaaacaataaacaacaagaattatgggaaatagctaatagcaaagacgctaaaaatgcttatcaaaagtggatttatgcagaagatgaagatgctttcaaagagaatgctgttattaagtcgtatgatattgacaaagaaagtatcaaaaaaaatcctatgggagggatttcggtaaggttaatcattaataaagatcctaacttatatattacttgtaatttggatagggataatcaagggcatttggtcagtcaaagtagccatcaatctccccagttaactcatttattggaaagtagaggtcat

SEQ ID NO: 10142 - protein, 130 aa, Streptococcus agalactiae; identical to SEQ ID NO: 8910

SEQ ID NO: 10143 - DNA, 1533 bp, Streptococcus agalactiae
atgatacatgatatgattaaaacaattgagcattttgctgagacacaagctgattttccagtgtatgatattttaggggaagtccatacttatggacaacttaaagtagactctgactctctagctgctcatattgatagcctaggccttgttgaaaaatcacctgtcttagtattcggtggtcaagaatatgaaatgttggcgacatttgttgctttaacaaagtcagggcatgcttatataccggttgaccaacactctgctttggatagaatacaggctattatgacagttgctcaaccaagccttatcatttcaattggtgaatttcctcttgaagttgataatgtcccaatcctagacgtttctcaagtttcagctatttttgaagaaaagactccttatgaggtaacacattctgttaaaggtgatgataattactatattattttcacttcagggactactggtttaccaaaaggtgtgcaaatttcacatgacaatttattgagctttacaaattggatgatttctgatgatgagttttcagttcctgaaagaccgcaaatgttggctcaaccgccatattcatttgacttatcagttatgtattgggcaccaacactagctatgggaggcaccctgtttgccctaccaaagacagtagttaatgatttcaaaaaactattcgctaccattaatgaattgccaatacaggtttggacttcgacaccatcatttgctgatatggcgctactatctaacgatttcaattcagagaccttgccacagttaacacatttttattttgatggggaagagttaactgtcaagactgcacaaaaacttcgtcaacgttttccaaaagctcgtatcgttaatgcatatgggccaacagaagcaacagttgctctatccgcagtagcaattactgatgaaatgttagaaacatgcaaacgccttccaattggttacactaaagatgactcaccaacgtatgtgattgatgaagaaggtcataaattaccaaacggagagcaaggtgaaatcattattgctggaccagcagtatcaaaaggctatcttaacaatccagaaaagacagctgaggcatttttccaattcgaaggtctacctgcttaccataccggtgacttaggaagtatgaccgatgaaggtcttctgctttacggtgggcgtatggatttccaaattaaatttaacggctatcgtattgaattagaagatgtttctcaaaacttaaacaaatcgcagtatgtaaaatcagcagtagcagtgccacgttataacaaggatcataaagttcaaaacttattagcctatattgtcttaaaagaaggtgtaagagatgattttgaacgtgatttggatttgacaaaagcaattaaggaagacttaaaggacattatgatggattacatgatgccatctaaatttatctatcgagaggatttacctttgacaccaaatgggaaaattgatatcaaaggtcttatgagcgaggtaaacaag

SEQ ID NO: 10144 - protein, 511 aa, Streptococcus agalactiae [sequence omitted]

SEQ ID NO: 10145 - DNA, 2376 bp, Streptococcus agalactiae
atgtcagaatttgatacaaaatcatatttagaaaaacttgatgcatggtggagagcagctaattatatttctgcagcacaaatgtatctaaaggataaccctctcttgagacgagagctggttgaaaacgacttaaaggttcatccaattggtcactggggcactgtacctggacaaaattttatctatgctcacttaaatcgcgctattaataaatacgatttagacatgttctatattgaaggtccaggtcatggtggtcaagttatggtatctaattcatatttagatggttcatatactgaattaaacccaaatattgagcaaacagaggatggctttaagcagttatgtaaaatcttctctttcccatgtggaattgcatcccatgctgcaccagaaacaccagggtcaattcatgaaggcggtgaacttggttacgcactttctcatgcgacaggtgccatcctagacaatccagatgttattgctgcgactgttattggtgatggtgaaggtgaaacaggaccacttatggctggttggctatctaatacctttatcaatccagtaaatgatggtgctgttctaccaatcttctatttaaatggtggtaaaatccataacccaactatctttgaacgtaagacagatgaagaattatctcagttttttgaaggattaggttggaaacctatttttgcagatgttgttgaactctctgaggatcatgcggctgctcatgctttgtttgcagaaaaattagatcaagctattcaagagattaaaaccattcaatcagaagcacgacaaaaaccagcagaagaagctatccaagcaaaattccctgtcttagttgcacgtattcctaagggttggactggtccaaaagcttgggaaggaacaccaattgaaggtggcttccgcgctcaccaagtaccaattccagtagatgcccaccatatggaacatgttgattctcttttgtcatggcttcaatcataccgtccagaagaattatttgatgaaaatggtaaaatcgttgatgagattgctgctatttcaccaaaaggtgatcgtcgcatgtccatgaatccaataaccaatgctggtattgttaaagcaatggatacagcagattggaagaaatttgctcttgatattaatgttccaggtcaaattatggcacaagatatgattgaatttggaaaatatgcagcagatttggtagatgctaatccagataatttccgtatttttggtccagatgaaacgaaatcaaatcgtcttcaagaagtgtttacacgtactagccgtcaatggcttggtcgtcgtaaaccagattatgacgaagctttaagtccagctggacgtgttattgattcccaattgtctgaacaccaagcagaaggtttcttagaaggttatgttttaactggtcgtcacggcttctttgcttcatacgaatcattccttcgcgttgtagattcaatggtaacacaacatttcaaatggttacgtaaatcaaaaacacacacaacatggcgtaaaaattatccagcgcttaacctaattgcagcttcaactgttttccaacaagatcataatggttatactcaccaagatccaggtattttaactcatttagctgaaaaaacacctgaatacattcgtgaatatttaccagcagatactaactcacttctagctgttatggataaagcgtttaaagctgaagataaaattaatttaattgtgacatctaagcaccctcgtccacaattttactctattgctgaagcagaagagttagtggcagaaggatataaggtgattgactgggcttcaaatgtgtcgcttaatcaagagccagatgttgtctttgctgcggcgggaacagaacctaacttagaagctttggcagctattagcattcttcataaggctttcccagaacttaagattagatttgttaatgtattagacatcctaaaacttcgtcatccttcacaagatgctcgcggtttatcagatgaagagtttaacaaagtctttaccacagataaacctgttatttttgctttccatggttatgaagatatgattcgagatattttctttagtcgtcacaatcataatttgcatacgcatggttaccgtgaaaatggtgacatcacaacaccatttgatatgcgcgtgatgtcagaattggaccgattccatctggcacaggatgcagctcttgcttctttaggaaataaagcacaagccttcagtgatgaaatgaatcaaatggttgcttatcacaaagactatattcgtgaacacggagacgatattccagaagtacaaaattggaaatgggaaaatatcaag

SEQ ID NO: 10146 - protein, 792 aa, Streptococcus agalactiae
MSEFDTKSYLEKLDAWWRAANYISAAQMYLKDNPLLRRELVENDLKVHPIGHWGTVPGQNFIYAHLNRAINKYDLDMFYIEGPGHGGQVMVSNSYLDGSYTELNPNIEQTEDGFKQLCKIFSFPCGIASHAAPETPGSIHEGGELGYALSHATGAILDNPDVIAATVIGDGEGETGPLMAGWLSNTFINPVNDGAVLPIFYLNGGKIHNPTIFERKTDEELSQFFEGLGWKPIFADVVELSEDHAAAHALFAEKLDQAIQEIKTIQSEARQKPAEEAIQAKFPVLVARIPKGWTGPKAWEGTPIEGGFRAHQVPIPVDAHHMEHVDSLLSWLQSYRPEELFDENGKIVDEIAAISPKGDRRMSMNPITNAGIVKAMDTADWKKFALDINVPGQIMAQDMIEFGKYAADLVDANPDNFRIFGPDETKSNRLQEVFTRTSRQWLGRRKPDYDEALSPAGRVIDSQLSEHQAEGFLEGYVLTGRHGFFASYESFLRVVDSMVTQHFKWLRKSKTHTTWRKNYPALNLIAASTVFQQDHNGYTHQDPGILTHLAEKTPEYIREYLPADTNSLLAVMDKAFKAEDKINLIVTSKHPRPQFYSIAEAEELVAEGYKVIDWASNVSLNQEPDVVFAAAGTEPNLEALAAISILHKAFPELKIRFVNVLDILKLRHPSQDARGLSDEEFNKVFTTDKPVIFAFHGYEDMIRDIFFSRHNHNLHTHGYRENGDITTPFDMRVMSELDRFHLAQDAALASLGNKAQAFSDEMNQMVAYHKDYIREHGDDIPEVQNWKWENIK

SEQ ID NO: 10147 - DNA, 1515 bp, Streptococcus agalactiae
atgacttattaccttagtattgactacggcggtacaaataccaaggcgcttatttttgacaaattaggacaccaaatcgctgtttcgagttttgaaactttaaaaaatgagactcaatctggtcatcgtcaagtaaaccttgttaaaacgtggaatgctataacttctgctattagagaggttattcaaatctcaaaactcagccctgagcagattagtgcagtagcatgtattggacatgggaaaggtctttatctgctagataataagttggagccacttgaacaaggaattttgtctacagataatcgtgccaaagatttggcgcaatatttcgaatctaaacttgataatatttgggagttgactcggcaacatattttcccttcacaaagtccagttattttacgttggcttaaagattatcagcccgaaacctataaatcaataggggcggtcctttctgcaaaggactttattcggtataagcttacaggaaaagtacagcaagaatatggtgacgcttcaggtaatcattggataaatttccaaacaggaacttatgatccagctattttagatttttttggcattagagagatagaaaactcacttcctgaacttatagatagtgcagatttagttcctgggggaattagttctcaagcagcaaaagagactggtcttgtagaagggacccccgttgttggagggctctttgacatcgatgcttgtgctcttggatcaggtgttttagagtcagatacttttagtgttatttcgggaacttggaatattaatacatatccaagtttaaaaccagcaaagcaagatagtggtcttatgacttcctattttccagatcgtcgttatctcttagaggcaagtagccctacttctgcagggaatcttaattttatgttaaaaatgctcatgcatcaagaaattgataacgctaaatctagtggaggttctatctatgataatttagaagaatttctcactcatactgatgctacacatcatggacttattttctttccgtttctttacggtagtaacacatcacaagatgctagcgcttgcttttttgggctaacaactaaatcgacgaaatctcagatgatacgtgcggtatatgaaggtattgcgtttgcacataagcagcatatcactgatttaataaaaagtaggggcagtgtgccaaaaataattcgtttctctggcggagctaccaactcaccagcatggatgcaaatgttttctgatatcttaaactttcctattgaaacagtagaaggcacagaattaggagggttaggaggagctattttagcacgtcatgctttagataagatttcgttaaaggaagcagtccaagatatggttcgtgtaaaagctatttataaacctcaattatccgaagtaaaggggtacaaaaaaaaatatcacgcttaccaaaaattattagaaacactggatcctatttggtcggaactcggtcatctgaataag

SEQ ID NO: 10148 - protein, 505 aa, Streptococcus agalactiae
MTYYLSIDYGGTNTKALIFDKLGHQIAVSSFETLKNETQSGHRQVNLVKTWNAITSAIREVIQISKLSPEQISAVACIGHGKGLYLLDNKLEPLEQGILSTDNRAKDLAQYFESKLDNIWELTRQHIFPSQSPVILRWLKDYQPETYKSIGAVLSAKDFIRYKLTGKVQQEYGDASGNHWINFQTGTYDPAILDFFGIREIENSLPELIDSADLVPGGISSQAAKETGLVEGTPVVGGLFDIDACALGSGVLESDTFSVISGTWNINTYPSLKPAKQDSGLMTSYFPDRRYLLEASSPTSAGNLNFMLKMLMHQEIDNAKSSGGSIYDNLEEFLTHTDATHHGLIFFPFLYGSNTSQDASACFFGLTTKSTKSQMIRAVYEGIAFAHKQHITDLIKSRGSVPKIIRFSGGATNSPAWMQMFSDILNFPIETVEGTELGGLGGAILARHALDKISLKEAVQDMVRVKAIYKPQLSEVKGYKKKYHAYQKLLETLDPIWSELGHLNK

SEQ ID NO: 10149 - DNA, 645 bp, Streptococcus agalactiae
atgaaatactttttagatactgccgatgtttctgaaattcgtcgtcttaatcgtttaggaatcgttgatggtgttactaccaatccgactattatttcacgtgaggggcgtgactttaaagaagttattaacgaaatttgccaaatcgttgatggcccagttagtgcagaagtgacaggtttaacttgtgatgaaatggttaccgaagctagagaaatcgctaagtggtcaccaaatgttgttgttaaaattccaatgactgaagaaggtttagcagcagtttcacaattatcaaaagaaggtataaagacaaatgtgacattaatatttactgtggctcaaggtctttcggcaatgaaagctggtgcaacatttattagtccttttgtgggtcgtcttgaagatattggaacagatgcttatgctttgattcgtgaccttcgtcacattattgatttttatggtttccaatctgagattattgctgctagcattcgtggattggcgcatgtggagggcgtcgctaaatgcggtgcgcacattgccactattccagataaaacatttgcatcactatttactcacccgcttactgataaagggattgaaactttcttaaaagattgggatagtttcaagaagaag

SEQ ID NO: 10150 - protein, 215 aa, Streptococcus agalactiae
MKYFLDTADVSEIRRLNRLGIVDGVTTNPTIISREGRDFKEVINEICQIVDGPVSAEVTGLTCDEMVTEAREIAKWSPNVVVKIPMTEEGLAAVSQLSKEGIKTNVTLIFTVAQGLSAMKAGATFISPFVGRLEDIGTDAYALIRDLRHIIDFYGFQSEIIAASIRGLAHVEGVAKCGAHIATIPDKTFASLFTHPLTDKGIETFLKDWDSFKKK

SEQ ID NO: 10151 - DNA, 657 bp, Streptococcus agalactiae
ttggttgaaactagaccaaatgtcattgtctccagctccaaaacagctctattagagcatgatggtattagtggtgcagttgtgcaatcgaatagacaccgtggactaattgagaagccttatcatatcactttaattgagccaagcgatgaagaaatttatcgcttttctgctcttttgaaccgtgaaaagttttggttggaaaatgaacaggaaccaactattaggctttggtgttataaggttgatagctttgagattggaaaagacgaatttggtgcctgggtggtcgatgttaccttcatctgccaccctaccaagtttttcaagaccactgacatccagacattgactggtaatggggttttgagggttcaagggtcagctcttgcttttccgaagattacagtggttggtcagagcgcttctgagacatcgtttacgataggtaaccaagtgattaagcttgaaaagctctcagaatcgctcgtgatgaccaatgatcctgacaatcctagctttaagacggctagtggaaaactcattaagtgggctggtgattttatcacagttgatactgctaaggggcagaatgtcggtgttgttttaggtgctggcataacatctttgaaatttgaaacagtttgggggtgggca

SEQ ID NO: 10152 - protein, 219 aa, Streptococcus agalactiae
MVETRPNVIVSSSKTALLEHDGISGAVVQSNRHRGLIEKPYHITLIEPSDEEIYRFSALLNREKFWLENEQEPTIRLWCYKVDSFEIGKDEFGAWVVDVTFICHPTKFFKTTDIQTLTGNGVLRVQGSALAFPKITVVGQSASETSFTIGNQVIKLEKLSESLVMTNDPDNPSFKTASGKLIKWAGDFITVDTAKGQNVGVVLGAGITSLKFETVWGWA

SEQ ID NO: 10153 - DNA, 342 bp, Streptococcus agalactiae
atgggcggtggtagcgtgaagatgacaccgctaaaggtggatatcaagaatcaagttttagagaacattaagaaggctgcccaaagtacagaaaatgacattagaactggaagccctagacgaaacggtgtttacgaaaaaggttggacacacgacatcatagatgacgccgctgttgttcataataatggcaaagaaaaatctctatcccacctattagagaatggtcatgccactaaaaacggtggctttgttgcccctagagagcatatcagaccagcctacctcaagaataaggagaaattccttaatgatatgaaatccattaaaatcacacctaaa

SEQ ID NO: 10154 - protein, 114 aa, Streptococcus agalactiae
MGGGSVKMTPLKVDIKNQVLENIKKAAQSTENDIRTGSPRRNGVYEKGWTHDIIDDAAVVHNNGKEKSLSHLLENGHATKNGGFVAPREHIRPAYLKNKEKFLNDMKSIKITPK

SEQ ID NO: 10155 - DNA, 1260 bp, Streptococcus agalactiae
atgaaaaaatcactcattgagcttttggaagctcgtcaaaaagcaactgatgaactggctgaggtaaagcttaaaaaagccactattgaagcaaagatgaaatcttcaaccattgaagacgatgacttggaacagttaaaaactgatgcagaaagtttggtttctcaagcaacagctattaaggaaacaattgctgggctggattctgacattgaagaaactgaagaagaactcagcaaagctgctaaaatcattaaagaaaaacagaaaggtaatacacctatggattatttgaaaaccaaagccgctgctcttgactttgtccgtattctgatggacaacgaaggtagcgcaaacagtgcccgtaaagcgtgggaagctaaccttgttgaaaaaggagtgactaacctcactaagattcttccagaacctgttcttatcgctattcaagatgcctttactaactataatgggatcttgaaccacgtttcaaaagatccacgttatgcggtgcgtgttgctcttcaaactcaagtatctcaagctaaaggacacaaagctggtaagactaagaaagatgaagacttcacattcttggatttcactatcaactctgcgacagtttatatcaaatatgcctttgaatattctgacttgaagaaagatacaacaggcgcttacttcaactatgtgatgaaagaacttgctcaaggcttcatccgaactattgaacgtgctgttgtcattggtgatggaaaatctaacagtgctgaagacaaaatcactgaaatcaaatcaattgctgaagaaactgaagcgaatctctttgaaacacaagaaatcaatgttgctggtgtatttgacaatgctgttcttgaaacgctggttgctggtattgataagatggttccaaatactactccaattcttgtcacttcaaaagccattgctcgtaaattgaaattggtcaaagatgcagaaggtcgctacatcgatcctcaaccatttgctccaattgcaaccaacggaaatgttattgctggttttcaagtttacatctatgactggatggacggtgcaactaacccaatcattgcatttgctgaccaagcttataagatgattggtgatgaggctgccgctgaccgctttgatgattatgatgtaacagtcaaccgccgtcatattgagcttgctagtgttatgggtggtcgtttggctcagtacaaatcagcggttaagtttacaaacccagcaggt

SEQ ID NO: 10156 - protein, 420 aa, Streptococcus agalactiae
MKKSLIELLEARQKATDELAEVKLKKATIEAKMKSSTIEDDDLEQLKTDAESLVSQATAIKETIAGLDSDIEETEEELSKAAKIIKEKQKGNTPMDYLKTKAAALDFVRILMDNEGSANSARKAWEANLVEKGVTNLTKILPEPVLIAIQDAFTNYNGILNHVSKDPRYAVRVALQTQVSQAKGHKAGKTKKDEDFTFLDFTINSATVYIKYAFEYSDLKKDTTGAYFNYVMKELAQGFIRTIERAVVIGDGKSNSAEDKITEIKSIAEETEANLFETQEINVAGVFDNAVLETLVAGIDKMVPNTTPILVTSKAIARKLKLVKDAEGRYIDPQPFAPIATNGNVIAGFQVYIYDWMDGATNPIIAFADQAYKMIGDEAAADRFDDYDVTVNRRHIELASVMGGRLAQYKSAVKFTNPAG

SEQ ID NO: 10157 - DNA, 477 bp, Streptococcus agalactiae
ttgaaaatcaatgaagttttagaaaagctaggaataagtcgtgctacccttacaaggtatcgaaaaaagctgggcatatttgaagaaactaggtcaaatatcaccaaaagtcagttcaaagagttggaaaagcttgccaatcaacggcaaaagtacacaaggcaggaacgtgttgagctatctcgtaagactttcaagctgattccaaaagaaaaaatgcttgaaatcagtgataatgattcagttgggttgaaaaatctcaaaactcaatacaatcacaatcaaaaagtgattgaaaacttccagcttgaaatcaataaggtcatcaatgacggtgagctacctgataagtacctacttgatggaatggaaaagtatcaaaagcttaacatgcagatcatgtcaacgattgaaaagcaaagtccacagggtgacaggctcaaagaaatgattcaggagaagttagcacgttatggt

SEQ ID NO: 10158 - protein, 159 aa, Streptococcus agalactiae
MKINEVLEKLGISRATLTRYRKKLGIFEETRSNITKSQFKELEKLANQRQKYTRQERVELSRKTFKLIPKEKMLEISDNDSVGLKNLKTQYNHNQKVIENFQLEINKVINDGELPDKYLLDGMEKYQKLNMQIMSTIEKQSPQGDRLKEMIQEKLARYG

SEQ ID NO: 10159 - DNA, 345 bp, Streptococcus agalactiae
atgaagttaaggcttgaagaactaagaaacaaacttggcctcagtcgcagagatgtgcatgaagccactggcatttctatgaacacgctgctacattatgaaaaaggcggtacaccatctattggtcaggttgaaaatatcgctaaggcttacaatatcaacccagcctggttgcttggttggattgatgaaggccagcaaccacaaccacttgaaaccgttgttgaaaagattatctatgtggaaaaggaaggctgtagattaccgccatattggaacaatgataataatggcagaatcatcaagtggaaagaatcaagaagagcattccaaaggagaacaatt

SEQ ID NO: 10160 - protein, 115 aa, Streptococcus agalactiae
MKLRLEELRNKLGLSRRDVHEATGISMNTLLHYEKGGTPSIGQVENIAKAYNINPAWLLGWIDEGQQPQPLETVVEKIIYVEKEGCRLPPYWNNDNNGRIIKWKESRRAFQRRTI

SEQ ID NO: 10161 - DNA, 258 bp, Streptococcus agalactiae
atgaacgaatataagaaacccacctacatcgtcattcaagaggcaatggctgagcgtattagatttcttgaagatgaattatataacagagcatacaaagacattgaacggctagaagttgagaatgaccgtctgaaggttagatgccttgatttgcagttggaaaatgctgactatgtctgggatgacatgtgtcgctctgctattgctcgtgcaaaatcagaaaatcgaagaccacacagaagatggaggggaaga

SEQ ID NO: 10162 - protein, 86 aa, Streptococcus agalactiae
MNEYKKPTYIVIQEAMAERIRFLEDELYNRAYKDIERLEVENDRLKVRCLDLQLENADYVWDDMCRSAIARAKSENRRPHRRWRGR

SEQ ID NO: 10163 - DNA, 414 bp, Streptococcus agalactiae
atgatcaataatgttgtacttattggccgcttgacaagagatgttgagctacgttacacgccgtcaaacatcgcaaacgctacttttaacctagcagtcaatcgaaatttcaagaatgctgctggtgatcgtgaagctgatttcatcaactgtgtgatgtggcgacaacaagctgaaaacttggccaattggacgaaaaaaggaatgctgattggtattactggacgaatccagacaagaagctacgaaaatcagcaaggtcagcgtatctatgtgactgaggttgttgctgacagcttccagattcttgaaaagcgtgataattcaacgaaccaggcaagcatggatgaccaattgccaccatcatttggaaatagtcagcctatggatatttcagatgatgatctaccgttt

SEQ ID NO: 10164 - protein, 138 aa, Streptococcus agalactiae
MINNVVLIGRLTRDVELRYTPSNIANATFNLAVNRNFKNAAGDREADFINCVMWRQQAENLANWTKKGMLIGITGRIQTRSYENQQGQRIYVTEVVADSFQILEKRDNSTNQASMDDQLPPSFGNSQPMDISDDDLPF

SEQ ID NO: 10165 - DNA, 1311 bp, Streptococcus agalactiae
atgaaatttttagacctctttgctggcattggtggttttcgccttggaatggagcaagctgggcatgagtgcataggattctgtgaaataaataaatttgctagagctagctacaaagtaatacatgatactgaaggagaaattgaactacatgacatcacaagagtttcagatgagtttattcgaggaatcggaagtgtggacgttatctgtggcggatttccgtgccaggctttctcaattgctggaaatagacgaggttttgaagatacacgaggaactttgttctttgaaattgctaggttcgcatctattctcagacctaagtatctattccttgagaacgttaaaggactcctcaaccacgaagggggggctacattcgagaccatcatcagaaccttggatgaattggggtacaacgtggaatggcaaatctttaacagcaagaattttggagtcccccagaatagggaacgagtgtttattatcggacatcttagaggagaaggtaccagaccaatttttcctttcgaatcaagcatcacagaaaattatcctatccacaccagaaaaataggaaatgttaatccatctggtaatggaatgaatggggaagtgtatgattcggaaggtttatctccaactctaacaacaaataagggagaaggagttaaaatcgctgtaaatgttgtaggcagattacctgggaaatttgaaatgccaaatagagtctacgatccagatggcctagcaccgactatcagaactatgcaaggtggagggttagagccaaaaataattcagcgaggcagaggctataatcagggaggagaatatgaaatttctccaactgtcacatgcaacagttggcaagaaaacaatcttttaaagataaaagaagccactaaaaaaggctattcagaggcagaggctggcgattcagtaaacttatctcacccaaattctgagacaagacgtggacgagttggtaaaggtattgccaatactctcttgactggagaagaacaaggtgtggttgtttatgacttgtacaacagaagaaagaaagatattgttggcactttaacagctagcggtcataacggtaatactactacgggtacttttggtatctctaacggatttagaatcagaaagcttacacctcgtgagtgttggaggctacaaggcttccctgactgggcttttgacaaggcgagtcaggtcaatagcaacagtcaattatataaacaagctggtaatagcgtaacagtaaacgtcattgctgcaattgcaaggagattgcta

SEQ ID NO: 10166 - protein, 437 aa, Streptococcus agalactiae
MKFLDLFAGIGGFRLGMEQAGHECIGFCEINKFARASYKVIHDTEGEIELHDITRVSDEFIRGIGSVDVICGGFPCQAFSIAGNRRGFEDTRGTLFFEIARFASILRPKYLFLENVKGLLNHEGGATFETIIRTLDELGYNVEWQIFNSKNFGVPQNRERVFIIGHLRGEGTRPIFPFESSITENYPIHTRKIGNVNPSGNGMNGEVYDSEGLSPTLTTNKGEGVKIAVNVVGRLPGKFEMPNRVYDPDGLAPTIRTMQGGGLEPKIIQRGRGYNQGGEYEISPTVTCNSWQENNLLKIKEATKKGYSEAEAGDSVNLSHPNSETRRGRVGKGIANTLLTGEEQGVVVYDLYNRRKKDIVGTLTASGHNGNTTTGTFGISNGFRIRKLTPRECWRLQGFPDWAFDKASQVNSNSQLYKQAGNSVTVNVIAAIARRLL

SEQ ID NO: 10167 - DNA, 600 bp, Streptococcus agalactiae
atgaaaaaatttgaccactatttcagcaaccatattgctgtaaaaaacgaatctgatacagtcaccattgttgactattacaatccagaaaagggctatgagtataacttacgttacattttcgatagaaaaaattcatcccttgctatcacaggagactttggggaattagttgcacgaaatttctacaatatgggtgaatgggacacattctacaatcactatactggtcatctggggtattttcttgaaaagttactatgttcaagtaggccagttcattactatgatactgacaaggctaaaagagaaattctcaatgaattctttgatggtgctgattatgatgatttagattttgatgatgaattcctacttgatcaattatttgacaattttgacgaagataaaggatttacttatattcttccagaggcttttgaacgttttagcgaagatatggaagaatatgaggtctatgaatttctatcaagggctggccgatacgtcaatgatgtctttgaactttacttagacgcttataagagagcttatgagtatctaacaaaggaggttgatgatggcacaacgcagaatgtt

SEQ ID NO: 10168 - protein, 200 aa, Streptococcus agalactiae
MKKFDHYFSNHIAVKNESDTVTIVDYYNPEKGYEYNLRYIFDRKNSSLAITGDFGELVARNFYNMGEWDTFYNHYTGHLGYFLEKLLCSSRPVHYYDTDKAKREILNEFFDGADYDDLDFDDEFLLDQLFDNFDEDKGFTYILPEAFERFSEDMEEYEVYEFLSRAGRYVNDVFELYLDAYKRAYEYLTKEVDDGTTQNV

SEQ ID NO: 10169 - DNA, 282 bp, Streptococcus agalactiae
atgaatgatctaatgattcaaatgcttgaccagttcgaagctggtctaatggacagaacgatgaaagtaatgcacgttgtgacagacgaaaagtatagatttcctttagaactcaacaagtctcaatgcgctttaatgctcttaggtactaaagatactgggacatttgatgaacgctttaactgtcataaggattttccgaggattccaaatgctcgtgagaaataccctcgtgatgaagtcattgaatggtatcacaagaattggcaaagaactgttatc

SEQ ID NO: 10170 - protein, 94 aa, Streptococcus agalactiae
MNDLMIQMLDQFEAGLMDRTMKVMHVVTDEKYRFPLELNKSQCALMLLGTKDTGTFDERFNCHKDFPRIPNAREKYPRDEVIEWYHKNWQRTVI

SEQ ID NO: 10171 - DNA, 468 bp, Streptococcus agalactiae
atgaatttgaatcaaattcgtatcatagaggcatgccataaatttctaattggcatcacaaatttcgaagaagagttacaagatgacgttctcgtctatcgttacaaaggtaaccttgtcagctttgaaacctatcaagaatatgaacaacggtcatttgtagactataatctaaaatatggctatcttgatgacactagaacttacctagatgacagagctgatttgatagcagctttccctagcgaagagcacttgagagccttgcaaagagttaacgatgctgaacaagctcgtgtgcaaatctttaagctactatctcaggtcaatcttgactctctctccgaaaaaaattccaacatcaaaaaagataattttggatatgatttcttcaattttgcaactaaagaagaataccctgtttatcttttttcagatgatgaatcatttgagctagttgctatcagt

SEQ ID NO: 10172 - protein, 156 aa, Streptococcus agalactiae
MNLNQIRIIEACHKFLIGITNFEEELQDDVLVYRYKGNLVSFETYQEYEQRSFVDYNLKYGYLDDTRTYLDDRADLIAAFPSEEHLRALQRVNDAEQARVQIFKLLSQVNLDSLSEKNSNIKKDNFGYDFFNFATKEEYPVYLFSDDESFELVAIS

SEQ ID NO: 10173 - DNA, 1068 bp, Streptococcus agalactiae
atggcatcatatcgaaaaagagagaacgggctgtgggaataccgcatttcctacaaaaccatagatggaaaatataaacggaaagagaaaggtggttttaagaccaagaagcttgctcaggcggcagcaatcgaaattgaaaagaaattgacccaaaacatcttgacaaatgacgaagtaactctatatgactttgtcaagacctggtcagaagtctataagcgtccgtatgtaaaagataagacttgggaaacctattcaaaaaactttaagcacatcaagaactatttccaagagttgaaggtcaaagatattacaccgctttactaccaaaaaaagttgaatgagtttggcgagaaatatgcccaagaaactcttgagaaatttcactatcaaataaaaggggctatgaaagttgctgtaagggaacaggttgttacctttaattttgcagaaggtgcaaaagtgaaatctcaggtagagcccaaaaatgaagaggaagattttttagaggagcgcgaatataaggctctcttggcccttacaagagagaacatccaatatgtatcctatttcactctttaccttcttgcagtcacaggactgcgtttttctgaggctatggggctaacctggagcgatatagacttcaaaaatggcattttggatataaacaagagttttgattactcgaatactcaagattttgcagatctgaagaatgagtcatcaaaaagaaaagttccaattgattcaaatacaatagatattcttcgagaatataagaaaaatcattggcaagctaatatcaagaatagagtgtgctttggtgtatctaattcagcttgcaataaactgattaagaaaattgtgggtaggaaagtcagaaatcactcattacggcacacatacgcttcgtttttgattttgaacggggttgacattgtgacaatttctaagctccttggacatgaaagtccagatattactctgaaagtttatacacatcagatggaagcactggctgagagaaattttgagaaaatcaaaaatatttttttagtcgca

SEQ ID NO: 10174 - protein, 356 aa, Streptococcus agalactiae
MASYRKRENGLWEYRISYKTIDGKYKRKEKGGFKTKKLAQAAAIEIEKKLTQNILTNDEVTLYDFVKTWSEVYKRPYVKDKTWETYSKNFKHIKNYFQELKVKDITPLYYQKKLNEFGEKYAQETLEKFHYQIKGAMKVAVREQVVTFNFAEGAKVKSQVEPKNEEEDFLEEREYKALLALTRENIQYVSYFTLYLLAVTGLRFSEAMGLTWSDIDFKNGILDINKSFDYSNTQDFADLKNESSKRKVPIDSNTIDILREYKKNHWQANIKNRVCFGVSNSACNKLIKKIVGRKVRNHSLRHTYASFLILNGVDIVTISKLLGHESPDITLKVYTHQMEALAERNFEKIKNIFLVA

SEQ ID NO: 10175 - DNA, 234 bp, Streptococcus agalactiae
atgtctcaattatctttggaagaacaattgaatcgactaaaagataaatacctttcttctaaaaatcaagaattttcaaatgttcacttaagtaaagtaaagaagaaaaagaagaaattaataatacttgaaaaagaaagatgtcgctgtcgattggagagagaagatactaaaaaaatcgatgataaaattgagaaattgaagaaagaattgatagatgttatgaaggaggaa

SEQ ID NO: 10176 - protein, 78 aa, Streptococcus agalactiae
MSQLSLEEQLNRLKDKYLSSKNQEFSNVHLSKVKKKKKKLIILEKERCRCRLEREDTKKIDDKIEKLKKELIDVMKEE

SEQ ID NO: 10177 - DNA, 642 bp, Streptococcus agalactiae
atggatatagaaaactactgccaagactactgtttggagactatctttccaaaacattatttcaaggatttacaagtaatcaccctaactgccggccaatccgtctgtaaacagggagaacaattagaatacttgcactacatcgtcaagggacgttttaaaattgtacgtcgactctttaacggcaaagaacatattttagatattaaaacaaaaccaacactgattggtgatattgaacttttgactaatagacaaattgtatcatctgttattgccttagaggatcttacagtcattcaattatcacttaaaggacggaaagagaaactgttaacagacgcaactttcctcctaaaacttagtcaagagctagctcaggcttttcatgatcaaaacatcaaagcgtctactaatctagggtataccgtcaaagagttacttgcaagtcatattttagcaattgaagaacaaggttactttcaacttgagttaagtagtttagctgattcgtttggcgtcagttatcgtcatttattaagagttatccacgatatggtcaaagaaggccttatccaaaaagaaaaaccaaaatactttatcaaaaatcgtttcgcactagaatcattaaatattcagcca

SEQ ID NO: 10178 - protein, 214 aa, Streptococcus agalactiae
MDIENYCQDYCLETIFPKHYFKDLQVITLTAGQSVCKQGEQLEYLHYIVKGRFKIVRRLFNGKEHILDIKTKPTLIGDIELLTNRQIVSSVIALEDLTVIQLSLKGRKEKLLTDATFLLKLSQELAQAFHDQNIKASTNLGYTVKELLASHILAIEEQGYFQLELSSLADSFGVSYRHLLRVIHDMVKEGLIQKEKPKYFIKNRFALESLNIQP

SEQ ID NO: 10179 - DNA, 423 bp, Streptococcus agalactiae
atgggaaactttaaaaattcagcggttaaatctatggttgtcatgcgaaaagcatttagaacaatagacggaaaagtctcagaatcatttaaagaatttgaattaacaccaactcagtttgcagttttggatgttctctatgctaaaggcacaatgaaaattggagaattgattgaaaatatgcttgctacatcaggtaatatgactgttgttattaaaaatatggaaaaaaagggatgggtattacgccattcttgtccgaatgataagagagcctttttggtgagtttaacaactgaaggagaagaagtgataaaaaaagctctaccagagcatattaaacgtgtagaagatgctttttcagtcttaacagaaacagagcaagaagacttgattaaccttttaaaaaaatttaaaaccttg

SEQ ID NO: 10180 - protein, 141 aa, Streptococcus agalactiae
MGNFKNSAVKSMVVMRKAFRTIDGKVSESFKEFELTPTQFAVLDVLYAKGTMKIGELIENMLATSGNMTVVIKNMEKKGWVLRHSCPNDKRAFLVSLTTEGEEVIKKALPEHIKRVEDAFSVLTETEQEDLINLLKKFKTL

SEQ ID NO: 10181 - DNA, 1836 bp, Streptococcus agalactiae
atgcttattccaacacttcgcgaaatgccaagtgatgctcaggttatcagccatgctcttatggttcgtgcaggatatgtccgccaagtttcggctggaatctatgcttatttgcctctagctaaccgtactattgaaaaatttaaaacaattatgcgtcaagaatttgagaagattggtgcagttgaaatgttagctccagctcttcttacagcagatttatggcgtgaatctgggcgctacgaaacatatggtgaagacctttataaattaaagaatcgtgatcaatcggattttatcttaggaccaactcatgaagagactttcacaactcttgttcgtgatgcagtaaaatcttataagcaattaccactaaacctttatcaaattcagtctaaatatcgtgatgagaagcgtcctcgtaatggacttcttcgaacacgtgaatttatcatgaaagatggatacagcttccacaaagattatgaagaccttgatgtcacttacgaagattaccgtaaagcatatgaagccatcttcacacgtgctggacttgactttaaaggcattataggtgacggaggtgctatgggaggtaaagatagccaagaatttatggcagtaactcccaatcgtacagatttaaatcgttggttagtccttgataaaactattccttctattgatgatattccagaggatgttttagaagaaattaaggtagaactctcggcttggctagtttctggtgaggacactattgcatactctactgaatcaagctatgctgctaaccttgagatggcaacgaatgagtacaaaccatctactaaggctgctacctttgaagaagtaacaaaagtagaaactcctaactgcaaatcaattgatgaggtagctggatttttatcaattgatgaaaatcaaactatcaagacactattgtttattgctgatgaacagcccgtggttgctttactagttggtaacgatcaagtcaatgatgtgaagttaaaaaattatttagcggctgatttcttagagcctgcaagtgaagagcaagcaaaagagatttttggtgcaggttttggttctcttgggccagttaacctacctgactctgttaaaattattgctgatcgtaaagttcaagaccttgctaatgctgtgtctggtgctaaccaagatggttatcattttactggagttaatccagaacgtgatttcacagctgaatacgttgatattcgtgaagtaaaagaaggggagatttctccagacggtaaaggtactctgaaatttgctcgtggtattgaaattggacatatctttaaactaggtacccgttattcagatagtatgggagcgaacatccttgatgaaaatggccgctcaaatcctattgttatggggtgttatggtattggtgttagtcgtattctctcagctgtcattgaacaacatgcccgactttttgtgaataagacaccaaaaggagcttatcgctttgcttgggggattaatttcccagaagaattagccccatttgatgtacatttgattactgtcaatgtcaaagatcaagagtcacaagaccttactgagaaaattgaagctgatttgatgcttaaaggttatgaagtcctgacagacgatcgtaatgaacgtgttggttctaaattctcagacagtgacttaattggacttccaattcgagtaactgttgggaagaaagcttctgaaggtatcgttgaagtgaaaattaaagcaagtggtgatacgattgaggttcacgctgataacttaattgaaactttagagattctaacaaaaaaa

SEQ ID NO: 10182 - protein, 612 aa, Streptococcus agalactiae
MLIPTLREMPSDAQVISHALMVRAGYVRQVSAGIYAYLPLANRTIEKFKTIMRQEFEKIGAVEMLAPALLTADLWRESGRYETYGEDLYKLKNRDQSDFILGPTHEETFTTLVRDAVKSYKQLPLNLYQIQSKYRDEKRPRNGLLRTREFIMKDGYSFHKDYEDLDVTYEDYRKAYEAIFTRAGLDFKGIIGDGGAMGGKDSQEFMAVTPNRTDLNRWLVLDKTIPSIDDIPEDVLEEIKVELSAWLVSGEDTIAYSTESSYAANLEMATNEYKPSTKAATFEEVTKVETPNCKSIDEVAGFLSIDENQTIKTLLFIADEQPVVALLVGNDQVNDVKLKNYLAADFLEPASEEQAKEIFGAGFGSLGPVNLPDSVKIIADRKVQDLANAVSGANQDGYHFTGVNPERDFTAEYVDIREVKEGEISPDGKGTLKFARGIEIGHIFKLGTRYSDSMGANILDENGRSNPIVMGCYGIGVSRILSAVIEQHARLFVNKTPKGAYRFAWGINFPEELAPFDVHLITVNVKDQESQDLTEKIEADLMLKGYEVLTDDRNERVGSKFSDSDLIGLPIRVTVGKKASEGIVEVKIKASGDTIEVHADNLIETLEILTKK

SEQ ID NO: 10183 - DNA, 849 bp, Streptococcus agalactiae
atggattttaaggaactgtttccagaagttattactaaacaggaagttaaacagagtgaggattatatcatcgttgagcaagatggtcatgtcctccactttccaaaatcttcgctaactaagcgtgaactatacttattacaaatgacaccaagcctggaagatgcgagttcagtggattctcagaatccttggtaccgctatctagttgaaggtcgtggaaggttgccccaatctcattcggcagtccaatttatttttattgagcatcaatttaccttatcagaagaacttaaggatttcttgtcgcctttagtaataaacgtagaaacaattatgacaattaatcaaacccaaagtgtcatgattttaaatcaggataatttctttaatgctacggaattactaacagatattttaccaacgattgaaaatgactttaacacgcgtttaaggtgctattttggaaatagttggacgcatctacaagcagtggactggaaagaattatatgaagaagaatataaactttttacgctttttcttagtcacaaggccgaacaacattactgtcgatttccaaagatggctttatgggctttggcaaatcaatcgcccatgccttctattaaagcaaaatgtttacaacatatccttgatacgagtgatacttcggctataataaaagccctgtggcaagagcaaggaaatcttgctaaaacggctaaggcacttttcattcatcggaattcattgcaatataaattagataaatttacccaatcttcgggacttaatttaaaaatattagatgatttagcctatgcctatttgatttcgatggatacc

SEQ ID NO: 10184 - protein, 283 aa, Streptococcus agalactiae
MDFKELFPEVITKQEVKQSEDYIIVEQDGHVLHFPKSSLTKRELYLLQMTPSLEDASSVDSQNPWYRYLVEGRGRLPQSHSAVQFIFIEHQFTLSEELKDFLSPLVINVETIMTINQTQSVMILNQDNFFNATELLTDILPTIENDFNTRLRCYFGNSWTHLQAVDWKELYEEEYKLFTLFLSHKAEQHYCRFPKMALWALANQSPMPSIKAKCLQHILDTSDTSAIIKALWQEQGNLAKTAKALFIHRNSLQYKLDKFTQSSGLNLKILDDLAYAYLISMDT

SEQ ID NO: 10185 - DNA, 894 bp, Streptococcus agalactiae
atggctattacgatacaaaatcatgagttgcaagtgacattaaaagcgttaggtgcaacaatgacttctattacagatagtcaaggcgttgagtacctttggcaaggggacgccacttattggggtgggcaagctcctattttatttcctatatgcggaagtgttcgaaatgattgcgtcatttacagaccagctcaagctccacattttacgggtatcataccaaggcatggctttgtacgtcacaaaacattcgactatgattacatatcggattcttctgttcgttttacaattaaaagtagtaaagaaatgttgataaattatccttatcgttttagtttagaaataacttacaccttaagaaataaaagcattgccattacatatattgtcaaaaacttagaatcagaaaaaaatatgccatatgctatcggagctcacccaggctttaattgccctttgtttgaaaaggaagtatttagtgattactatctagagtttgaacagtttgaaacttgcacaattcctgagtcgtttccggatacaggcttgttagatttacaagctagacatccttttttagaaaatcaaaaacaattatctcttaatcatgctttatttgaaaaagatgctattactttagaccaactacgatctaagacggtttacttaaaatctagaaatcatgcaaaaggaatccaacttgactttgatgattttgagaatcttattctttggacaagtaacaatggtggtccttttttggctttggaaccctggagttctttgtcaacttctattgaagagtctgatattttagaagataaacaaaatatcgtacggcttaatccaaagcagtcgaaacagcattctattcggatcactatttta

SEQ ID NO: 10186 - protein, 298 aa, Streptococcus agalactiae
MAITIQNHELQVTLKALGATMTSITDSQGVEYLWQGDATYWGGQAPILFPICGSVRNDCVIYRPAQAPHFTGIIPRHGFVRHKTFDYDYISDSSVRFTIKSSKEMLINYPYRFSLEITYTLRNKSIAITYIVKNLESEKNMPYAIGAHPGFNCPLFEKEVFSDYYLEFEQFETCTIPESFPDTGLLDLQARHPFLENQKQLSLNHALFEKDAITLDQLRSKTVYLKSRNHAKGIQLDFDDFENLILWTSNNGGPFLALEPWSSLSTSIEESDILEDKQNIVRLNPKQSKQHSIRITIL

SEQ ID NO: 10187 - DNA, 930 bp, Streptococcus agalactiae
atgattttaacagtaactttgaacccttctattgatatttcgtactgcttagaaaactttaacatggatactgtaaatcgagttaccgacgtctccaaaacacctgggggtaaggggttaaatgtgactcgtgttctttctcaacttggcgataatgtagtggcaactggtctattagggggggattttggagatttcatccgaagtggcttagatgcattggaaatcagacaccaatttttaagtattggtggagaaacacgtcattgtattgcagttttacatgagggtcagcagactgaaattctagaaaaaggtccacatattactaaagatgaagcagacgcctttttgaatcatctaaaacttatctttgatgctgcaactatcataacagtatcaggaagtttaccaaagggactcccctcagattattatgctaggttaatctccctagcgaatcactttaataagaaagttgttttagactgttcaggagaagcattacgttcggttttaaaatctagtgctaagccgaccgtcattaaacctaaccttgaagaattaacacaattaattggaaaaccaattagctatagtttagacgaattaaaatctaccttacagcaagatctttttagaggaattgattgggttattgtttctttaggtgctaggggagcttttgctaaacatgggaatcactactatcaagtgacgattccaaaaatagaagttattaatccagttggttcaggggatgcaacggttgcaggaatcgcgtctgctttggaacatcaactagatgatacaaatttgcttaagagagctaatgtcttgggtatgcttaatgcacaagaaacattaacagggcatatcaatctgacctactatcaagaattaatcagtcaaatccaagtgaaagaggta

SEQ ID NO: 10188 - protein, 310 aa, Streptococcus agalactiae
MILTVTLNPSIDISYCLENFNMDTVNRVTDVSKTPGGKGLNVTRVLSQLGDNVVATGLLGGDFGDFIRSGLDALEIRHQFLSIGGETRHCIAVLHEGQQTEILEKGPHITKDEADAFLNHLKLIFDAATIITVSGSLPKGLPSDYYARLISLANHFNKKVVLDCSGEALRSVLKSSAKPTVIKPNLEELTQLIGKPISYSLDELKSTLQQDLFRGIDWVIVSLGARGAFAKHGNHYYQVTIPKIEVINPVGSGDATVAGIASALEHQLDDTNLLKRANVLGMLNAQETLTGHINLTYYQELISQIQVKEV

SEQ ID NO: 10189 - DNA, 513 bp, Streptococcus agalactiae
atgaaaattgcggtcggttgtgatcatattgtaacttatgacaaaattgcagttgtggattatttaaaaacaaaagggtatgaggttattgattgtggaacttatgataatatccgtactcactatcctatttatggtaagaaagtaggagaagctgtcgctagtggaaaagccgacttaggtgtatgtatttgtggaactggagttggtattaataatgctgttaataaagttccaggaattcgctcagctctggtacgtgatttgacatcagctatctatgccaaagaagaattaaatgctaacgttatcggatttggtgggaaaattactggtgggctgttaatgacagatatcatcgaggcgtttataagagctaaatataaaccaacaaaagaaaacaaagtattaattgaaaagatagccgaggttgagactcataatgcccatcaagaagagaatgactttttcacagagttcttagataaatggaatcgtggtgaatatcacgac

SEQ ID NO: 10190 - protein, 171 aa, Streptococcus agalactiae
MKIAVGCDHIVTYDKIAVVDYLKTKGYEVIDCGTYDNIRTHYPIYGKKVGEAVASGKADLGVCICGTGVGINNAVNKVPGIRSALVRDLTSAIYAKEELNANVIGFGGKITGGLLMTDIIEAFIRAKYKPTKENKVLIEKIAEVETHNAHQEENDFFTEFLDKWNRGEYHD

SEQ ID NO: 10191 - DNA, 2448 bp, Streptococcus agalactiae
atgacattaacctttgggaaaccttctataacgatacgccgtctaggagtgataactagtacatatatgatgctaggttttatcttattatgtggatttttgcatcctagtacaatttatagtgaggaaataaaatctgatataaactcttttatatcaatagatgatgaaaaaactactgttcccatatttgactctactttagataagcttactaattcaatagaggagaggcagttagaattagattctgatacatcggacagtttaatagtagatgatcaaaaagataaagatatggtaatagtcttaggtgattctgacagtcaagaaaaattgtcacctcctctaaaatcggaaatagcgacagaagaaaatcgtaaacaggcaaatttagcagaactaaatgcaactcaacctaataatagaactacctatattatacccgaaagcagtcattccattgcagaacaacagagattcctgatagaatcaaagggttattcggttgcattacttaatagcgatgaatttagaaagacagcgagagaggatagaggttttgaaagggataagttgaggtctttggatatcattcctaagggagatttatcgacaagtaatgtcataggtaatacggacattgctagtcagatatcgttgggctttaaaaagaatgcgatacaggaacaccatcttactaaaacattctctcaaaaggatggaaagttatcgtctgttatagaggggatgcttgctattggcaaagagaaagtagagaaggaaataaaatatagtggtaatttatggcaaaaattaaaagctaaggcacactgccttgtttgctgtgttgataatttgaattttgaagatataaaatcttattttcaatattattgtcatctaaaccatcagctcaaattacctaaaggtgctatactttctgctaaaacagaagtatataggggaggagattttgggagaaaaaataaagataatgtgtttggttaccgtatcccctcattattaaaaacggaaaaaggaactttacttgtgggagctgatgaaagaattgagcaagcttgtgattggggaaacataggaatggttattcgccgtagtgaggatgatggtgtcacttggggaaaaagagaaactattgtcaatctccgtaataaccctagagttccgctagttactagtggtgactatagtggctcacctattaatatggatatggcattagttcaagatactagctctaagacgaaacgtattttttcaatatatgatatgtttccagaaggaagaggcgttattagtattgctaacacacctgaaaaagaatatacccaaatcggaggacagtcttatcttaatttatataataatggaaagaaatcgaaggtttttactatccgtgacaaaggtattgtatataattttaaagggaaaaagactgattatcatgttataacagaaactactaaaagtgaccattcaaatctaggggatatttataagggaaaacagctacttggaaatatatattttacaaaacataaaacgtcaccatttcgtttagcaaaatcaagctatgtgtggatgtcatatagcgatgatgatggtaggacatggtcatcacctagagatataacagcaagtcttcgtcagaaaggcatgaaatttttaggaataggacctggaaaaggtatagttttaaaatgggggccacacgctggtcgtattattattcctgcctattctacgaattggaaatctcatctaagaggttcacaatcttcacgcctaatttattcagacgaccatggaaaaacgtggcatactggaaaagcagtcaatgataaccgtatactttctaatggtgaaaaaattcactccttaacaatggataataaaaaagaacaaaatacagaatccgtacccgttcaattgaaaaatggggacattaagttatttatgaggaatctaactggtaacctagaagtagccacaagtaaagacggcggggagacttggcaaaaccatgttaaacgatataaggaagttcatgatgcttacgtccaattatcagctattcgctttgagcatgacaaaaaagagtatattttattagtgaatgctaatgggccaggtaagaagcgtcaagatggatatgcacgtctagcgcaagttaatcgaaatggtagttttaagtggttatatcaccatcacattcaagatggttcgtttgcttacaactctgttcaacaacttaataatgataaatttggtgtcctttatgaacatagagaaaaacatcaaaatagttttactttaaattacaaagtttttaattggagttttcttagtcaaaatacagagaagcaaggcactttatgggagaaaatggcagcaaattggcatgttttgtttaaattttattta

SEQ ID NO: 10192 - protein, 816 aa, Streptococcus agalactiae
MTLTFGKPSITIRRLGVITSTYMMLGFILLCGFLHPSTIYSEEIKSDINSFISIDDEKTTVPIFDSTLDKLTNSIEERQLELDSDTSDSLIVDDQKDKDMVIVLGDSDSQEKLSPPLKSEIATEENRKQANLAELNATQPNNRTTYIIPESSHSIAEQQRFLIESKGYSVALLNSDEFRKTAREDRGFERDKLRSLDIIPKGDLSTSNVIGNTDIASQISLGFKKNAIQEHHLTKTFSQKDGKLSSVIEGMLAIGKEKVEKEIKYSGNLWQKLKAKAHCLVCCVDNLNFEDIKSYFQYYCHLNHQLKLPKGAILSAKTEVYRGGDFGRKNKDNVFGYRIPSLLKTEKGTLLVGADERIEQACDWGNIGMVIRRSEDDGVTWGKRETIVNLRNNPRVPLVTSGDYSGSPINMDMALVQDTSSKTKRIFSIYDMFPEGRGVISIANTPEKEYTQIGGQSYLNLYNNGKKSKVFTIRDKGIVYNFKGKKTDYHVITETTKSDHSNLGDIYKGKQLLGNIYFTKHKTSPFRLAKSSYVWMSYSDDDGRTWSSPRDITASLRQKGMKFLGIGPGKGIVLKWGPHAGRIIIPAYSTNWKSHLRGSQSSRLIYSDDHGKTWHTGKAVNDNRILSNGEKIHSLTMDNKKEQNTESVPVQLKNGDIKLFMRNLTGNLEVATSKDGGETWQNHVKRYKEVHDAYVQLSAIRFEHDKKEYILLVNANGPGKKRQDGYARLAQVNRNGSFKWLYHHHIQDGSFAYNSVQQLNNDKFGVLYEHREKHQNSFTLNYKVFNWSFLSQNTEKQGTLWEKMAANWHVLFKFYL

SEQ ID NO: 10193 - DNA, 462 bp, Streptococcus agalactiae
gtgactcaagatattttatttattgatgcccattctcaggaagaattatttgacttagtatcaaaagcattgataaaacaacactatgttagtcctaactaccgacaggcagtaaaagaaagggagagagagtttccaacggggttaaaaattgatttaaaagatgggactcctattcaatatgttgctattccacacactgaaacgcagtattgtctagtagatagaatcttttatgtcaaaaatagtcagccaattactttcaaacatatgattaatccagaagaggagtgtagggttcaggattttttcttcatcattaatagtaggaatagtaaccaaagtgatattttatctaatttgattaccttctttattacaaaaggaaacctagatcggctacatgagcttggcgacaataaagaaaaaattaatcattatttaatagaaaaaggagtgttt

SEQ ID NO: 10194 - protein, 154 aa, Streptococcus agalactiae
MTQDILFIDAHSQEELFDLVSKALIKQHYVSPNYRQAVKEREREFPTGLKIDLKDGTPIQYVAIPHTETQYCLVDRIFYVKNSQPITFKHMINPEEECRVQDFFFIINSRNSNQSDILSNLITFFITKGNLDRLHELGDNKEKINHYLIEKGVF

SEQ ID NO: 10195 - DNA, 894 bp, Streptococcus agalactiae
atggtttctctaaaaggaaaaaatgatactaaacatcgcatgataactgctcaccttgatacacttggtgctatggttagggccatcaaaccagatggtcggttaaaaattgaccttattggtggatatacatacaatgccattgaaggagaaaactgtactatacacctctcaaaaaatggtaaagaaatttctggaactgctcttattcatcaaactagtgtccatgtttacaaagacgctggaactgctgaacgtaatcaaacaaatatggaaattcgtttagatgagaaagtaacaactgctgacgaaacacgtgctttaggcatccaggtcggtgatttcatttcatttgatccgcgtacaatcataacagacagcggctttattaaatcacgttacctagatgacaaggtatccgctggtatcctaatggaacttctttctgtttacaagaaagaagacattcaacttccttatactactcatttctactttagtgcctttgaagagctaggacatggagcaaattcaagcatcccaaatgaaactgtagaatatctagcagttgatatgggagctatgggagacgatcaagaaactgacgaatatactgtctctatctgtgttaaagatgcttctggtccttatcattatgaattacgtcaacatcttgtttctctagctgaaaacaataatattccttataaacttgatatttatccttattatggtagtgacgcctccgctgccatgcgtgctggtgcggaagttaaacacgcgctacttggtgcaggtattgaatctagtcattcttatgaacgtacccatatcgattctattcaagcaactgaactcttagtggatgcctatctcaaaagcaatatggtggac

SEQ ID NO: 10196 - protein, 298 aa, Streptococcus agalactiae
MVSLKGKNDTKHRMITAHLDTLGAMVRAIKPDGRLKIDLIGGYTYNAIEGENCTIHLSKNGKEISGTALIHQTSVHVYKDAGTAERNQTNMEIRLDEKVTTADETRALGIQVGDFISFDPRTIITDSGFIKSRYLDDKVSAGILMELLSVYKKEDIQLPYTTHFYFSAFEELGHGANSSIPNETVEYLAVDMGAMGDDQETDEYTVSICVKDASGPYHYELRQHLVSLAENNNIPYKLDIYPYYGSDASAAMRAGAEVKHALLGAGIESSHSYERTHIDSIQATELLVDAYLKSNMVD

SEQ ID NO: 10197 - DNA, 1647 bp, Streptococcus agalactiae
atgagaggatatagaatggaagaacgctttaagaaacgactacaagatgatatctctaaacatttttcccgccagtctttaattttatccttgttattgattgcacttttcgtccttttttctttagcgcctcaacagataggtctttataaagatgttaattcagtttcctatagttataagcaattgattcaaaaacatgataccttattagatgacttaggtaaaaatagtttgaaaccatttgtctcaggacacttaggaagtgctgatttgagtaagcaatattatcatttaaggaatcatttacaaagtcaaacagaacttttagtattctcacctaatcaagaacttttgtttgctagtaattcacatttaggtaatttttttagtaagtctatttacattagtgaagttttagataaggctaaaataaatcaaaggctactaaaaattattgtggatagtgagggagggcattaccttgcactcattaagccaattatagttaataaaaaagtttcaggttatgcctttttattgatgaatgggaaagactttttacttccaacgaaggctattaactcagacttgattattgccgatcagctaaataatagctttacttttactaatcgtgattttatctcctctagtttagataaggtagatagtcaattcttaactagatattttagttttcacgatcatcgagcttttgttgttaggaaagtagctctgcaagacaatatcctactttacatgtatcgtcccctgataccagtaactctggtcgtccttttttctctagtatcatcagttattatttttgtgattttacgacaaaaatctagagttctagccgatcgcatcgcagtaaaaaattctagcgccataaatcaaatggtgctagatatggatgccatttcccgccaagaaaaatctagtattgagcttgatagtcaagatgaatttcaatatctatctgtgcaaatcaatcagatggtttcacggttaaaagatttacatgagaaaactcttgatttggaaacacaaaagttgttgtttgaaaagaggatgttagaagctcagtttaatcctcacttcctttataatacccttgagacaattttaataaccagtcactatgattcacaattaacagaaagaatcgttatacaactaacaaaattattgcgctatagccttagtggtagcacagaagcagctgtgcttaaggatgatttagcaatcattgaatcctaccttttgattaatcaagtgagatttgaagaattaacttacactatttcagtatctcctgaacttgaacacatgcgtgtaccaaaacttttcttgttaccgctaattgagaatgctattaaatatggcttaaaagaacgtcatgatgtagcaataaacatagatatttggcaagatagtgatggaatttggtttactgtttcaaataatggatcaggtattagtttggctaggcaacaagccatacgtacaatgttaagatcaactcactcgcatcatgggcttattaattcttatagacgattacaatatcaattttcaacagtattgttagagtttacgaagacagatgatgcttttcgagttagctatatagtaaaggag

SEQ ID NO: 10198 - protein, 549 aa, Streptococcus agalactiae
MRGYRMEERFKKRLQDDISKHFSRQSLILSLLLIALFVLFSLAPQQIGLYKDVNSVSYSYKQLIQKHDTLLDDLGKNSLKPFVSGHLGSADLSKQYYHLRNHLQSQTELLVFSPNQELLFASNSHLGNFFSKSIYISEVLDKAKINQRLLKIIVDSEGGHYLALIKPIIVNKKVSGYAFLLMNGKDFLLPTKAINSDLIIADQLNNSFTFTNRDFISSSLDKVDSQFLTRYFSFHDHRAFVVRKVALQDNILLYMYRPLIPVTLVVLFSLVSSVIIFVILRQKSRVLADRIAVKNSSAINQMVLDMDAISRQEKSSIELDSQDEFQYLSVQINQMVSRLKDLHEKTLDLETQKLLFEKRMLEAQFNPHFLYNTLETILITSHYDSQLTERIVIQLTKLLRYSLSGSTEAAVLKDDLAIIESYLLINQVRFEELTYTISVSPELEHMRVPKLFLLPLIENAIKYGLKERHDVAINIDIWQDSDGIWFTVSNNGSGISLARQQAIRTMLRSTHSHHGLINSYRRLQYQFSTVLLEFTKTDDAFRVSYIVKE

SEQ ID NO: 10199 - DNA, 846 bp, Streptococcus agalactiae
atgttattacagctagataatatcactaaaagctacgggaaaaaaatagtacttaaccagatttcctaccagtttactcctggtttgtatggactcttaggagcaaatggtactggcaaaacaaccttattaaatttgatgagccactttacattagcagatagtgggaatatttattggaatggacaggagcagtcggaagaattttatcgtcacattggttttttaccgcaacattttcgctattatgatcaatttactggcattgctttcttaaattatatcgctaccttaaaaggtgttgataaaaagaaagctaaacaagaaattcctagattactagagcttgttggtttaggcgatgtaggtaaaaagaagatttcatcatactccggtggtatgaagcaacgtttaggcattgctcaagcacttatcaatgatcctgaaatactcattctggatgaaccaactgttggacttgatcccaaggaacgggttaaatttcgccatattttgagtcagttatccaccaataaaattatcattttatcaacgcatattgtgtcggatgtggaagctgttgccaaagaaattatagtattaaaaaatggtaaatttatcgaacatggcaacaccgcacagctgttgaaaactattgagggaaaagtgtgggaaataacgactgaaccaggtttatctcagatacccaatattgctattgttaatgaaaaagtcttttcagatagtcgggtatttcgtgtagtgagtgatatttgtccgagtgattcggcacagttggttgttccgactctagaagatttctacatctatcattttagaggggag

SEQ ID NO: 10200 - protein, 282 aa, Streptococcus agalactiae
MLLQLDNITKSYGKKIVLNQISYQFTPGLYGLLGANGTGKTTLLNLMSHFTLADSGNIYWNGQEQSEEFYRHIGFLPQHFRYYDQFTGIAFLNYIATLKGVDKKKAKQEIPRLLELVGLGDVGKKKISSYSGGMKQRLGIAQALINDPEILILDEPTVGLDPKERVKFRHILSQLSTNKIIILSTHIVSDVEAVAKEIIVLKNGKFIEHGNTAQLLKTIEGKVWEITTEPGLSQIPNIAIVNEKVFSDSRVFRVVSDICPSDSAQLVVPTLEDFYIYHFRGE

SEQ ID NO: 10201 - DNA, 2181 bp, Streptococcus agalactiae
atgaaaaataatgtcaaacagctctttagttttgaattttggcagaagtttgggaaggctttgatggttgttattgctgttatgccagcagcaggattgatggttagtattggtaactccattagtctattggatccatcaaatgttttattagggcgcatagctaatgttattgctcaaattggttggggagttattggtaacttacacatcttatttgcattggctattggtggtagctgggctaaagaacgtgccggtggtgcttttgcggctggcttatcctttattcttattaaccttattacagggaacttttttggtgttaaaacagatatgttagcagacagtaaagcaactgttcaaacggtatttggtgcaaccatcagagtttcagattactttgttaacgttcttgggcaacctgctcttaatatgggtgtatttgtcggtattatttcaggtttcgttggtgcaactgcctttaataaatattataactatcgtaaattaccagatgctttaacttttttcaatggaaaacgttttgttccatttgttgttatttatcgttcagtcattgttgcattaattttatcagtattttggccggttgttcaatcaggtatcaatggctttggtaaatggattgcaagttcacaagacagtgctccaatattagcaccatttgtctacggtacgttagagcgtttattgctcccatttggtttacaccatatgttaactattccaatgaactacacgcaactaggtggcacatacactgtccttacaggtgcaactaaaggagcacaggtgttgggacaagatccactgtggttagcatgggttggtgatttaattaacttaaaaggctcaaattcaagtcaataccatcacttattgacaagtgtcactccagcacgttttaaagtggggcaaatgattggtgcttcaggtattttgatgggattatcttatgctatgtatcgtaacgttgataaagataaaaaattgaaatacaagtcaatgtttatttcagcagcagcggctactttcttgacaggtgttactgagccaattgagtacatgttcatgtttgcagcaatgccactctaccttgtatatgctgtcgttcaaggatgtgcgtttgctatggcagatattgttaacctccgcgttcattcatttggtaatatagaatttttaacacgtgttcctatgggcataaaagcgggccttggtggtgatattttcaactttgtttgggtgacacttctttttgcagtattgatgtactttattgcaaactttatgattaaaaaattcaatttagcaacagcaggacgtaatggtaattatgataacgaagaggttgataatgctccttcaacagcttctggttctgctgatgcaaattctcaagttgtacaagttattaatttacttggtggtcgtgataacattgaagatgtagatgcatgtatgactcgtcttcgtgtcacagttaaagatggaaatagcgtgggttctgaagcagcttggaaaaaagctggtgcaatgggattggtgttaaaaggtaatggcgttcaagctatttacggacctaaagcagatgtccttaaatcagacattcaagatttgctagattcaggtacagttattccaatagttgatttagaaacaggtcaacctgtagcagcagccccagttacaacttataaaggaataacagaagaaattgtttcggtggctaatggtcaagtagaagcattggatgttgttaaagaccctgtcttttctcaaaaaatgatgggtgatggctttgctgtggaaccaactgatggcaatatttatgttccagtttcaggtacagttactagtgtctttccaacaaaacatgcttttggtttattaacagaaagtggcctagaagttttagtacatatcggtctagatacagtagctcttgatggtcaaccatttgaggttaaaatttctagtggtcaaaaagtggtagcaggcgatcttgctgtagtagcagatttggaagctatcaaagcagctggtaaagagacaagtgtgattatcgtctttacaaatgtttcagatataaaaactgttaaacttgaaaaatcaggtccacaaatagctaaaacagttgtggcaaaagtcgaactg

SEQ ID NO: 10202 - protein, 727 aa, Streptococcus agalactiae
MKNNVKQLFSFEFWQKFGKALMVVIAVMPAAGLMVSIGNSISLLDPSNVLLGRIANVIAQIGWGVIGNLHILFALAIGGSWAKERAGGAFAAGLSFILINLITGNFFGVKTDMLADSKATVQTVFGATIRVSDYFVNVLGQPALNMGVFVGIISGFVGATAFNKYYNYRKLPDALTFFNGKRFVPFVVIYRSVIVALILSVFWPVVQSGINGFGKWIASSQDSAPILAPFVYGTLERLLLPFGLHHMLTIPMNYTQLGGTYTVLTGATKGAQVLGQDPLWLAWVGDLINLKGSNSSQYHHLLTSVTPARFKVGQMIGASGILMGLSYAMYRNVDKDKKLKYKSMFISAAAATFLTGVTEPIEYMFMFAAMPLYLVYAVVQGCAFAMADIVNLRVHSFGNIEFLTRVPMGIKAGLGGDIFNFVWVTLLFAVLMYFIANFMIKKFNLATAGRNGNYDNEEVDNAPSTASGSADANSQVVQVINLLGGRDNIEDVDACMTRLRVTVKDGNSVGSEAAWKKAGAMGLVLKGNGVQAIYGPKADVLKSDIQDLLDSGTVIPIVDLETGQPVAAAPVTTYKGITEEIVSVANGQVEALDVVKDPVFSQKMMGDGFAVEPTDGNIYVPVSGTVTSVFPTKHAFGLLTESGLEVLVHIGLDTVALDGQPFEVKISSGQKVVAGDLAVVADLEAIKAAGKETSVIIVFTNVSDIKTVKLEKSGPQIAKTVVAKVEL

SEQ ID NO: 10203 - DNA, 522 bp, Streptococcus agalactiae
atgttgccgggagatgatggtttgactattttagagcgtttaaggagaaaacatcaaacggaaatgataccagtaatcatgacaactgctaaaggtagtgagtatgataaagttaaagggttagatcttggagcagatgattatctcgtcaaaccttttgggatgatggaaatgatttcacgaataaaagcagtcttgagacgtagccgccaagtagattcaaaagctcatattatcattggaaatttagagattgatccgactaattattgggtcaaaaggggaacggaaaaaatccacttaaccctaaaggaatttgagttattagtattattcttccgtaatcccaatagagtctttacaaggcaagaacttctggataaggtttggggagaacaatttttaggagaaactagaactgtggatgttcacattgggacactgcgaacaaaacttggtgaggatggctatttgattgctacagtaaggggagttggataccgtttggaggaaagacatgac

SEQ ID NO: 10204 - protein, 174 aa, Streptococcus agalactiae
MLPGDDGLTILERLRRKHQTEMIPVIMTTAKGSEYDKVKGLDLGADDYLVKPFGMMEMISRIKAVLRRSRQVDSKAHIIIGNLEIDPTNYWVKRGTEKIHLTLKEFELLVLFFRNPNRVFTRQELLDKVWGEQFLGETRTVDVHIGTLRTKLGEDGYLIATVRGVGYRLEERHD

SEQ ID NO: 10205 - DNA, 747 bp, Streptococcus agalactiae
gtgagtaaattagtaattaataatttagatttgtattatggagaatttcacgctctgaaggatgttaatttagacattgaagaaaaagaaatcacagcctttattggaccttctgggtgcggaaagtctactctcttgaaaagtattaaccgtatgaatgatttggtcaaaaattgcaaaatcacaggggatattactttagaaggcgaggatgtctatagacaattggatattaaccaattgcgtaaaaaggttggaatggtgtttcaaaaacctaatccgtttccaatgagcatttatgataatgttgcttttggtccaagaacgcacggtattcattccaaagcagagttagatgatatcgttgaacgttcccttaaacaggcggctctatgggatgaggttaaagatcgtcttcacaaatctgctctgggtatgtctggcggacagcagcaacgtttgtgtattgcgcgtgctcttgctattgagcctgatgttttacttatggatgaacccacaagtgccttggatcctatttcaacagcaaaaattgaagaattggttatccaactgaagaagaactacactattgttatagtgacacataatatgcaacaagctgttcgtatttctgataaaacagcattctttctgatgggagaagtggttgaatataacaaaacgagccaactcttttcattgccacaagatgagcgtacagaaaactacattacagggagattcgga

SEQ ID NO: 10206 - protein, 249 aa, Streptococcus agalactiae
MSKLVINNLDLYYGEFHALKDVNLDIEEKEITAFIGPSGCGKSTLLKSINRMNDLVKNCKITGDITLEGEDVYRQLDINQLRKKVGMVFQKPNPFPMSIYDNVAFGPRTHGIHSKAELDDIVERSLKQAALWDEVKDRLHKSALGMSGGQQQRLCIARALAIEPDVLLMDEPTSALDPISTAKIEELVIQLKKNYTIVIVTHNMQQAVRISDKTAFFLMGEVVEYNKTSQLFSLPQDERTENYITGRFG

SEQ ID NO: 10207 - DNA, 93 bp, Streptococcus agalactiae
ttgtttctgaatcaacaacatgggattccattccttggtaactttgaaaaagccagagatgaaaaaggctacaatggtcatcagacaagctat

SEQ ID NO: 10208 - protein, 31 aa, Streptococcus agalactiae
MFLNQQHGIPFLGNFEKARDEKGYNGHQTSY

SEQ ID NO: 10209 - DNA, 324 bp, Streptococcus agalactiae
atgcaacaggtttttaatgtgagtgttcctgtaccagatgatgttgttattatttcaaaagaagaatatttaaatttattaagtgataatgaacaaggcaagtggtgggatattgataacttgcaagagttattgggaattggaaggtcaaaattgattaatgatattttgttaaatccagatataaaaaaagaagtagatttatcaattaatccaaatggttttattgtttatccgaaaggtaaaggtagtcgatataaaatattagcaacaaaagctagaaaatattttgaagataattttggttctattttattaaatagt

SEQ ID NO: 10210 - protein, 108 aa, Streptococcus agalactiae
MQQVFNVSVPVPDDVVIISKEEYLNLLSDNEQGKWWDIDNLQELLGIGRSKLINDILLNPDIKKEVDLSINPNGFIVYPKGKGSRYKILATKARKYFEDNFGSILLNS

SEQ ID NO: 10211 - DNA, 264 bp, Streptococcus agalactiae
atggaggctattgtttattcacattttagaaataatttaaaagattatatgaagaaggtcaatgatgaatttgagcctttgattgtagttaataaaaatcctgatgaaaatatagtggttttatctcaagatagctgggaaagtttacaagaaacgattcgtttgatggaaaatgattatctatcacataaggttattaatggtatatcacaagttaaagagaagcaagtcactaaacatggtttaattgaggtagaagatgtt

SEQ ID NO: 10212 - protein, 88 aa, Streptococcus agalactiae
MEAIVYSHFRNNLKDYMKKVNDEFEPLIVVNKNPDENIVVLSQDSWESLQETIRLMENDYLSHKVINGISQVKEKQVTKHGLIEVEDV

SEQ ID NO: 10213 - DNA, 480 bp, Streptococcus agalactiae
atggatgttagtgcaattgttagagatataaaaactggtagagctacgttagtttgttttcctgtggaaatgagtgagcttaagttagctttggggcttcgtgaagaagatgatttagagtatattattgcagattcggattgtcagttactaaaagaacatgattctattgagatgattaatcaatttgttgaactggtagagaatgttgatagtgaacttgttaaagcagtgcatcaggtaataggttatactgcctcagactttgtggattatgattttaattttggtgattgttgtttactgtctgatgtcacaactagacgagaactaggtgaatattatttcgatgaattaggcgtacaaggagttggtaaagaggctctggagatgtattttgatcatgaagcttatggtcgagatattgacttagaaagccaaggtggtttttcagactacggatatgtcgaaatatcaggg

SEQ ID NO: 10214 - protein, 160 aa, Streptococcus agalactiae
MDVSAIVRDIKTGRATLVCFPVEMSELKLALGLREEDDLEYIIADSDCQLLKEHDSIEMINQFVELVENVDSELVKAVHQVIGYTASDFVDYDFNFGDCCLLSDVTTRRELGEYYFDELGVQGVGKEALEMYFDHEAYGRDIDLESQGGFSDYGYVEISG

SEQ ID NO: 10215 - DNA, 1347 bp, Streptococcus agalactiae
atgtttagtaaaatagaatttaaaaactttatgtccttttcaaatttgacttttgatttgctgaatagaggaaaatgtaaggatattattgcaatctatggagaaaacggttcaggaaaaacaaatattgttgaagcttttaagttactagttttgtcattacaatcaatggaatccttaaatgaaaatacacgattacaatcattattaaaagaacaaacaaataaagaagaaaatcaaaaaactaactttggtgatatatcagaaatcttagataaaatcagtttcttcaccacttttaagggcatagcgaaaaatactcatagaattgcatctgaaggtaatacgattctaaaatattattttaatatcgaaaaagataatggttattaccttctagaatataatgaaaataatgaactagtaaaagaggagctagtatttaagataaaatccaataagggagttcatttcagtattactaacatagatggtttatctcaatcattaaataagacaatttttaagaatactatttttaaagatttgactgaacaaatagaaaaatattggggtaaacatacattcctatcaatatttaataattattgtctagaagtaaatgaagagtttattaatgaacaagtttctataaattttcaaaaagtagttgatgaatttgataaaatttttatttggagtggtaattttagaggtccttttcattcgacagaattattattgaaagatatttcaaaaggtaaaattgataagtcggaaaaagaaaaactttcctatactgaggaaattatttataaatattttagtgcattatatattgatataaaagatgttaaatataagcaggatgctcaaggtcaagaaataaaatatgaactcatgatccgaaaaaatattggaggtgatcttttagatgtaccaataagtttagaatctcagggaacaaaaaatcttctggatcttctaaaagtttttaacaatgtgttggatgggaaaatatgtatcgttgatgaaattgactcaggtattcatgatcttttaatgaatagtattctgaatgacttgaaaggaagtgtgaatggtcagttaatatttacaacgcatgatacaacgttattgaaggaattatcaccgagctcagcttattttttaaatgtagatattaaaggtaataaagttatcatttctggcaatgaggcagataaaaaaataggagtaaataacaatttagaaaaattatatttgtctggtttctttggtgctgtaccagatccattagatattgatttttcagatttatttcttgatcataatttaagcgaggac

SEQ ID NO: 10216 - protein, 449 aa, Streptococcus agalactiae
MFSKIEFKNFMSFSNLTFDLLNRGKCKDIIAIYGENGSGKTNIVEAFKLLVLSLQSMESLNENTRLQSLLKEQTNKEENQKTNFGDISEILDKISFFTTFKGIAKNTHRIASEGNTILKYYFNIEKDNGYYLLEYNENNELVKEELVFKIKSNKGVHFSITNIDGLSQSLNKTIFKNTIFKDLTEQIEKYWGKHTFLSIFNNYCLEVNEEFINEQVSINFQKVVDEFDKIFIWSGNFRGPFHSTELLLKDISKGKIDKSEKEKLSYTEEIIYKYFSALYIDIKDVKYKQDAQGQEIKYELMIRKNIGGDLLDVPISLESQGTKNLLDLLKVFNNVLDGKICIVDEIDSGIHDLLMNSILNDLKGSVNGQLIFTTHDTTLLKELSPSSAYFLNVDIKGNKVIISGNEADKKIGVNNNLEKLYLSGFFGAVPDPLDIDFSDLFLDHNLSED

SEQ ID NO: 10217 - DNA, 1230 bp, Streptococcus agalactiae
gtggatgctatctatttaaaaaaatttcgaaagaaaacaggtctaaaacaaaaggaatttgctttaagttctggtttgacattgaaatcacttagaaactatgagcaaggaaagcggaagttgacacttgaaaagtatcaagagataaaatcacattttggatatctagtagaaaatgatagttcacgattacaagtgatgattgactatgtcagaattacgttaaaggatgttagggatcttgaatttttctgtcgtaactttttgcactgtgcatttaaagaatttcagccttttgaatcgaagttgatgaattacaatcatctttggaaacgtggagatatttggatatttgattttgcggataaacatgagacaggtaattttcaaataactgttcaattgtctggtcgtggatgccgacaattggaattgttgatggaaactgaaaaatttacatggcatgattggttaagttatctaagaaattcatatcgtgatgatatgaatgtgacacgttttgatattgctattgatgaattgtatctgggtaaggatagagaaaatgaacagtttcatttgtcagatatgatttcaaaatattatcgtcatgagttagattttgaaagtttgagaacttggaattatataggtggcggttctttaaatttttcggatatggaagagattgagcagaatagacaaggaatatcgctttattttggtagtcgtcaatcagaaatgtattttaacttttatgaaaaacgttatgaaattgcaaagcaggaaggaattactgttgaagaagctttagaaatttttgaattgtggaatcgttatgagatacggttatctcaaagtaaagctaatgcggcagttgatgaatttatttctggagtgccgattggtgaaatatccagagggttaattgttagtaagattgacgtgtatgatgggaaaaatgaatatgggtcgtttcaagcagatagaaagtggcaattaatgtttggaggtgttgagcctttaaaatttgttacaaagccagaggcttatagtattgaacgaaccttacgttggttaagtgattctgtttctccgtctttagctatgataagagagtatgacatgattgtggatggtgactatttacaaaccattcttaattctggggaagtcaatgaacgtggggagaagatacttgacagtatcaaagctagcttaggtattttg

SEQ ID NO: 10218 - protein, 410 aa, Streptococcus agalactiae
MDAIYLKKFRKKTGLKQKEFALSSGLTLKSLRNYEQGKRKLTLEKYQEIKSHFGYLVENDSSRLQVMIDYVRITLKDVRDLEFFCRNFLHCAFKEFQPFESKLMNYNHLWKRGDIWIFDFADKHETGNFQITVQLSGRGCRQLELLMETEKFTWHDWLSYLRNSYRDDMNVTRFDIAIDELYLGKDRENEQFHLSDMISKYYRHELDFESLRTWNYIGGGSLNFSDMEEIEQNRQGISLYFGSRQSEMYFNFYEKRYEIAKQEGITVEEALEIFELWNRYEIRLSQSKANAAVDEFISGVPIGEISRGLIVSKIDVYDGKNEYGSFQADRKWQLMFGGVEPLKFVTKPEAYSIERTLRWLSDSVSPSLAMIREYDMIVDGDYLQTILNSGEVNERGEKILDSIKASLGIL

SEQ ID NO: 10219 - DNA, 294 bp, Streptococcus agalactiae
atgaaacaagaaacattagtgttacttccaaattttattggagatgcaatttatgaaggatttgaagctggacctgctcaattaaatggtaaaaaagggtcttatacaagacacattttgtttaatgaaaaacatggtaagttttatgtttatacaccagcatcttcacgtgtgattggaaatggaaaaatggtaactgttgaaaaaccgttattgtttattgacaatacaattaatggtagaaatattgaacctgcaaaaaatgtatgggctgaaaagcttattgaagtgaaa

SEQ ID NO: 10220 - protein, 98 aa, Streptococcus agalactiae
MKQETLVLLPNFIGDAIYEGFEAGPAQLNGKKGSYTRHILFNEKHGKFYVYTPASSRVIGNGKMVTVEKPLLFIDNTINGRNIEPAKNVWAEKLIEVK

SEQ ID NO: 10221 - DNA, 1251 bp, Streptococcus agalactiae
atgtcagacttattatccctaccagacattaaaacaatagaaccgccacaagaaaatgaaaccgatatgatgtttaaagttgaagcagtcggaccacctgaacgttgtcctgaatgtggttttgacaagttgtacaaacacagttcaagaaatcaactaattatggatttgcccattcgtttaaagcgagtgggcttacatttgaaccgtagacgatacaagtgtcgtgaatgcggatctaccatatctgtagatgaaaagcgtagtatgaccaaaaggcttttaaagtccattcaagagcaatccatgtctaagacctttgtagaagtcgcagaaagcgttggtgttgacgagaaaaccattaggaacgtttttaaggactatgtggcactcaaagaacgtgaataccagtttgaaactcctaagtggcttgggatagacgagatacatattatccgtagacctcggcttgtattgactaatattgaacgcaggactatttatgacatcaagcctaaccgtaacaaggaaacagtcatccaacgtctttcagaaatcagtgacaggacttacattgagtacgtcacaatggatatgtggaagccctacaaagacgcagtgaacactatccttccacaagctaaagttgtcgtagataagtttcatgtagttagaatggctaatcaagccttagataacgtcagaaagtctttgaaagcccatatgagccaaaaagaaagacgtacccttatgcgtgaaaggtttatccttctaaagcgtaaacacgatctaaatgaacgtgaatcattcctcttagatacttggttaggtaatcttcctgctttaaaagaagcctatgaactcaaagaagagttttactggatatgggatactcctgatccagatgaaggtcatcttcgttatagtcaatggagacaccgttgtatgtccagcaactctaaagacgcatataaagacctcgtgagagccgtagacaactggcatgttgaaatattcaactactttgataaaaggctcactaatgcttatacggagtcaattaacagcattattaggcaggtagagcgaatgggtagaggttactcgtttgatgccttacgagccaaaatccttttcaatgagaagctccataaaaagcgtaagccacgatttaattcaagtgctttcaataaagctatgttatacgatactttcaattggtatgaagtgaatgatcacgacattacagac

SEQ ID NO: 10222 - protein, 417 aa, Streptococcus agalactiae
MSDLLSLPDIKTIEPPQENETDMMFKVEAVGPPERCPECGFDKLYKHSSRNQLIMDLPIRLKRVGLHLNRRRYKCRECGSTISVDEKRSMTKRLLKSIQEQSMSKTFVEVAESVGVDEKTIRNVFKDYVALKEREYQFETPKWLGIDEIHIIRRPRLVLTNIERRTIYDIKPNRNKETVIQRLSEISDRTYIEYVTMDMWKPYKDAVNTILPQAKVVVDKFHVVRMANQALDNVRKSLKAHMSQKERRTLMRERFILLKRKHDLNERESFLLDTWLGNLPALKEAYELKEEFYWIWDTPDPDEGHLRYSQWRHRCMSSNSKDAYKDLVRAVDNWHVEIFNYFDKRLTNAYTESINSIIRQVERMGRGYSFDALRAKILFNEKLHKKRKPRFNSSAFNKAMLYDTFNWYEVNDHDITD

SEQ ID NO: 10223 - DNA, 333 bp, Streptococcus agalactiae
atgaaaaggaataaacatttaccgttaacagaaactacctattatatcttattagctttgtttgaggaagcacatggctatgctattatgcaaaaagttgaagaaatgagtggcggtgatgttagaatagccgcagggacaatgtacggtgccattgaaaatttacttaaacaaaaatggataaagtctatcccaagtgacgatagaagaagaaaagtttatattattactgagacaggaaaagaaatagtagaacttgaaacgaatcgattaagaaagttacttaatactgctaatcagttgggttttgggggagatagttatgataaagtt

SEQ ID NO: 10224 - protein, 111 aa, Streptococcus agalactiae
MKRNKHLPLTETTYYILLALFEEAHGYAIMQKVEEMSGGDVRIAAGTMYGAIENLLKQKWIKSIPSDDRRRKVYIITETGKEIVELETNRLRKLLNTANQLGFGGDSYDKV

SEQ ID NO: 10225 - DNA, 486 bp, Streptococcus agalactiae
atggaaattaaagaatacgagaataatccgtaccatttagcacagctagtagatttaattaattattgtcagaatatagaagctaaacttgatataaagatggctgaacaagacgatatttttcaaatagaaaattattatcaaaacagaaaaggtcaattttggattgccttagaaaatgaaaaagtagttggttcgattgcgttactgcgtattgatgataaaacagctgttctaaaaaaattttttacatatccaaaatatagaggaaatcctgttcgacttggtcgaaaattatttgaaagatttatgctttttgctcgagctagtaaattcacaagaattgtcttggatactccagaaaaagagaaaagatctcacttcttttatgaaaatcaaggatttaagcaaataacaagagatgaactagatgtagactacatttttccagatagagattcaaggatatatgtaaaacttcttgat

SEQ ID NO: 10226 - protein, 162 aa, Streptococcus agalactiae
MEIKEYENNPYHLAQLVDLINYCQNIEAKLDIKMAEQDDIFQIENYYQNRKGQFWIALENEKVVGSIALLRIDDKTAVLKKFFTYPKYRGNPVRLGRKLFERFMLFARASKFTRIVLDTPEKEKRSHFFYENQGFKQITRDELDVDYIFPDRDSRIYVKLLD

SEQ ID NO: 10227 - DNA, 741 bp, Streptococcus agalactiae
atgttaaaaaaagaatggatggagaatgttaggacatacaaagttatatctattctgattacttgttcaatatttggtatattaggtcccttaactgcacttatgatgcctgatattatggcaggaattttacctaaaaaactacagggagcgataccagagcctacctatattgattcttatattcagtattttaaaaatatgaatcagcttggtttagttattttagtatttttatttagtagtacactgacgcaagaattttcaaaaggaaccttaattaatctagttacgaagggattagccaaaaaagttataatccttgctaaatttatagtaattacccttctatggacagtgtcatacttattaagtgttgtcatccattttagttatacgttatattactttagtaacgaaggaagtcataaattaatggtttacggtgcaacatggtttatcggtattcttttcataagcttaatactctttttttcagttctttttcgtaaaactttagggggtttgttaggttgtctttttatggtggtgttatgtgtagtatctggattttttaaaatcagtaaaagctataatcctatgcttcttatccaaaaacaaggagaaatattaagtggaaagtttaaagttcaagacttaatggaaccgagcatattagtgtttttgcttattataatgacgttattacttagcatgtacatttttgaaaaaagtgaagtt

SEQ ID NO: 10228 - protein, 247 aa, Streptococcus agalactiae
MLKKEWMENVRTYKVISILITCSIFGILGPLTALMMPDIMAGILPKKLQGAIPEPTYIDSYIQYFKNMNQLGLVILVFLFSSTLTQEFSKGTLINLVTKGLAKKVIILAKFIVITLLWTVSYLLSVVIHFSYTLYYFSNEGSHKLMVYGATWFIGILFISLILFFSVLFRKTLGGLLGCLFMVVLCVVSGFFKISKSYNPMLLIQKQGEILSGKFKVQDLMEPSILVFLLIIMTLLLSMYIFEKSEV

SEQ ID NO: 10229 - DNA, 813 bp, Streptococcus agalactiae
atgatttatggattcgtaggaccaaatggagcaggtaaaacaacgacaataaaaatgattttaggattgttaaaatttgatacgggtttcataacaatttttggtaaaaaagttaattttggaagaacagataccaatcaactgattggctatctcccagatgttcccgagtactacgattatatgacagctctagaatatcttgatttatgttctggtttagcgagatcaaagcataagctttctaacaaagaactacttaggtcagttggacttgacgataatcaccaaaagattgctacttattctcgaggaatgaaacagcgtcttggattagcccaagcactggttcatgatcctaaaattattatttgcgatgaaccaacctctgcattagacccgaaaggtcgccaagatattttagatattatttcaaatcttagaggagaaaaaactgtgattttttctacccatattctctctgatgtcgaaaaaatatgtgatcatgttctggtgttaactaagtgtgggatttattctcttgaagagttaaaaggaaaaaaatcagaggaaaattattcggttcgtattttaataaaagtgacaaagtctgaagctaaggtactatctcataactatcagatagaaaagaaagataatgagtatgcactgactctcaaaggctctaaaatggataacaaagcagatttactagctggtttttaccaagatttagtttctttaaagattagcccatcagctattgaagtcattgacaatagtttagaggagctttatttggaggttaccaaa

SEQ ID NO: 10230 - protein, 271 aa, Streptococcus agalactiae
MIYGFVGPNGAGKTTTIKMILGLLKFDTGFITIFGKKVNFGRTDTNQLIGYLPDVPEYYDYMTALEYLDLCSGLARSKHKLSNKELLRSVGLDDNHQKIATYSRGMKQRLGLAQALVHDPKIIICDEPTSALDPKGRQDILDIISNLRGEKTVIFSTHILSDVEKICDHVLVLTKCGIYSLEELKGKKSEENYSVRILIKVTKSEAKVLSHNYQIEKKDNEYALTLKGSKMDNKADLLAGFYQDLVSLKISPSAIEVIDNSLEELYLEVTK

SEQ ID NO: 10231 - DNA, 705 bp, Streptococcus agalactiae
atggtatgtgtcgattttattgatcaaaaagtttatagtgaagcagaaggcctatttgtttccgatttagacttaggcattaaaggtttaataagagcacgttatccttttgctctggatagtgactttatttcgtatggaaatttaagtcattattgtatgaattatcttgacgaaattgttcagcgagcgaatcagaaaaatgagaagataaaatataatgtgactaccttgatgaaagaagaagagaagcccttcaacgttgaagagcgtttgaacaagcaagcaactatcggtcaacgaattgctgatgatgttgcacgttttggcggatcttggacttttattatcgtttttgtatccattatggctatttggatgttggttaatatcatgaagccttttggtattcaatttgatccttacccatttatcctgttaaacttagctttatcaacgattgctgcaatccaagcaccacttattatgatgagtcaaaatcgtgctgctgattatgatcgtttgcaagctcgaaatgactttaatgtcaataaaacctctgagttagaaattagattattgcacgaaaagattgatcatatggtacaacaagatcagtttgaattgttagagattcaaaagttacagacagaaatgctagtatcattgggaaatcagttagcacaattgaaacaactacaaaaa

SEQ ID NO: 10232 - protein, 235 aa, Streptococcus agalactiae
MVCVDFIDQKVYSEAEGLFVSDLDLGIKGLIRARYPFALDSDFISYGNLSHYCMNYLDEIVQRANQKNEKIKYNVTTLMKEEEKPFNVEERLNKQATIGQRIADDVARFGGSWTFIIVFVSIMAIWMLVNIMKPFGIQFDPYPFILLNLALSTIAAIQAPLIMMSQNRAADYDRLQARNDFNVNKTSELEIRLLHEKIDHMVQQDQFELLEIQKLQTEMLVSLGNQLAQLKQLQK

SEQ ID NO: 10233 - DNA, 2235 bp, Streptococcus agalactiae
atggtaaaagtttcaaatttagggtatccacgtcttggtgaacagcgcgaatggaagcaagcgatcgaagctttctgggcagggaatcttgaacaaaaagatttagaaaaacaactaaaacaattacgtatcaatcatttaaagaaacaaaaagaggcaggtattgaccttattccagtgggggatttttcttgttatgatcatgttttggatttgtcatttcaattcaatgtaatcccaaagcgtttcgatgagtatgagaggaatttagacctttattttgctattgcaagaggtgataaagataatgtcgcatcatctatgaaaaagtggtttaataccaactaccactacatagtcccagaatgggaggttgagactaaacctcacttgcagaataattacttacttgatctttatctagaagctagggaagtagttggtgataaagcaaagccggttatcactggtccaataacctatgtttccttatcatcaggaattgtcgactttgaagcgactgttcagcggttattaccactttataagcaggtctttcaagatctgatagatgcaggcgccacctatattcagattgatgagccgatatttgtaactgatgaaggtgaacttttagtagatatagctaagtctgtttatgatttttttgcaagagaagtaccacaagcccacttcatctttcaaacctactttgaatcagcagtctgtttagataaactctctaagctgccagtaacgggatttggccttgattttatacatggtagggcggaaaatttagctgctgttaagcaaggtctattccgcgaaaaagaattatttgcaggaattgttaatggtcgaaatatctgggcagtaaatttagaagaaacgttggctttattggaagagataggtccctttgttaaacgattgactcttcaaccttcttcaagtcttttacatgtaccggtgacgactaaatacgaaacacatttagaccctgtgttaaagaatggcttatcatttgctgatgaaaaactaaaggaattagaactattagctagtgcttttgatggtaataaaacaaagggatatcacgaagctttatctcgtttttcagctcttcaagctgctgattttcgtcatgtagcattggaatcattagcagaagtaaagcttgaacgaagtccgtataaattacgccaagctttgcaagctgaaaaattacagttaccgattttaccaacaacaactattggatcctttcctcaatcacctgaaattaggaagaaacgccttgcttggaaaagaggaaatctatctgactcagattataaagatttcataaaaactgaaattagaagatggattgctattcaagaagatcttgatcttgatgtgttagtacatggcgaatttgagcgtgttgatatggttgaattttttggtcaaaagttagctggttttacgacaaccaaattaggctgggtacagtcttatggttcaagggcggtcaaaccacctatcatttatggtgatgtcaaacatattcaacccttaagccttgaagaaacggtttatgcccaaagtttgactaagaaacctgttaaaggcatgttgacaggtcctattactataacgaactggtcatttgagcgagatgatattagccgatctgatctttttaatcaaattgctttggctataaaagatgagattcaacttttggaacaatcaggtattgctattatacaagtggatgaagcagcccttcgagaaggtttacccttacgccagcaaaagcaacaggcttacttagatgatgctgttgcggcctttaaaattgcaacttcatctgtgaaagatgagacacaaattcatacacatatgtgttattcaaaatttgacgaaattattgattctatccgtgcactagatgcagatgttatttctattgaaacgagtagaagtcatggggacatcattgaaagttttgaaacagcagtttatcctctaggaattggcctgggtgtttatgatattcattcccctcgcatacctactaaggaagaaattattgtcaatattcaacgatcactaaaatgtctatcaaaagagcaattttgggtaaaccctgattgtggcttaaaaacacgccgtgaagcagaaacaattgctgccttggaggttcttgtttcagctaccaaagaggttcgtcagcaattagataat

SEQ ID NO: 10234 - protein, 745 aa, Streptococcus agalactiae
MVKVSNLGYPRLGEQREWKQAIEAFWAGNLEQKDLEKQLKQLRINHLKKQKEAGIDLIPVGDFSCYDHVLDLSFQFNVIPKRFDEYERNLDLYFAIARGDKDNVASSMKKWFNTNYHYIVPEWEVETKPHLQNNYLLDLYLEAREVVGDKAKPVITGPITYVSLSSGIVDFEATVQRLLPLYKQVFQDLIDAGATYIQIDEPIFVTDEGELLVDIAKSVYDFFAREVPQAHFIFQTYFESAVCLDKLSKLPVTGFGLDFIHGRAENLAAVKQGLFREKELFAGIVNGRNIWAVNLEETLALLEEIGPFVKRLTLQPSSSLLHVPVTTKYETHLDPVLKNGLSFADEKLKELELLASAFDGNKTKGYHEALSRFSALQAADFRHVALESLAEVKLERSPYKLRQALQAEKLQLPILPTTTIGSFPQSPEIRKKRLAWKRGNLSDSDYKDFIKTEIRRWIAIQEDLDLDVLVHGEFERVDMVEFFGQKLAGFTTTKLGWVQSYGSRAVKPPIIYGDVKHIQPLSLEETVYAQSLTKKPVKGMLTGPITITNWSFERDDISRSDLFNQIALAIKDEIQLLEQSGIAIIQVDEAALREGLPLRQQKQQAYLDDAVAAFKIATSSVKDETQIHTHMCYSKFDEIIDSIRALDADVISIETSRSHGDIIESFETAVYPLGIGLGVYDIHSPRIPTKEEIIVNIQRSLKCLSKEQFWVNPDCGLKTRREAETIAALEVLVSATKEVRQQLDN

SEQ ID NO: 10235 - DNA, 690 bp, Streptococcus agalactiae
atggaaaaaggatttaaagagggagtgaaagatgccttgcccacagctttagggtatatctcaataggcttggcgtttgggatagttgcttcagcatcagatttatctgcaatagaagttggtcttatgagtgccttggtatatgggggatctgctcagtttgctatgtgtgcgctattattagcaaaagcagacttgatgactattacgatgacagtatttttagttaatttgagaaatatgttaatgagtttacacgcgactactatcttcaagtctgctcacctaatgaatcaattagccataggaactctaataacagatgagagctacggcgttttacttggagaagcattacatcacaaagttgtatcgcctagttggatgcatggtaataatgtgatgagttatttgacatgggtaatctcaacgataataggaactttactggggagtactattcctaatccagaaatgtttggtttagactttgcattagtcgccatgtttataggtctctttgtatttcagttgtttgggatgttatctgatggaaagcgacttgttgtatatgttcttgcttctgtaggtttaagttacttcttattagctacttttttgtcaggagccttatcagtattgcttgcgactgttgttggatgtagtgtgggagttgttttagatgataaa

SEQ ID NO: 10236 - protein, 230 aa, Streptococcus agalactiae
MEKGFKEGVKDALPTALGYISIGLAFGIVASASDLSAIEVGLMSALVYGGSAQFAMCALLLAKADLMTITMTVFLVNLRNMLMSLHATTIFKSAHLMNQLAIGTLITDESYGVLLGEALHHKVVSPSWMHGNNVMSYLTWVISTIIGTLLGSTIPNPEMFGLDFALVAMFIGLFVFQLFGMLSDGKRLVVYVLASVGLSYFLLATFLSGALSVLLATVVGCSVGVVLDDK

SEQ ID NO: 10237 - DNA, 4710 bp, Streptococcus agalactiae
atgaacacaaaacagcgtttttcaatccggaaatataagttaggtgccgtatctgtacttttgggaaccctattttttttaggtggtatcacaaatgtagctgctgattctgtcataaataagccatctgatattgcagttgaacagcaagtaaaagacagtccaacgagcatagcaaatgagacacctactaacaacacgtcatcagcccttgcgtcgacagctcaagacaatcttgttacaaaggctaataatagtccaacagaaacacaaccagtagctgagtctcactctcaagccaccgagacattttccccagtcgcaaatcaaccggttgaaagcactcaagaagtttctaaaactcctttaaccaaacaaaatttagcagtcaaatctacaccagctatttctaaagaaacccctcaaaacattgatagtaataaaattatcactgtccccaaagtatggaacacaggctacaaaggagagggaactgttgtagcaattattgactcaggactagatatcaatcacgatgctctccaattaaatgattcgacaaaagcaaaataccaaaacgaacagcaaatgaatgctgctaaagcaaaagctggtataaactatggaaaatggtataacaacaaagtaatctttggtcacaactatgttgatgtcaatacagagctaaaagaggtgaaaagcacttctcatggtatgcacgtaaccagtatcgcaacagctaatcctagcaagaaagatacaaatgaattaatctatggtgttgctcctgaagcacaagtaatgtttatgagagtcttctctgatgaaaaaagaggaactggaccagccctttatgttaaagctattgaagatgccgttaaactcggtgctgacagcattaatttaagtttaggtggagctaatgggtctttagttaatgccgatgaccgacttataaaagctttagagatggctagactcgctggcgtttctgttgttatagcagcaggtaacgacggtacatttgggagtggagcatcaaagccttctgctctttatcctgattatggtttagttggtagtccatcaacagctcgtgaggccatttctgtagcatcatataataatacaacactggttaataaagtcttcaacattatcggattagaaaacaacagaaatctcaacaacggattagctgcttatgcagatcctaaagttagtgataagacctttgaagtagggaaacaatatgattatgttttcgtaggaaaaggaaacgacaatgattataaggacaaaactttaaatggtaaaatcgccttaattgaacgtggagatattacttttacaaaaaaagtcgtcaatgctattaatcacggtgctgtgggagctattatctttaataacaaagctggggaagctaatctaacaatgagtttagatcctgaagcaagtgctattcctgctatttttacccaaaaagagtttggagatgttttagctaaaaacaactataaaattgtatttaacaatatcaaaaataaacaagccaaccctaatgcaggtgtcctatctgacttttcaagctgggggttaacagcagacggacaattaaaacctgacttatctgctcctggaggctctatttacgccgctatcaatgataatgaatatgatatgatgagtgggacaagtatggcttctccccatgtcgctggtgctactgctctagttaaacaatacttattgaaagaacatccagaacttaaaaaaggtgacattgaaagaactgtcaaataccttcttatgagtactgctaaagcacacctaaacaaagatacaggcgcttacacctcaccacgccaacaaggagcaggtattatcgatgtcgcagcagcagttcagacaggattatacctaactggtggggaaaacaactatggcagcgttacattaggaaatattaaagataaaatttcctttgatgttactgttcataatatcaataaagttgcaaaagatttacactatacaacctatttaaatactgatcaagttaaagatggctttgtcacattggctcctcaacaacttggtacatttacagggaaaacgatacggattgaaccagggcaaacccaaacgattacaattgatatagatgtttcgaaataccatgacatgttaaaaaaagtaatgccaaacggctatttcctagaaggctacgtacgttttacagaccctgttgatggtggggaagttcttagtattccttatgttggatttaagggagaattccaaaacttagaagttttagaaaaatccatttataagcttgttgctaacaaagaaaagggattttatttccaaccaaaacaaacaaacgaagttcctggttcagaagattatactgccttaatgactacaagttcagagcctatctactcaacagacggtactagtcctatccaattgaaagccttgggaagctataagtctatagatggaaaatggatcttacaactagatcaaaaaggccagcctcatctagccatttcacctaatgatgaccaaaatcaagatgccgttgcagtgaaaggtgttttcttacgtaatttcaataatttaagagccaaagtctatcgtgcagatgatgttaatttacaaaaaccactatgggtaagtgctccccaagcaggagataaaaattactacagcggaaatactgaaaatccaaaatctacatttttatatgacacagaatggaaaggaaccactactgatggtattcctttagaagatggaaaatacaaatacgttttaacttattactctgatgtccctggctctaagccacaacaaatggtgtttgatatcactttggatagacaagctcctacactaacaacagcaacttatgacaaagatagacgtatcttcaaagctcgtcctgcagtagaacacggggaatctggtatctttagagaacaagttttttacttaaaaaaagataaagatggtcattataatagcgtcttacgtcaacaaggagaagacggtatccttgttgaagataacaaagtatttatcaaacaagaaaaggatggtagctttattctacctaaagaggttaacgatttctctcatgtctactatactgttgaagattatgcaggcaatctagtatcagcaaaactcgaagatttgatcaatattggcaataaaaatggtttagtaaacgtcaaagtgtttagccctgagcttaacagtaatgtcgatattgatttctcttactctgtcaaagatgacaaaggtaatatcatcaaaaagcaacatcacgggaaagacctcaatttattgaaattgccttttggtacctatacgtttgatctattcttatacgatgaggaacgagcaaatctaatcagtcccaaaagtgtcactgtaactatttctgaaaaagatagccttaaagacgtcttatttaaagttaacttactcaagaaagcagccttactcgttgaatttgacaagcttttaccaaaaggagcaacagtccagttggttactaagacaaatactgttgttgatctaccaaaagcaacttattctcctactgactatggtaaaaacatacctgtaggagactatcgtttaaacgtaacgctgcctagtgggtatagcactttagagaacttagatgatttacttgtatccgtaaaagaagatcaggtaaacctaacaaaattgacgctgattaataaagctcctctgattaatgccctagcagaacaaactgatattattacccagcctgtgttttataatgctggaactcacttaaaaaataattacctagctaatcttgaaaaggcacaaactttaattaaaaatagagtggaacaaacaagtattgataatgctattgctgctttgagagaaagtcgccaagctcttaacggtaaagaaacagatacttctttactggcaaaagctattttagctgaaacagaaatcaagggaaactatcaatttgttaatgctagtccattaagccaatcaacttatatcaatcaagtccaattggcgaaaaaccttctacaaaaacctaacgtcactcaatcagaagtagacaaagccttagaaaatcttgatattgctaaaaatcaattaaatggtcatgaaactgattactctggtttacaccatatgataattaaagcaaacgttctgaaacaaacatcatctaaatatcagaacgccagtcaatttgctaaagaaaattataataaccttatcaagaaagcagaattgctgctttccaatagacaagctacacaagctcaagttgaagagttattaaaccaaataaaagcaaccgaacaagagcttgatggccgtgatagagtttcttccgcagagaattatagtcaatcactcaatgataatgactctctcaataccacacctatcaatccgccaaatcagccccaggcgttgatattcaaaaaaggcatgactaaagaaagtgaggttgctcagaagcgtgtcttaggggtgactagccaaaccgataatcaaaaggtaaagacaaacaagcttcctaaaacaggcgaaagcactcctaaaataacctatacaatattgctatttagtctctctatgctaggtctggcaacaatcaaactaaagtctatcaaaagagaa

SEQ ID NO: 10238 - protein, 1570 aa, Streptococcus agalactiae; identical to SEQ ID NO: 8964

SEQ ID NO: 10239 - DNA, 684 bp, Streptococcus agalactiae
atgacaaaaataatttatttcgctgatgatgaaaagaatattcgtgacttggtggttccttttttagaacatgatggtttcactgttcgagcatttgaaactggagaccttctcttagaagcctataaaaaccaaaaacccgatttagttatattagacataatgatgcctggaactaatggtttagatgttatgaaaagcatccgccaatatgataatattcctattatcatgttaacagctagagattctgatgttgatttcattacggcttttaatttaggaactgacgattacttcaccaagcctttttcacctataaaacttagtctacatgttaaagcattgttcaaacgccttgatgaaaaagcaatcaaaaatgacactcagtatcagttcctagatttaactctggataccgaaaagcgaatagccctattatcaaatgaagaaatgcccttaaccaagacagaatttgattttcttttagtattaattgaaaaacctgaaactgctttttctagggaaacactgcttaatcgtatttggggatttgatgatattgaaagcagagcagttgatgacactattaaacgattacgtaaaaaatttaagcaataccacagtcaggttagtatcaaaactgtctggggttacggcttcaaattaatcaaagaggacaaa

SEQ ID NO: 10240 - protein, 228 aa, Streptococcus agalactiae
MTKIIYFADDEKNIRDLVVPFLEHDGFTVRAFETGDLLLEAYKNQKPDLVILDIMMPGTNGLDVMKSIRQYDNIPIIMLTARDSDVDFITAFNLGTDDYFTKPFSPIKLSLHVKALFKRLDEKAIKNDTQYQFLDLTLDTEKRIALLSNEEMPLTKTEFDFLLVLIEKPETAFSRETLLNRIWGFDDIESRAVDDTIKRLRKKFKQYHSQVSIKTVWGYGFKLIKEDK

SEQ ID NO: 10241 - DNA, 2499 bp, Streptococcus agalactiae
atgacattctataatcacaaagaaatcgaacccaaatggcaagctttttgggcagataatcatacctttaaaacaggaacagacgcatcaaaacctaagttttatgccctagatatgttcccatacccatctggagctggtctccacgttggtcacccagaaggctatacagcaacggatattctcagccgtttcaaacgtgcccaaggtcacaatgtcctccacccaatgggttgggatgcttttggacttcctgctgagcagtacgctatggatactggtaatgacccagctgagtttacagctgaaaacatcgctaacttcaaacgccagattaatgctcttggtttctcatacgactgggatcgtgaagttaacacaactgaccctaactactacaagtggacacagtggatctttaccaagctttatgaaaaaggtctagcttacgaagctgaagttccagttaactgggttgaagaattgggaacagctatcgccaacgaagaggttcttccagatggtacatcagaacgtggtggctacccagttgtcagaaaaccaatgcgccaatggatgctcaaaatcactgcctatgcagagcgcttgctggaagacttggaagaagttgactggccagagtcaatcaaggacatgcaacgcaactggattggtaaatcaactggtgctaatgtaaccttcaaggttaaggatacagataaggacttcactgtctttacaacacgtcctgacaccctttttggtgcgacttacgcagttcttgctcctgagcatgccttggttgatgctattacaacagctgaccaagcagaagccgttgccgaatacaaacgtcaagcgagtctcaaatcagaccttgctcgtacagaccttgccaaagaaaaaactggtgtctggacaggtgcctatgccattaacccagttaatggtaaagaaattccagtttggattgcggactatgtccttgctagctacggtacaggtgctatcatggcagttccagctcacgatgaacgtgactgggaattcgcaaaacaattcaacctagacatcattccagttcttgaaggtgggaatgttgaagaggctgcctttacagaagacggtcttcacatcaactcagacttcctagatggtctcgacaaagcggcagctattgccaaaatggtcgagtggcttgaagcagaaggtgttggtaatgagaaagttacttaccgtcttcgtgactggctcttcagccgtcagcgttactggggtgagccaatcccaatcatccactgggaagatggaacatcaactgcggttcctgagagcgaattgccactagttcttccagttactaaggatatccgtccttcaggtactggtgagagcccacttgctaacttgacagactggttggaagtcactcgtgaagatggcgttaaaggtcgtcgtgagaccaacaccatgccacaatgggcaggttcaagctggtactatctccgctacatcgatccacacaacactgaaaaactagctgacgaggaactcctcaaacaatggttgccagttgatatctatgtcggtggtgcagagcatgccgtgcttcaccttctctatgctcgcttctggcacaaggttctttatgatctcggtgtcgtacctaccaaagagccattccaaaaactctttaaccaagggatgattttgggaacaagctaccgcgacagccgtggtgctcttgtggcaactgacaaggttgaaaaacgtgatggcagcttcttccatgtggaaactggtgaagagcttgaacaagcacctgctaagatgtctaaatcacttaagaacgttgtcaatccagatgatgttgttgagcagtacggtgctgacacccttcgtgtttacgagatgttcatgggaccactcgatgcttcaatcgcttggtctgaagaaggtcttgaaggctcacgtaagttcttggaccgtgtttaccgtttgatcacgactaaagagatcactgaggaaaatagcggagctcttgacaaggtttacaacgaaactgttaaggcagttactgagcaagttgaccaaatgaaattcaacacagctatcgctcaactcatggtctttgtcaatgcagccaacaaggaagacaaactctttagcgactatgccaaaggctttgttcaattgattgcaccattcgcaccgcacttaggtgaagaactctggcaagtcttgacagcctcaggacagtcaatctcttacgtgccatggccaagctatgacgaaagcaaattggttgaaaacgaaatcgaaatcgttgtccaaatcaaaggtaaggtcaaagctaaactcgtcgttgctaaagacctttcacgcgaagaattgcaagatcttgctcttgctaacgaaaaagtccaagccgaaatcgcaggcaaagacatcatcaaagtcatcgcagtaccaaacaaactcgttaatattgtggtgaaa

SEQ ID NO: 10242 - protein, 833 aa, Streptococcus agalactiae
MTFYNHKEIEPKWQAFWADNHTFKTGTDASKPKFYALDMFPYPSGAGLHVGHPEGYTATDILSRFKRAQGHNVLHPMGWDAFGLPAEQYAMDTGNDPAEFTAENIANFKRQINALGFSYDWDREVNTTDPNYYKWTQWIFTKLYEKGLAYEAEVPVNWVEELGTAIANEEVLPDGTSERGGYPVVRKPMRQWMLKITAYAERLLEDLEEVDWPESIKDMQRNWIGKSTGANVTFKVKDTDKDFTVFTTRPDTLFGATYAVLAPEHALVDAITTADQAEAVAEYKRQASLKSDLARTDLAKEKTGVWTGAYAINPVNGKEIPVWIADYVLASYGTGAIMAVPAHDERDWEFAKQFNLDIIPVLEGGNVEEAAFTEDGLHINSDFLDGLDKAAAIAKMVEWLEAEGVGNEKVTYRLRDWLFSRQRYWGEPIPIIHWEDGTSTAVPESELPLVLPVTKDIRPSGTGESPLANLTDWLEVTREDGVKGRRETNTMPQWAGSSWYYLRYIDPHNTEKLADEELLKQWLPVDIYVGGAEHAVLHLLYARFWHKVLYDLGVVPTKEPFQKLFNQGMILGTSYRDSRGALVATDKVEKRDGSFFHVETGEELEQAPAKMSKSLKNVVNPDDVVEQYGADTLRVYEMFMGPLDASIAWSEEGLEGSRKFLDRVYRLITTKEITEENSGALDKVYNETVKAVTEQVDQMKFNTAIAQLMVFVNAANKEDKLFSDYAKGFVQLIAPFAPHLGEELWQVLTASGQSISYVPWPSYDESKLVENEIEIVVQIKGKVKAKLVVAKDLSREELQDLALANEKVQAEIAGKDIIKVIAVPNKLVNIVVK

SEQ ID NO: 10243 - DNA, 807 bp, Streptococcus agalactiae
atgagaggtctttatactgctggagttttagatgcttttctagatgcaggaataaaaatagatggtatcgtatctgtctctgctggtgcattgtttggtgttaattttgtatctagacaacgagagagggctttgcgatacaataaaaagtatttatcccaccctaaatatatgagtctaaggtcatggtttcgaacagggaattttgttaataaagatttcacctattatgaagttcctatgaaattggatgtatttgacgatgaagcatttaaaaaatcaagtattgatttttacgtagttgctacagagatgacatctggtaaacctgaatattttaaaattgatagtgtttttgaacaaatggaaattttacgtgctagttcagcattaccagtagtctcaaagatggttgattggcaggggaaaaagtacttagatggtggtttatctgatagtattcccgttgattttgcccgtggtttaggatttgacaagttgattgttgtgatgactaggccgctcaattatcagaaaaagccttcaagtggacgattgtataaaactctgtataggaaatatcctaattttgtaaagacagcctcgaatcggtaccaacagtataataatagtcttgaaaaggtcatgagccttgaaaaaacaggcgatctatttgcaattagaccgagtaagagcttggttattggccgcttagagaagaatccggataaacttgatagtatttatcagcttggtatgaaagatgctaaaagtgtgatgcctgagctgaatagttatctaatgaaa

SEQ ID NO: 10244 - protein, 269 aa, Streptococcus agalactiae
MRGLYTAGVLDAFLDAGIKIDGIVSVSAGALFGVNFVSRQRERALRYNKKYLSHPKYMSLRSWFRTGNFVNKDFTYYEVPMKLDVFDDEAFKKSSIDFYVVATEMTSGKPEYFKIDSVFEQMEILRASSALPVVSKMVDWQGKKYLDGGLSDSIPVDFARGLGFDKLIVVMTRPLNYQKKPSSGRLYKTLYRKYPNFVKTASNRYQQYNNSLEKVMSLEKTGDLFAIRPSKSLVIGRLEKNPDKLDSIYQLGMKDAKSVMPELNSYLMK

SEQ ID NO: 10245 - DNA, 1200 bp, Streptococcus agalactiae
atgcaatttatttatagtattattggtattttattggtattaggaattgtgtatgcaatttctttcaatcgtaagagtgtttctctaagtttaattggaaaagctcttatcgttcaattcattattgcgctaatcttagtacgtatcccactaggtcaacaagttgttagtgttgtttcaactggagttactaaagtaatcaactgtggtcaagctggattaaattttgtgtttggttcattagcagatagtggagcaaaaactggttttattttcgccattcaaacgcttggcaatattgttttcttatctgccctagttagtctactttattatgtaggaatccttggatttgtagtaaaatggataggtaagggcgttggtaaaattatgaaatcctcagaggttgagagttttgttgccgtagctaatatgtttcttggtcaaacagacagtccaattttggttagcaaatacctaggtcgtatgactgatagtgagataatggttgtgttggtatcaggtatgggaagtatgtcagtttctattcttggtggctacattgcattaggcattccaatggaatatctcttgattgcttcaacaatggttcctattggcagtattctcattgctaaaatcttattgcctcaaacagaacctgttcaaaaaattgatgacattaagatggataataaaggtaataacgccaatgtgattgatgcaatcgctgagggtgcaagcacaggtgcacaaatggctttctcaattggtgctagtttgattgcctttgttggtttagtttctttgattaatatgatgttaagtggattgggaatccgcttagaacaaatcttctcatatgtttttgctccatttggttttcttatgggatttgaccacaaaaacattcttctagaaggaaaccttcttggaagtaagttgattttaaatgagtttgtttcgttccaacaattgggtgacctaatcaaatctttagattatcgtacagcattggtagcaactatttcactttgtggttttgctaatttatcaagtttaggtatttgtgtttcaggtattgctgttctttgtccagagaaacgtggcaccctagctcgacttgttttccgtgcaatgattggtggtattgctgtaagtatgcttagcgcctttatcgtcggtattgtaactctattc

SEQ ID NO: 10246 - protein, 400 aa, Streptococcus agalactiae
MQFIYSIIGILLVLGIVYAISFNRKSVSLSLIGKALIVQFIIALILVRIPLGQQVVSVVSTGVTKVINCGQAGLNFVFGSLADSGAKTGFIFAIQTLGNIVFLSALVSLLYYVGILGFVVKWIGKGVGKIMKSSEVESFVAVANMFLGQTDSPILVSKYLGRMTDSEIMVVLVSGMGSMSVSILGGYIALGIPMEYLLIASTMVPIGSILIAKILLPQTEPVQKIDDIKMDNKGNNANVIDAIAEGASTGAQMAFSIGASLIAFVGLVSLINMMLSGLGIRLEQIFSYVFAPFGFLMGFDHKNILLEGNLLGSKLILNEFVSFQQLGDLIKSLDYRTALVATISLCGFANLSSLGICVSGIAVLCPEKRGTLARLVFRAMIGGIAVSMLSAFIVGIVTLF

SEQ ID NO: 10247 - DNA, 735 bp, Streptococcus agalactiae
atgcctaaaaatgaactaaataataaactaaataaactaaagcatgtacaagtctacaataagatttttaacatgattcaagacggtacttattctcctggaatgcaattaccttctgaacccgaattagcagggcaacttaatgttagtcgagctactttacgaaagtcattagcactattacaagaagaccatttggttaaaaatatcagaggaaaaggtaatttcattagagaaaattctagcaacttgtctgaaaacggttacgaaaatagacaacaccctattaaaacttgtctaacttccaaaattacagaagtagaattagaatttcgtgtagaggttcctgcagaagctatcacagcttcacttaaacaagaaacccctgtagttgttattgctgatcgttggtaccacaccgatgatggaccattagcttacacactttcttttatccctatcgaacttatttcagatgctgagatttctttacatgatactaaacagttgttaaacttcattgaagaaggtatctatcaagaaggcatatcaagccactcacaaagccatttgggatatgcgacatctggcaatttttcagcaactaaatataccctatccgatcatggacaattcatattaatacaagaaacaatttttaagcaagagaaaatactaatgtgtaataagcattacgttcccattgagcactttgaattgtccattacctctcat

SEQ ID NO: 10248 - protein, 245 aa, Streptococcus agalactiae
MPKNELNNKLNKLKHVQVYNKIFNMIQDGTYSPGMQLPSEPELAGQLNVSRATLRKSLALLQEDHLVKNIRGKGNFIRENSSNLSENGYENRQHPIKTCLTSKITEVELEFRVEVPAEAITASLKQETPVVVIADRWYHTDDGPLAYTLSFIPIELISDAEISLHDTKQLLNFIEEGIYQEGISSHSQSHLGYATSGNFSATKYTLSDHGQFILIQETIFKQEKILMCNKHYVPIEHFELSITSH

SEQ ID NO: 10249 - DNA, 795 bp, Streptococcus agalactiae
atggtaaggctaatatttagtgatattgatggtactttaattaacagtaattttaaagtaacacctaagacacggcagggaattaaacaaatagtagctcaaggggctactttcgttcccatatcagctaggatgcctgaggcaattactccgattatggaacaaattggaatagattcttatattatttcctataatggggctttaatacaagatatgcaacaaaaaacaattgcttcccacacaatggatggtcaagttgccttacaagtttgttcttatgtaagcaagcattattcgaaaattgcatggaatgtctatcgttatcatgaatggtattcctgtgataaagaaaatgagtgggtccaaaaagaggaggagattgttggtttacaatctaaagagatgagtttgatggagttagagaagcaagataggattcataaacttctcttgatgggagaaccatctctgatgggagaattggagaacactttgaaagctcaatatccacatttatcaatcgcacaatctgctccttactttattgaaataatggctccaggtattgaaaaaggaaaatctgctaaaactttagcagactatttagatatttctcttgcagactctattgcgtttggtgataactataatgatttaaatctgcttgaaattgtgggtaaaggttttgtcatggggaatgctcctaaagatttacaagagagaattggaaatgtaactcaggataatgataacgatggtatttattatgctttagtagagtatatggaaaat

SEQ ID NO: 10250 - protein, 265 aa, Streptococcus agalactiae
MVRLIFSDIDGTLINSNFKVTPKTRQGIKQIVAQGATFVPISARMPEAITPIMEQIGIDSYIISYNGALIQDMQQKTIASHTMDGQVALQVCSYVSKHYSKIAWNVYRYHEWYSCDKENEWVQKEEEIVGLQSKEMSLMELEKQDRIHKLLLMGEPSLMGELENTLKAQYPHLSIAQSAPYFIEIMAPGIEKGKSAKTLADYLDISLADSIAFGDNYNDLNLLEIVGKGFVMGNAPKDLQERIGNVTQDNDNDGIYYALVEYMEN

SEQ ID NO: 10251 - DNA, 858 bp, Streptococcus agalactiae
atgtcgtatccatacaaagccaatcattccattgaatcaatcaccttaaaagtaaatgacctcgaaaacctcgtaaacttctatagcgatatcattgggttaactgttattgacaaatcaagcactagagccttactaggggtaaatcaaaaaatccctcttattatccttgaaaaaactgaacttgaaaagcatagtacctatggcctttatcacactgctattttagtaccagatgaataccatctcagtctagctctaaatcatttattatctcagcatatccctctagagggtggagctgaccatggctatagcaatgctatctatctaagtgatcctgaaggtaatggaattgaaatttataatgataaggatatctctatgtgggatatcagagagagtggacaaattattggtattactgaaagactagatattgacaatttacttgacagccttgtcaacgttcctaataattataagctttctgaaaaaactagtattggtcatattcatttgagtgttaaagatgctaagattagctcaaaactctatcaaaatgtttttggccttgatgagaaatttgcaatcccgacagctagttggattgcatccggcaactaccatcatcatctagcctttaataattgggctggtccaaatctttctaaaaaccaagaagatagacccggaatttccttattgacaattgcttacaatgatgacaacctttttagagatagcttaaaaaaagcgcaactttaccaactgactttccttgaaaaacaagatcattattatattattgaagattttgatggcatccgaattaaagttgttctaaaaccagagaat

SEQ ID NO: 10252 - protein, 286 aa, Streptococcus agalactiae
MSYPYKANHSIESITLKVNDLENLVNFYSDIIGLTVIDKSSTRALLGVNQKIPLIILEKTELEKHSTYGLYHTAILVPDEYHLSLALNHLLSQHIPLEGGADHGYSNAIYLSDPEGNGIEIYNDKDISMWDIRESGQIIGITERLDIDNLLDSLVNVPNNYKLSEKTSIGHIHLSVKDAKISSKLYQNVFGLDEKFAIPTASWIASGNYHHHLAFNNWAGPNLSKNQEDRPGISLLTIAYNDDNLFRDSLKKAQLYQLTFLEKQDHYYIIEDFDGIRIKVVLKPEN

SEQ ID NO: 10253 - DNA, 2169 bp, Streptococcus agalactiae
atgacagaatctgatatcaaagtgattaaacgtgacgggcgtttggtcagctttgataagtataaaatctacacggctctattaaaagctagtaataaagttatcaaaatgtctcctttagttgaggctaaacttgagatgattgcagatcatgtcatcgctgagatctacaatcgttttaaagataacatcaagatatatgaaatacaaaatatcgttgaacataaattattggaagctaatgagtacgctattgcacaagaatatatcaattatcgtacccaacgcgattttgagcgttcacaggctacagatatcaatttttctattggaaaattaattaataaggatcaaactgttgttaatgagaatgctaataaagactctgatgtgtttaatacccaacgtgatttaacagcaggtattgtagggaaatcaattggtctgaaaatgttaccttctcatgtagcaaatgcacatcaaaagggtgatatccattatcatgatttagattacagcccatacactcccatgacaaattgctgtttaatcgattttaagggaatgcttgcaaatggttttaagattggtaatgcagaagttgagagtccaaaatctattcagacagcgactgctcagatttcacagattattgcgaacgttgcttcaagtcaatatggtggctgtacagcagatcgcattgatgagtttttagctccttatgcacagttaaattatcaaaaacatttaaaagatgcaaaagaatgggttattgaagataaacaagaagactatgcgcgcgctaaaacacaaaaagatatatatgatgccatgcaatctttggagtatgaaattaatactttatttacttcaaatgggcaaacgccatttacttcgcttggttttggattaggaactaattggtttgaacgagaaattcaaaaagcgattttgaaaattcggattcaaggtttaggaagcgagcatcgtactgctatttttccaaaattaatttttacgcttaaaaaaggtcttaatttagaagaagatagccccaattatgatattaaacaattagcattagagtgtgcgacaaaacggatgtatccagatgtcctttcttatgataaaattattgacttaacgggctcttttaaagcccctatgggctgtcgttctttcctacaagggtggcgagatgcaaatggtcaggatgtaacatctggtcgtatgaatcttggagttgtaacagttaatctaccgcgtgttgccatggagtctaacggtgatatggataaattctgggagatatttaatgaacgtatgagtattgctagagatgccttggtttatcgtgtggaacgtgtcaaagaggctatcccagcaaatgcgcccattctttaccagtatggagcatttggagaacgtttaggaaaatatgacaatgttgatcgactctttaatcaccgccgtgcaacggtgtctcttggttatattggtttatatgaggtggcgagtgttttttatggtggtgactgggaagataaccatcaagctaaagcatttactgtagacatcgttcgtaagatgaagcagttatgtgcagattggtctgatgagtatgattatcatttttcagtttattcgacaccatcggagagcttgactgaccggttttgtcgtttagatactgaaaaatttggtatagtaactgatattactgataaggaatactacactaattcattccattatgatgtgcgtaagaatccaacaccttttgaaaaactagattttgagaaaatctatcctgaaacgggtgcatcaggaggatttattcactactgtgaataccctgttttgcaacagaatccaaaagctttagaagcagtttgggactatgcttatgatcgggtaggttatctaggtactaatacaccgattgataagtgttaccaatgtcaatttgaaggggattttacaccgacagatcgaggttttacttgtccaaattgtggtaacagcgaccctaagacagtagatgttgtcaaacgtacatgtggttatttaggtaatccacaggctcgtccgatggttaatggtcgtcataaggaaatctctgctcgtgtaaaacatatgaacggatcaagtattaaaaatcaaggtaat

SEQ ID NO: 10254 - protein, 723 aa, Streptococcus agalactiae
MTESDIKVIKRDGRLVSFDKYKIYTALLKASNKVIKMSPLVEAKLEMIADHVIAEIYNRFKDNIKIYEIQNIVEHKLLEANEYAIAQEYINYRTQRDFERSQATDINFSIGKLINKDQTVVNENANKDSDVFNTQRDLTAGIVGKSIGLKMLPSHVANAHQKGDIHYHDLDYSPYTPMTNCCLIDFKGMLANGFKIGNAEVESPKSIQTATAQISQIIANVASSQYGGCTADRIDEFLAPYAQLNYQKHLKDAKEWVIEDKQEDYARAKTQKDIYDAMQSLEYEINTLFTSNGQTPFTSLGFGLGTNWFEREIQKAILKIRIQGLGSEHRTAIFPKLIFTLKKGLNLEEDSPNYDIKQLALECATKRMYPDVLSYDKIIDLTGSFKAPMGCRSFLQGWRDANGQDVTSGRMNLGVVTVNLPRVAMESNGDMDKFWEIFNERMSIARDALVYRVERVKEAIPANAPILYQYGAFGERLGKYDNVDRLFNHRRATVSLGYIGLYEVASVFYGGDWEDNHQAKAFTVDIVRKMKQLCADWSDEYDYHFSVYSTPSESLTDRFCRLDTEKFGIVTDITDKEYYTNSFHYDVRKNPTPFEKLDFEKIYPETGASGGFIHYCEYPVLQQNPKALEAVWDYAYDRVGYLGTNTPIDKCYQCQFEGDFTPTDRGFTCPNCGNSDPKTVDVVKRTCGYLGNPQARPMVNGRHKEISARVKHMNGSSIKNQGN

SEQ ID NO: 10255 - DNA, 1485 bp, Streptococcus agalactiae
atgagtaaacgaacggctatcagaatgaagaaatctagtcgattttcaattttactatatagtgttttgtcaactctcttagcaattgcaaatcctttattgacttattttgcaaatggtttgcagactcagaatctctatacaggtttgatgatgaccaaaggacagatcccttatagtgatgtttttgctacaggaggatttttatactatgtaacgattgctctaagttaccttttagggtctagtatctggttacttattgtacagtttattgcttactatgtatctggaatttatttttataaattagtttattatgtggcacaaagtgaaattgtctcgataggcatgacgttgattttctatataatgaatattgtcttaggattcggtggtatgtacccaatacagtgggcattaccttttatgctcatttcgctatggtttttaattaaattttgtgtcgataatatcgttgatgaagcatttatattttatggcattttagcagcattctcactatttatagatccccaaacactgattttttggctttgctcttttgttctcttaacagcaaccaatattaagcaaaagcagtcactacgaggattttatcagtttttatgcgttgtttttggtatgattttaattgcttatactgttggttactttatgtttaatctacagattatctcttcttatattgacaaagctattttttacccctttacgtatttcgctaggacaaaccactcattccttcttagtttagcaattcaaattgttgtccttctagggtcaggttgtctctttggactatgggattttattcaaaatcgtaaaaaagcatcttatcaaatcggcttgaactttattgcctgtatttttattatttacgctataatggccattttttcaagagattttaacctttaccactttttacctgctttaccatttggtcttttgctaacgagtaataaaattactattctttaccaaaaagtgattgacagacgttcacatagacgtcagtatttctctggtaaatctcttatcgtagacctttttgtaaagaaaacatattatttgcccctcttactagtttccttatcgatagggttactagtttataatacttatcaaaatgttactcttagtaaagaaaggcgtgacatttcacattatttgactacaaaaattgatagagatggtaagatttatgtttgggacaaagttgctagcatttatagccagactcggttaaaatctgcttctcaatttgttttgccacatattaatacagcgcaaaaaaataatgagaaaattttgaaggacgagctgcttcagcatggggctaaatactttatcttaaataaaaatgagaagttaccaaatgaactgaaatctgatattaagaagcactaccaagaagttcctctatcaaatatcactcattttgttctatatcgtttcaaa

SEQ ID NO: 10256 - protein, 495 aa, Streptococcus agalactiae
MSKRTAIRMKKSSRFSILLYSVLSTLLAIANPLLTYFANGLQTQNLYTGLMMTKGQIPYSDVFATGGFLYYVTIALSYLLGSSIWLLIVQFIAYYVSGIYFYKLVYYVAQSEIVSIGMTLIFYIMNIVLGFGGMYPIQWALPFMLISLWFLIKFCVDNIVDEAFIFYGILAAFSLFIDPQTLIFWLCSFVLLTATNIKQKQSLRGFYQFLCVVFGMILIAYTVGYFMFNLQIISSYIDKAIFYPFTYFARTNHSFLLSLAIQIVVLLGSGCLFGLWDFIQNRKKASYQIGLNFIACIFIIYAIMAIFSRDFNLYHFLPALPFGLLLTSNKITILYQKVIDRRSHRRQYFSGKSLIVDLFVKKTYYLPLLLVSLSIGLLVYNTYQNVTLSKERRDISHYLTTKIDRDGKIYVWDKVASIYSQTRLKSASQFVLPHINTAQKNNEKILKDELLQHGAKYFILNKNEKLPNELKSDIKKHYQEVPLSNITHFVLYRFK

SEQ ID NO: 10257 - DNA, 408 bp, Streptococcus agalactiae
atgggacttgacgtcggctcgaaaactgtcggcgttgcaattagtgatccactcggtttcactgcacaaggtcttgaaatcattaagatcgatgaagaatctggaaattttggttttgaccgcttagcagagttagtaaaagagtacaaagttgataaatttgtagttggtctacctaaaaatatgaataatacaagtggtcctcgtgtagaggctagtcaggcatatggcgataaaatcactgaattattcaatcttccagttgaatatcaagatgaacgtttaacgactgttcaagcagagcgtatgctagttgagcaagctgatattagtcgtggtaagcgtaagaaagttatcgataaattagcagctcaactaatcttacaaaattatttagaccgcatgttt

SEQ ID NO: 10258 - protein, 136 aa, Streptococcus agalactiae
MGLDVGSKTVGVAISDPLGFTAQGLEIIKIDEESGNFGFDRLAELVKEYKVDKFVVGLPKNMNNTSGPRVEASQAYGDKITELFNLPVEYQDERLTTVQAERMLVEQADISRGKRKKVIDKLAAQLILQNYLDRMF

SEQ ID NO: 10259 - DNA, 396 bp, Streptococcus agalactiae
atgattaagatttatactatttcaagttgcacaagttgtaaaaaagcaaaaacttggctaaatgctcatcaacttccatataaagaacaaaacctaggtaaagaatcactaacacgtgatgaaattttagaaatattaacaaaaactgaaagtggtattgaaagtatcgtttcttctaaaaatcgttatgctaaggcgctcaattgtaatattgaggagttgagtgtaaatgaagttattgatcttattcaagaaaatccacgtattttaaagagtccaattctaattgatgacaaacgtcttcaagtaggttataaggaagatgatattcgtgcttttctacctcgctctattcgtaacgttgaaaatgcagaagctcgtcttcgtgcagcactt

SEQ ID NO: 10260 - protein, 132 aa, Streptococcus agalactiae
MIKIYTISSCTSCKKAKTWLNAHQLPYKEQNLGKESLTRDEILEILTKTESGIESIVSSKNRYAKALNCNIEELSVNEVIDLIQENPRILKSPILIDDKRLQVGYKEDDIRAFLPRSIRNVENAEARLRAAL

SEQ ID NO: 10261 - DNA, 816 bp, Streptococcus agalactiae
atggttttaccaggtccgcctagtgaattaaagccaatggttatggagcaggtagtacctattttgtcaaataatggcacaaaattatattcacgtgtattgagattctttggtatcggtgagagtcagttagtcacaatcttagaagacataattaagaatcagacagacccaactatagcaccatatgcaaaggttggtgaggtaactttaaggttatcaacgaaagctgaaaatcaggatgaggccgactttaaattagatagcttagaaaaagaaatacttgctcttaagacattagataaccgtaaattaaaagatttattatatggttatggtgataataatagtatggcacgtactgttttagaattattgaaagtacaaaataaaacgattactgccgcagagagcttaacagcagggttatttcaatctcagttagcagaattttctggtgcttcgcaagtttttaatggtggttttacgacctatagtatggaagcaaaatcacaacttctcggcatccctaagaaaaaattgcaagaatatggagttgtcagtcattttacagctgaggcaatggctcagcaagctcgccaacttttaaaagcagattttggtatcggtttaacgggagttgctggtcctgatgagttggaaggataccctgcaggtacagtttttattgggattgcaacccctgaaggcgtttcttctattaaagtatcgattggagggaagagtcgctcagatgtccgtcatatcagtactttacatgcttttgacttggtgcgtagggctttattaaagata

SEQ ID NO: 10262 - protein, 272 aa, Streptococcus agalactiae
MVLPGPPSELKPMVMEQVVPILSNNGTKLYSRVLRFFGIGESQLVTILEDIIKNQTDPTIAPYAKVGEVTLRLSTKAENQDEADFKLDSLEKEILALKTLDNRKLKDLLYGYGDNNSMARTVLELLKVQNKTITAAESLTAGLFQSQLAEFSGASQVFNGGFTTYSMEAKSQLLGIPKKKLQEYGVVSHFTAEAMAQQARQLLKADFGIGLTGVAGPDELEGYPAGTVFIGIATPEGVSSIKVSIGGKSRSDVRHISTLHAFDLVRRALLKI

SEQ ID NO: 10263 - DNA, 549 bp, Streptococcus agalactiae
atgaaacgatgttcttgggtgaatttagataatccattatatgtagcttaccatgataaagagtgggggagagctgttcatgacgatcatgtactctttgagttactatgtttagaaacttatcaatcgggtttatcttgggaaacagtattaaataaacgtcaggagttcagacaagtttttcatcactataatattgaaaaggtagctgcaatgtcagatgcggatttagagataatcttacaaaatcctagggttattcgtcatcgtctaaaacttttctcaacacgacaaaatgctaggtcaattatattaattcagaaagaattcggaagttttgatcgctacatttggtcttttgtagataataaagtacaggttaactcagttaacaactacaacgatgtgcctgcaagtactaccttatccgaacgcttatctaaggatttaaaaaaacgcggttttaaatttgttggtccaacttgcctctattcttttattcaggccgcgggtatggttaatgaccatgaaaatatatgtgatttcaag

SEQ ID NO: 10264 - protein, 183 aa, Streptococcus agalactiae
MKRCSWVNLDNPLYVAYHDKEWGRAVHDDHVLFELLCLETYQSGLSWETVLNKRQEFRQVFHHYNIEKVAAMSDADLEIILQNPRVIRHRLKLFSTRQNARSIILIQKEFGSFDRYIWSFVDNKVQVNSVNNYNDVPASTTLSERLSKDLKKRGFKFVGPTCLYSFIQAAGMVNDHENICDFK

SEQ ID NO: 10265 - DNA, 1230 bp, Streptococcus agalactiae; identical to SEQ ID NO: 8725

SEQ ID NO: 10266 - protein, 410 aa, Streptococcus agalactiae
MKEFFALPKQLQLRELLRFISITVGSAIFPFMAMYYVQYFGNLVTGILIIITQLSGFVATLYGGHLSDAMGRKKVVIIGSLLATIGWAITIAANVPNHITPHLTFVGILIIEIAHQFYFPAYEAMTIDLTNEQNRRFVYTIGYWLVNIAVMLGSGIAGIFYDHHFFELLIVLLIISAICCFVVYFKFDETKPQEGTFKHDKGVLGTFKNYSQVLVDKAFVVYTLGAIGSSVVWLQVDNYFSVNLKQNFEVVSILGHTITGAKMLSLAVFTNTLLIVLLMTTINKFIENWPLKRQLILGSLICGFGMLFNISLNTFGAILIAMTFFTFGEMIYVPASQVLRAEMMVEGKIGSYSGFLAIAQPVASVLAGAMVSLSYFTGKIGVQITLTIFMLAGLVLILYATKMKNIEIGK

SEQ ID NO: 10267 - DNA, 1977 bp, Streptococcus agalactiae
atgaacttgtctaaaattattgaattaccggatatattagctaaccagattgctgctggtgaggttgttgaaaggcctagtagcgtcgttaaagaattagttgaaaatgccatagatgcaggaagtagccaaattaccatagaggttgaagaatctggtcttaaaaagattcaaataacggataacggtgaagggatgactagtgaggatgccgttctcagtttacgacgtcacgctacatccaaaatcaaaagccagagtgacctttttcgtattcggaccttaggttttcgtggtgaagctctaccatcaatcgcttcgattagtttaatgacgataaaaacagctacagagcaagggaaacaagggacgttacttgttgctaaagggggaaacattgaaaaacaggaagttgtttcaagtcctcgtggaacaaaaattttagttgaaaatttattctttaacacgcctgccagattgaaatacatgaagagtttacagtctgaactagctcatattattgatattgttaatagactcagtctagcgcatccggaagttgcttttacactgataaatgatggtaaagaaatgactaaaactagtgggactggcgatttgagacaggcgattgcaggtatttatggtttaaatactgcaaaaaaaatgattgagatttcaaatgcagatttagattttgaaatttcgggttatgtaagtttgcctgaattgacacgagctaaccgaaactatattaccctattaattaacggtcgttacattaaaaattttcttttgaaccgctcaattctagatggttatggttcaaagttgatggttggaagatttccaattgctgtcattgatattcagatagatccttatctagcagatgtcaacgttcatccgactaagcaagaggtgagaatttctaaggaacgagaattaatgagtttaataagcacagcaatttctgagagtcttaaacaatatgacttgattccggatgctttagagaatttagctaaaactagtacccgaagtgtagataagcctatacaaacaagcttctcactaaaacagcctggtttgtattacgatagggctaaaaatgacttttttataggtgcagatactgtatctgaacctattgctaactttacaaaccttgacaaaagtgacggttcagttgacaatgatgtaaaaaactctgttaatcaaggagcaacgcagtctcctaatataaagtatgctagtagagatcaagctgatagtgagaacttcattcattctcaggattaccttagtagtaaacagtcacttaacaaacttgttgaaaaattagattcggaagaaagttcgacttttccagagctcgaattttttggtcaaatgcatgggacctacttatttgctcaagggaatggtgggttgtatattattgatcaacatgcagctcaagagcgtgtaaaatacgagtattaccgtgaaaagataggtgaggttgataatagtcttcaacaattgttagtaccatttctatttgaattttcaagttcagattttcttcaattacaagaaaaaatgtcattattacaagatgttggtattttcttggaaccgtatggtaataatactttcattttaagggaacatccaatttggatgaaagaagaagaggtagagtctggcatttatgaaatgtgtgatatgttgttgctcactaatgaagtatcagtgaaaaaatatcgcgcagagttggctattatgatgtcttgcaagcgatctattaaagcaaaccatacgctagacgattactcagcacgtcatttattagatcagttagcgcaatgtaaaaatccttataattgccctcatggaagacctgttttagttaattttacaaaagctgatatggagaaaatgtttaaacgaatccaagaaaatcatacaagcctcagggatttaggaaaatat

SEQ ID NO: 10268 - protein, 659 aa, Streptococcus agalactiae
MNLSKIIELPDILANQIAAGEVVERPSSVVKELVENAIDAGSSQITIEVEESGLKKIQITDNGEGMTSEDAVLSLRRHATSKIKSQSDLFRIRTLGFRGEALPSIASISLMTIKTATEQGKQGTLLVAKGGNIEKQEVVSSPRGTKILVENLFFNTPARLKYMKSLQSELAHIIDIVNRLSLAHPEVAFTLINDGKEMTKTSGTGDLRQAIAGIYGLNTAKKMIEISNADLDFEISGYVSLPELTRANRNYITLLINGRYIKNFLLNRSILDGYGSKLMVGRFPIAVIDIQIDPYLADVNVHPTKQEVRISKERELMSLISTAISESLKQYDLIPDALENLAKTSTRSVDKPIQTSFSLKQPGLYYDRAKNDFFIGADTVSEPIANFTNLDKSDGSVDNDVKNSVNQGATQSPNIKYASRDQADSENFIHSQDYLSSKQSLNKLVEKLDSEESSTFPELEFFGQMHGTYLFAQGNGGLYIIDQHAAQERVKYEYYREKIGEVDNSLQQLLVPFLFEFSSSDFLQLQEKMSLLQDVGIFLEPYGNNTFILREHPIWMKEEEVESGIYEMCDMLLLTNEVSVKKYRAELAIMMSCKRSIKANHTLDDYSARHLLDQLAQCKNPYNCPHGRPVLVNFTKADMEKMFKRIQENHTSLRDLGKY

SEQ ID NO: 10269 - DNA, 435 bp, Streptococcus agalactiae
atgaataaaatagaacgccaaaaacgtattaaacgtttgatccaatcagggcagattggcacacaagaagaaattaaattacatttaaaaaatgaaggaatcgatgtcacgcaagcgactctatcaagagacttgcgtgagattggtcttttaaaattacgtagcccagaaggtaagctatattatagtttatcaacagctacttcaaatcgatttagcccagccttacgctcatatattttgaaagtatcgcgagcaagttttatgttagttttaaatactaatttaggggaggctagcgttttagcaaactttattgatgagaaagggctgccagagattttaggaacaatggcaggagcagacaccttgttggtgatttgtcaaaatgaagatattgccaaagtttttgaaaaagaactatcagtaggttta

SEQ ID NO: 10270 - protein, 145 aa, Streptococcus agalactiae
MNKIERQKRIKRLIQSGQIGTQEEIKLHLKNEGIDVTQATLSRDLREIGLLKLRSPEGKLYYSLSTATSNRFSPALRSYILKVSRASFMLVLNTNLGEASVLANFIDEKGLPEILGTMAGADTLLVICQNEDIAKVFEKELSVGL

SEQ ID NO: 10271 - DNA, 1689 bp, Streptococcus agalactiae
atggatacaaaacatctaattgcgagtgaaattcaaaaagttgttccagatatggaacaatcgaccattctttctttattagaaaccccaaaaaattcgagcatgggagatttagctttcccagcattctctttggctaaaactctacgcaaagcacctcaaataattgctagtgacattgctgaacaaattaaaagcgaccaatttgaaaaggtggaagctgttggaccttacgttaactttttccttgataaagccgcaatctcaagtcaagttttaaaacaagtcttatctgatggttctgcctatgctactcaaaatattggtgaaggacgaaatgttgccattgacatgtctagtccaaatattgctaagccattctcaattggacaccttcgttcaacagttattggtgatagtttagctaatatttttgataaaattggctatcatcctgttaaaattaatcaccttggcgactggggtaaacaatttggaatgttaatcgttgcctataaaaaatggggcaatgaagaggctgtccgtgctcatcccatcgatgaacttttaaaactttatgtccgtattaatgctgaagccgagacagaccctagcgttgatgaagaggcacgtgagtggtttcgtaaacttgaagctaacgatcctgaagcaactgaattatggcaatggttccgtgacgagtcattattagaattcaaccgtctttacgatcaaatgaatgttacatttgatagctataacggcgaggcattctacaacgacaaaatggatgaagtgcttgaactgctagaatctaaaaacctcctagtcgaatctaaaggtgcacaagttgttaacctagaaaaatacggtattgaacatcctgccctcattaaaaaatccgatggagcaactctctacattacacgtgacttagctgctgcactttaccgtaaacgtacctacgattttgcaaaatcaatctacgttgtaggaaacgaacagtctgcacactttaagcaactaaaagctgtgcttaaagaaatggactacgattggtccgatgatatgactcatgttccttttggccttgtaacaaaaggaggagcaaaattatcaactcgtaaaggaaatgtaattctacttgaacctactgttgcagaagctattaatcgtgcggcatctcagattgaagctaaaaaccctaacctagcagataaagataaagttgctcaagcagttggtgtaggtgctattaaattttacgatttgaaaactgatcgtacaaatggttatgactttgacttagaagcaatggtatcatttgaaggtgaaactgggccatatgtacaatatgcacatgctcgtattcaatcaatcttacgtaaagctaactttagcccatctaatagcgataattacagtctcaacgatgttgaaagctgggaaatcatcaaactcatccaagattttcctcgtattattgtacgtgcggcagataattttgagccctctattattgcaaaattcgctattaatttagctcagtgcttcaataaatattacgcccacacacgtattttagatgaagacgctgaaatcagtagtcgtctagcactttgctatgcaactgctacagtattaaaagaatctcttcgcctcctaggagttgatgctccgaatgaaatg

SEQ ID NO: 10272 - protein, 563 aa, Streptococcus agalactiae
MDTKHLIASEIQKVVPDMEQSTILSLLETPKNSSMGDLAFPAFSLAKTLRKAPQIIASDIAEQIKSDQFEKVEAVGPYVNFFLDKAAISSQVLKQVLSDGSAYATQNIGEGRNVAIDMSSPNIAKPFSIGHLRSTVIGDSLANIFDKIGYHPVKINHLGDWGKQFGMLIVAYKKWGNEEAVRAHPIDELLKLYVRINAEAETDPSVDEEAREWFRKLEANDPEATELWQWFRDESLLEFNRLYDQMNVTFDSYNGEAFYNDKMDEVLELLESKNLLVESKGAQVVNLEKYGIEHPALIKKSDGATLYITRDLAAALYRKRTYDFAKSIYVVGNEQSAHFKQLKAVLKEMDYDWSDDMTHVPFGLVTKGGAKLSTRKGNVILLEPTVAEAINRAASQIEAKNPNLADKDKVAQAVGVGAIKFYDLKTDRTNGYDFDLEAMVSFEGETGPYVQYAHARIQSILRKANFSPSNSDNYSLNDVESWEIIKLIQDFPRIIVRAADNFEPSIIAKFAINLAQCFNKYYAHTRILDEDAEISSRLALCYATATVLKESLRLLGVDAPNEM

SEQ ID NO: 10273 - DNA, 1749 bp, Streptococcus agalactiae
atgaaacgtagtatgtatgctgggcgtgttcgtagtgagcacataggaacatcgattactttaaaaggatgggttggtcgtcgtcgtgaccttggaggccttatttttattgatcttcgcgatcgcgagggaatcatgcaattagttattaatcctgaagaagtatcagcctcagttatggcaaccgcagaaagtctccgtagtgaatttgttatagaggttagcggtgtagtgacagcacgagaacaagctaatgataatttaccaacaggagaagttgaattaaaagtgcaagaattatcgattcttaatacctcgaaaacaacaccatttgaaattaaagatggtattgaggcaaatgatgatacacgcatgcgttaccgttacttggatcttcgtcgtccggaaatgcttgaaaatttcaaattacgtgcgaaagtaacacactcaatccgtaattaccttgacaacttagagtttattgatgtcgaaactccgatgctaacaaaatcaactccagagggggcacgagactatttggttccatcacgtgtcaaccaaggacatttttatgcccttccacaaagccctcaaattacaaaacagctattgatgaatgcgggatttgatcgttattatcaaattgtcaaatgtttccgtgatgaggatttacgtggagaccgtcaacctgagtttacacaagttgacttagagacatcattccttagtgatcaagaaattcaagacattgttgagggtatgattgctaaagtaatgaaagacactaaaggtttagaggtttctttaccattcccaaggatggcatatgatgatgcaatgaataactacgggtctgataagcctgatacaaggtttgatatgcttttacaagacttgacagaaattgtcaaagaagttgacttcaaggtgttctcagaagcttcagtagttaaagcgattgttgtcaaagataaggcggacaagtactctcgaaaaaatattgataaattaacagaaattgcaaaacaatacggtgccaaaggtttagcatggctaaaatatgcagataatactatttcaggtccggttgctaagttcttgacagctattgaaggtaggttgacagaagctttacagctagagaataatgacttaattctatttgtagcagatagtcttgaagtagctaacgagactttaggagcgcttcgtacacgcattgcaaaagaacttgaactcattgattattctaaatttaatttcctatgggttgttgattggccaatgtttgagtggtcagaagaagagggacgatatatgtcggctcatcatccattcaccttgccaacagcggagacagcgcatgagttggaaggggatttggctaaagtacgtgcagttgcctatgatattgttttgaatggatatgagttaggcggtggtagcctacgtattaaccaaaaagatacacaagagcgtatgttcaaggctttaggatttagcgctgaatcagctcaggaacagtttggtttcttacttgaagctatggattacggcttcccaccacatggtggattggcaataggccttgaccgctttgttatgttgttagcaggcaaggacaatattcgagaagttattgcattccctaaaaacaataaggctagtgatccaatgactcaagctcctagtctcgtttcagaacaacaattagaagaattatcacttactgtagaaagttatgaaaac

SEQ ID NO: 10274 - protein, 583 aa, Streptococcus agalactiae
MKRSMYAGRVRSEHIGTSITLKGWVGRRRDLGGLIFIDLRDREGIMQLVINPEEVSASVMATAESLRSEFVIEVSGVVTAREQANDNLPTGEVELKVQELSILNTSKTTPFEIKDGIEANDDTRMRYRYLDLRRPEMLENFKLRAKVTHSIRNYLDNLEFIDVETPMLTKSTPEGARDYLVPSRVNQGHFYALPQSPQITKQLLMNAGFDRYYQIVKCFRDEDLRGDRQPEFTQVDLETSFLSDQEIQDIVEGMIAKVMKDTKGLEVSLPFPRMAYDDAMNNYGSDKPDTRFDMLLQDLTEIVKEVDFKVFSEASVVKAIVVKDKADKYSRKNIDKLTEIAKQYGAKGLAWLKYADNTISGPVAKFLTAIEGRLTEALQLENNDLILFVADSLEVANETLGALRTRIAKELELIDYSKFNFLWVVDWPMFEWSEEEGRYMSAHHPFTLPTAETAHELEGDLAKVRAVAYDIVLNGYELGGGSLRINQKDTQERMFKALGFSAESAQEQFGFLLEAMDYGFPPHGGLAIGLDRFVMLLAGKDNIREVIAFPKNNKASDPMTQAPSLVSEQQLEELSLTVESYEN

SEQ ID NO: 10275 - DNA, 1278 bp, Streptococcus agalactiae
atgaaacttcaaaaaccaaaagggactcaggatatcttacctggagaatcagcaaagtggcaatacgttgaaaatgttatacgcaatctctttaaacaatatcattatgatgaaattcgtacaccaatgtttgaacattacgaggttattagtcgctcagttggggatacaacggatatcgttacaaaagagatgtatgattttcatgataaaggagatcgtcacattacgcttcgtccagaaggaacagcacctgttgtacgttcttatgttgaaaataaactatttgcaccagaagttcaaaaaccaaccaaaatgtattatattggatcaatgttccgatatgagcgcccacaggctggtcgtttacgagaatttcatcaagtaggcgttgagtgctttggatcaaataatccagcaactgatgttgaaacaatcgcaatgggacatcatctatttgaagatttaggtatcaaaaacgttaaacttcatcttaatagtttagggaatccagaaagtcgtcaggcctatcgccaagctcttattgattacttaacacccatacgtgaacaattgtctaaggatagtcaacgtcgtttgaatgaaaatccattgcgcgtactagactctaaggagccagaagacaaactagcagttgaaaatgctccttctattttagattatttagatgagtcaagccaagcccactttgatgctgtgtgtcatatgcttgatgctctaaatattccatacatcattgatactaatatggttcgtggtcttgattattataatcatactatttttgagtttatcactgagattgaagataatgaattaacgatctgtgctggaggccgttatgacggcttagtatcctattttggtggaccagaaacaccagcatttggttttggattaggattagaacgcttgctcttaatattagataagcaagggatttctttaccaatagaaaatactatagatctgtatatagctgtattaggatcagaggctaatctagctgccttagatttggcacaatcaatacgtcatcagggttttaaagtagagcgtgattatttgggtcgtaaaatcaaagcacaatttaagtctgcagatacttttaatgctaaagtgattatgacattaggtagcagtgaagtagattcgaaagaggtcggtttaaaaaataatcaaacacgtcaagaagttaaagttagttttgaaaacattaaaacagatttttcatctgtgcttaaacaattaggattg

SEQ ID NO: 10276 - protein, 426 aa, Streptococcus agalactiae
MKLQKPKGTQDILPGESAKWQYVENVIRNLFKQYHYDEIRTPMFEHYEVISRSVGDTTDIVTKEMYDFHDKGDRHITLRPEGTAPVVRSYVENKLFAPEVQKPTKMYYIGSMFRYERPQAGRLREFHQVGVECFGSNNPATDVETIAMGHHLFEDLGIKNVKLHLNSLGNPESRQAYRQALIDYLTPIREQLSKDSQRRLNENPLRVLDSKEPEDKLAVENAPSILDYLDESSQAHFDAVCHMLDALNIPYIIDTNMVRGLDYYNHTIFEFITEIEDNELTICAGGRYDGLVSYFGGPETPAFGFGLGLERLLLILDKQGISLPIENTIDLYIAVLGSEANLAALDLAQSIRHQGFKVERDYLGRKIKAQFKSADTFNAKVIMTLGSSEVDSKEVGLKNNQTRQEVKVSFENIKTDFSSVLKQLGL

SEQ ID NO: 10277 - DNA, 519 bp, Streptococcus agalactiae
atgagaacatattcagataaaaacgaacttaaggaagaagtactaaaatcatataaaaaatatattgctgaattcaatgacattcctgagaagttgaaagatttaagaattgatgaggttgataggacaccagcggagaatctagcctatcaggttggctggactaccctgatactaaaatgggagtcagatgaacagagtggcttagaagttaaaacaccaactgagacgtttaaatggaatcaacttggagagctatatcagcattttactgagacctacgctagtctaaccatcaaagaacttacggctcaactcaatgataatgtagatgctataggtaacatgattgattcaatgagcgacgaagtcctatttaaacctcatatgagaaattgggctgatagtgcgactaagaatgcagtctgggaagtttataagtttattcatattaatacggtagctcctttcggaacatttagaactaagattcgcaagtggaaaaaagttgctttaaag

SEQ ID NO: 10278 - protein, 173 aa, Streptococcus agalactiae
MRTYSDKNELKEEVLKSYKKYIAEFNDIPEKLKDLRIDEVDRTPAENLAYQVGWTTLILKWESDEQSGLEVKTPTETFKWNQLGELYQHFTETYASLTIKELTAQLNDNVDAIGNMIDSMSDEVLFKPHMRNWADSATKNAVWEVYKFIHINTVAPFGTFRTKIRKWKKVALK

SEQ ID NO: 10279 - DNA, 1119 bp, Streptococcus agalactiae
atggataacaaattcaaaaatatcccaaaacggcatttaccacaaaaactcccatttgactacacgtcaatatatactgacccacaaatcattaaattaactactagggcaaatattgcaatcggtacttacgaaggatttctagagtctatcattaaccctatgctactaatctcccctttgcttagccaagaagccgttctctcttcaaaacttgaagggacccatgccaccttgaaagacttacttaattatgaagctggtaataaagtagatattgagcgtgatgaattgcatgaaatcattaactaccgaaaggctctcttttatgctctagaaaacatttccaccatcaacaacatcgattctaaaggattaccgttatccaatagaattattaaagaaatgcacaaaattcttctagataatgttagaggtagtagtaaaaatcctggtaattttaagagaagtcaaaactatatcggtagtgtatcctcgatttcatacactcctgtccccgcggaaaaaacaccagaatacatgtctaatttggagcaatatatccattatgatgacttagacttattggttcagtcagcaattatccatgctcaatttgaaatgattcacccttttgaagacggtaatggacgaattggacgattgcttataccactattcctgtactatcaggaactactttcttatccaacattttatatgagttcgtattttgaaagagataggtctctttacatatcacacctatcaaacatttcaaaagacaacaactggaaagactggtttgagtattacctagaaggagtgatattgtccgcagaagagagtacaaaaaaagctcaggacatactaagcctatataacattatgaaggaacaagtcatccctaaacttaattctgtttcaggtatccagcttcttgactttatattctcggctccaatctttaaggcagaacaagttagtgaacacctaaaaatttctaagagaactacctatactttactaaataagttaattgatgaaggttatctttcaacagataatgctcaaaggaatagaacctactattgtcctcaacttctttcaatcgttcaa

SEQ ID NO: 10280 - protein, 373 aa, Streptococcus agalactiae
MDNKFKNIPKRHLPQKLPFDYTSIYTDPQIIKLTTRANIAIGTYEGFLESIINPMLLISPLLSQEAVLSSKLEGTHATLKDLLNYEAGNKVDIERDELHEIINYRKALFYALENISTINNIDSKGLPLSNRIIKEMHKILLDNVRGSSKNPGNFKRSQNYIGSVSSISYTPVPAEKTPEYMSNLEQYIHYDDLDLLVQSAIIHAQFEMIHPFEDGNGRIGRLLIPLFLYYQELLSYPTFYMSSYFERDRSLYISHLSNISKDNNWKDWFEYYLEGVILSAEESTKKAQDILSLYNIMKEQVIPKLNSVSGIQLLDFIFSAPIFKAEQVSEHLKISKRTTYTLLNKLIDEGYLSTDNAQRNRTYYCPQLLSIVQ

SEQ ID NO: 10281 - DNA, 528 bp, Streptococcus agalactiae
atgtcttttgaacataagcatgaaggacacgataaacatcacgatcatagagaaaaatactcactaaaaacattaaagaatatctcgacaaaaatcgattataagactgccttagaaactgccaaaaaagaagctcgctcaggctttatttcacaaattgaattaaataccaaaggtgatacacctttttatgaaatcaaagttattgataataaaatagctaaaaaatataaaattgatgctaattctgggaagatcctttcaacaacatcagataatcaactcaattcaaaagatgcccaattaaaacaaccaagtaaagatattcagactgcattacaagctattcaagcaaaatataaaaatgcaaaaataaaagaaatttctcttgcgaataacaaatcaaataagctagtttataaagtaaaactacttgatggaaatactcctaagattgcccaatttgatagtgataaagcatcatttataaaggcaaataagcttaatacaactcataaaaatcacgac

SEQ ID NO: 10282 - protein, 176 aa, Streptococcus agalactiae
MSFEHKHEGHDKHHDHREKYSLKTLKNISTKIDYKTALETAKKEARSGFISQIELNTKGDTPFYEIKVIDNKIAKKYKIDANSGKILSTTSDNQLNSKDAQLKQPSKDIQTALQAIQAKYKNAKIKEISLANNKSNKLVYKVKLLDGNTPKIAQFDSDKASFIKANKLNTTHKNHD

SEQ ID NO: 10283 - DNA, 2538 bp, Streptococcus agalactiae
ttgaaaaagctaattgaaaaagtcaaatcactgacttctgtgattaaaattgtattttttatatctgttttagtgcttattattgttgaaatgattcatttgaaacgaactatttctgttgagcaactaaagagtgtttttgggcaattatctccaatgaatcttttcttaattatccttgtgggggttatcgctgtcttaccgacaaccggatatgactttgtactgaatggacttttacgtacagataaaagcaaaaggtatattttacagactagttggtgtatcaacacttttaataacttgtcaggattcggtggcttaatcgatattgggttgcgcatggctttttatggtaaaaaaggtcaagagaagagtgacctaagagaagtgactcgttttttaccctatcttatttctggtctgtcatttattagtgtgattgccttaatcatgagccatatttttcatgccaaagctagtgttgattactattatttggtattaattggtgctagtatgtattttcctgttatttattggatttctggtcataaaggaagccattatttcggagatatgccatctagtactcgtataaaattaggtgttgtttctttttttgaatggggatgtgcggccgcagcatttataattatcggttatttaatgggcattcatctaccagtttataaaattttaccactattttgtattggttgtgccgtcgggattgtatcccttattcccggtggattaggaagttttgaattagttctatttacagggtttgctgccgagggactacctaaagaaactgtggttgcatggttattactttatcgtttagcctactatattattccattctttgcaggtatctatttctttatccattatttaggtagtcaaataaatcaacgttatgaaaatgtcccgaaagagttagtatcaactgttctacaaaccatggtgagccatttgatgcgtattttaggtgcattcttaatattttcaacagcattttttgaaaatattacttatattatgtggttgcagaagctaggcttggacccattacaagaacaaatgttatggcagtttccaggtttattgctgggggtttgttttattctcttagctagaactattgatcaaaaagtgaaaaatgcttttccaattgctattatctggattactttgacattgttttatcttaatttaggtcatattagttggcgactatctttctggtttattttactattgttaggcttattagtcattaagccaactctctataaaaaacaatttatttatagctgggaagagcgtattaaggatggaatcattatcgttagtttaatgggagttctattttatattgcaggactactattccctatcagggctcatattacaggtggtagtattgaacgcctgcattatatcatagcatgggagccgatagcattggctacgttgattcttactctcgtttatttatgtttggttaagattttacaaggaaaatcttgtcagattggtgatgtgttcaatgtggatcgttataaaaaactacttcaagcttacggtggttcttcggatagcggtttagcctttttaaatgataaaaggctctactggtaccaaaaaaatggagaagattgcgttgcgttccaatttgtaattgtcaataataaatgtcttattatgggggaaccagccggtgatgacacttatattcgtgaagctattgaatcgtttattgatgatgctgataagctagactatgaccttgttttttacagtattggacagaagttgacactacttttacatgagtatggttttgactttatgaaagttggtgaggatgctttagttaatttagaaacgtttactcttaaagggaataagtacaaacctttcagaaatgccctaaatagagttgaaaaggatggtttctatttcgaagttgtacaatcgccacatagtcaagagctactaaatagtttggaagagatttctaatacttggttagaaggacgtcctgaaaaaggtttctcactaggatattttaataaagattatttccaacaagccccaatagctttggtaaaaaatgctgaacacgaagttgttgcttttgctaatattatgccaaactatgaaaagagtattatctctattgatttaatgcgtcacgataaacagaaaattccgaatggcgttatggatttcctctttttatcattattctcttattatcaagagaagggataccactattttgatttggggatggcacctttatcaggagttggtcgcgttgaaacaagttttgctaaagagagaatggcgtatcttgtctatcatttcggtagtcatttctactcatttaatggtttacacaagtataagaagaagtttacaccattgtggtcggaacgttatatttcttgttctcgttcgtcctggttaatttgtgctatttgtgccctattaatggaagatagtaaaattaagattgttaaa

SEQ ID NO: 10284 - protein, 846 aa, Streptococcus agalactiae
MKKLIEKVKSLTSVIKIVFFISVLVLIIVEMIHLKRTISVEQLKSVFGQLSPMNLFLIILVGVIAVLPTTGYDFVLNGLLRTDKSKRYILQTSWCINTFNNLSGFGGLIDIGLRMAFYGKKGQEKSDLREVTRFLPYLISGLSFISVIALIMSHIFHAKASVDYYYLVLIGASMYFPVIYWISGHKGSHYFGDMPSSTRIKLGVVSFFEWGCAAAAFIIIGYLMGIHLPVYKILPLFCIGCAVGIVSLIPGGLGSFELVLFTGFAAEGLPKETVVAWLLLYRLAYYIIPFFAGIYFFIHYLGSQINQRYENVPKELVSTVLQTMVSHLMRILGAFLIFSTAFFENITYIMWLQKLGLDPLQEQMLWQFPGLLLGVCFILLARTIDQKVKNAFPIAIIWITLTLFYLNLGHISWRLSFWFILLLLGLLVIKPTLYKKQFIYSWEERIKDGIIIVSLMGVLFYIAGLLFPIRAHITGGSIERLHYIIAWEPIALATLILTLVYLCLVKILQGKSCQIGDVFNVDRYKKLLQAYGGSSDSGLAFLNDKRLYWYQKNGEDCVAFQFVIVNNKCLIMGEPAGDDTYIREAIESFIDDADKLDYDLVFYSIGQKLTLLLHEYGFDFMKVGEDALVNLETFTLKGNKYKPFRNALNRVEKDGFYFEVVQSPHSQELLNSLEEISNTWLEGRPEKGFSLGYFNKDYFQQAPIALVKNAEHEVVAFANIMPNYEKSIISIDLMRHDKQKIPNGVMDFLFLSLFSYYQEKGYHYFDLGMAPLSGVGRVETSFAKERMAYLVYHFGSHFYSFNGLHKYKKKFTPLWSERYISCSRSSWLICAICALLMEDSKIKIVK

SEQ ID NO: 10285 - DNA, 741 bp, Streptococcus agalactiae
atgactgagaactggttacatactaaagatggttcagatatttattatcgtgtcgttggtcaaggtcaaccgattgtttttttacatggcaatagcttaagtagtcgctattttgataagcaaatagcatatttttctaagtattaccaagttattgttatggatagtagagggcatggcaaaagtcatgcaaagctaaataccattagtttcaggcaaatagcagttgacttaaaggatatcttagttcatttagagattgataaagttatattggtaggccatagcgatggtgccaatttagctttagtttttcaaacgatgtttccaggtatggttagagggcttttgcttaattcagggaacctgactattcatggtcagcgatggtgggatattcttttagtaaggattgcctataaattccttcactatttagggaaactctttccgtatatgaggcaaaaagctcaagttatttcgcttatgttggaggatttgaagattagtccagctgatttacagcatgtgtcaactcctgtaatggttttggttggaaataaggacataattaagttaaatcattctaagaaacttgcttcttattttccaaggggggagttttattctttagttggctttgggcatcacattattaagcaagattcccatgtttttaatattattgcaaaaaagtttatcaacgatacgttgaaaggagaaattgttgaaaaagctaat

SEQ ID NO: 10286 - protein, 247 aa, Streptococcus agalactiae
MTENWLHTKDGSDIYYRVVGQGQPIVFLHGNSLSSRYFDKQIAYFSKYYQVIVMDSRGHGKSHAKLNTISFRQIAVDLKDILVHLEIDKVILVGHSDGANLALVFQTMFPGMVRGLLLNSGNLTIHGQRWWDILLVRIAYKFLHYLGKLFPYMRQKAQVISLMLEDLKISPADLQHVSTPVMVLVGNKDIIKLNHSKKLASYFPRGEFYSLVGFGHHIIKQDSHVFNIIAKKFINDTLKGEIVEKAN

SEQ ID NO: 10287 - DNA, 2316 bp, Streptococcus agalactiae
atgttagacgaattaaaagcaatcataaaaagcccaaaattatggattacgatggctggggttgcactgattccaacgctatataatgttatctttctaagctcaatgtgggatccttatgggaatactaaaaatttacctgtggcagtcgttaaccaagataaatcggctaaattaaatggaaaaactatttcaattggcaaagatatggaggacaatttgtctaaaaatgatagcttagatttccattttacaacagctaaaagagcagaaaaagaattagaaaagggtcactattatatggttattacctttcctaaagatctttctagaaaagcgacaactctcatgacagaaaaaccagaaaggttaaatattacttataaaactactaaggggcgtagttttgtagcttcaaaaatgagtgagacagcagctaataaactaaaagatgaggtagcagaatctattacagggacttatactgaatcagtttttaaaaatatgggttctatgaaaacaggtatcaataaagctgctgatgggagtcaagaattattaaatggttctaataagctacaggatgggagccaaaccttgacaagtaatttagatgttttagcaagctctagtcaaactttttctggaggagctaataaactaaatagtggaataaacctttatacagatggtgtggggaccctatctaacgggttagaaacattatcagatggtgttactgcttacacaacaggtgtgcataagttgagtgaaggtagtcaaaaattagatgataagtctcaagcattggtggaaggatcagaaaagttgacggatggtttacaacaattgtcacaagcaactcaactaaaaccagagcaagaacgtactttgcagaacctttcagatggattaaagaatctaaatcagattattacaaatttacaatcgacagcaactactgatagcgatactaatagtaagttatttaattttttatcaactattgaatcaagtacaaaggctttgatgaatacggctgctgctgataaacaaaagcaaatgactgcggtacaatcaacgtcagcttttaaaagtttaacccctgaacaacaatctcaaatcacctcagcggttactggaacacctacttcagctgagacaattgcagcaaatatttcttcaaatatagaaaatatgaaaactgtgcttagtgaagcatctagttcagccccttctaataatggatcacaaaatcttcaaactttgtcaggaacagctaacaatttagtattaaaagctatctcagatttagataaaattcaaaaattgccaacggctactaagcagttatatcaaggtagtcaaaccttgacaaaaggaatcacggattatacgaatgctgtagggcaattacgcaaaggtgcagtaactttagatagtaaatccaatcaattgatttcaggaacacaaaaagcaagtcagggagctcaaactttagatagtaaatcggatcaattgagagacggagcggggcaattagctagtggttctgatagaattgcagatggttctaataagcttgctgggggaggacatcagttgacagatgggttgacagagttgtcaggtggtgtttctcaattatcaagttctttggggaaagctggggaccagttgtccatggtttctgtaaataaagataatgccaatgcagtatctagcccagtcactatcaagcatgaagattatgatagcgttgatacgaatggtgttggaatggcaccatacatgatttcagttgcgttgatggtggtagctttatcagccaatgttatttttgcgaaagctttatctggcaaagagccagctaatcgttttagttgggctaaaaataaattattaatcaatggattcattgcaactctagcagcaactatcttattttttgcagttcaattcataggtcttaaaccagattaccctggaaaaacctactttattatcctattgacagcatggactttgatggcattagtaactgctttagtgggatgggataataggtatggttccttcttgtcgttattaatattattattccagcttggttcaagcgcaggaacttacccaatagaattgagtcctaagttctttcaaacaattcaaccatttttaccgatgacttactctgtttcaggattaagagagaccatctcgttgacgggagacgttaaccatcaatggagaatgctagtaatctttttagtatcatcgatgatacttgctcttcttatttatcgtaaacaagaagat

SEQ ID NO: 10288 - protein, 772 aa, Streptococcus agalactiae
MLDELKAIIKSPKLWITMAGVALIPTLYNVIFLSSMWDPYGNTKNLPVAVVNQDKSAKLNGKTISIGKDMEDNLSKNDSLDFHFTTAKRAEKELEKGHYYMVITFPKDLSRKATTLMTEKPERLNITYKTTKGRSFVASKMSETAANKLKDEVAESITGTYTESVFKNMGSMKTGINKAADGSQELLNGSNKLQDGSQTLTSNLDVLASSSQTFSGGANKLNSGINLYTDGVGTLSNGLETLSDGVTAYTTGVHKLSEGSQKLDDKSQALVEGSEKLTDGLQQLSQATQLKPEQERTLQNLSDGLKNLNQIITNLQSTATTDSDTNSKLFNFLSTIESSTKALMNTAAADKQKQMTAVQSTSAFKSLTPEQQSQITSAVTGTPTSAETIAANISSNIENMKTVLSEASSSAPSNNGSQNLQTLSGTANNLVLKAISDLDKIQKLPTATKQLYQGSQTLTKGITDYTNAVGQLRKGAVTLDSKSNQLISGTQKASQGAQTLDSKSDQLRDGAGQLASGSDRIADGSNKLAGGGHQLTDGLTELSGGVSQLSSSLGKAGDQLSMVSVNKDNANAVSSPVTIKHEDYDSVDTNGVGMAPYMISVALMVVALSANVIFAKALSGKEPANRFSWAKNKLLINGFIATLAATILFFAVQFIGLKPDYPGKTYFIILLTAWTLMALVTALVGWDNRYGSFLSLLILLFQLGSSAGTYPIELSPKFFQTIQPFLPMTYSVSGLRETISLTGDVNHQWRMLVIFLVSSMILALLIYRKQED

SEQ ID NO: 10289 - DNA, 1686 bp, Streptococcus agalactiae
atgggtaaaaacattgataaaacctatatacaaatgaaaatgcttaatacaggtaaggggcctgctgtccgtgccttaagagcacaagctgataaagccctctatgcacaaacaatgaagcaaactgtagaaaagcaagaaaatcttaccttaagacaagctatgattgacgaaatacttgttgaagatggaaaggttgtgggggttcgtacagcaactaatcagaaattttcagcaaaatctgttgttataacaacaggtactgctcttcgaggagagattatattaggtgatcttaagtactcctcgggccctaataatagtttagcttctgtgacattggcagataatttaagagacctaggattagaaattggtcgtttcaaaactggaacacctcctcgtgtaaaagcctcctctattaattatgaaaagacagagatacaacctggggatgagcaaccaaatcatttttcatttatgtctagggatgaagattatattactgaccaggtaccgtgctggttgacctatacgaatactttgagtcatgacatcatcaatcaaaatctacaccgtgctcctatgttttctggaatcgttaagggagttggtcctagatattgtccgtcaattgaagataaaattgtgcgttttgctgataaagagcgccaccaactcttcttagaaccagaaggtagatacactgaagaagtttatgttcaagggctatcaacgagtcttcctgaggatgttcaagttgatttattacgttctataaaagggcttgaaaatgctgaaatgatgcgtacaggctatgctattgagtatgatattgtattgcctcatcaattaagagcaacactcgaaacaaaagtaattgctggtttgtttactgcaggacagactaatggtacttcaggttatgaagaagctgctggtcaagggttggttgctgggatcaacgctgctcttaaagttcaagggaagccagaacttattttaaaacgaagtgatgcttacattggtgtcatgattgatgatttagttaccaaagggactctagaaccatatcgtctgttgacaagtcgcgcagaatatcgtctgattcttcgtcatgataatgcagatatgcgtttaacagaaatcggttatgagattggcctagtagatgaagagcgttatgcgatatttaaaaagcgtcaaatgcaatttgaaaatgaattagaacgtttagactctataaagttaaagccagtttctgagacaaataaacggattcaagaattgggctttaaacctttgacagatgctttaactgccaaagaatttatgcgccgcccacaaatcacatatgcagtagcaacggattttgttggttgtgctgatgagccattagacagtaaggttattgaacttttggaaactgaaattaaatacgaaggctatattaaaaaggctttagatcaagttgcaaaaatgaaacgaatggaagaaaaacgtattccccctcatattgactgggacgacattgattctatcgcaacagaagctagacaaaaattcaaaaaaattaacccagaaacgctaggtcaggctagtcgtatttcaggagttaatccagccgatattagtattttaatggtttaccttgaaggaagacaaaaaggtcgtaaaaatatcaat

SEQ ID NO: 10290 - protein, 562 aa, Streptococcus agalactiae
MGKNIDKTYIQMKMLNTGKGPAVRALRAQADKALYAQTMKQTVEKQENLTLRQAMIDEILVEDGKVVGVRTATNQKFSAKSVVITTGTALRGEIILGDLKYSSGPNNSLASVTLADNLRDLGLEIGRFKTGTPPRVKASSINYEKTEIQPGDEQPNHFSFMSRDEDYITDQVPCWLTYTNTLSHDIINQNLHRAPMFSGIVKGVGPRYCPSIEDKIVRFADKERHQLFLEPEGRYTEEVYVQGLSTSLPEDVQVDLLRSIKGLENAEMMRTGYAIEYDIVLPHQLRATLETKVIAGLFTAGQTNGTSGYEEAAGQGLVAGINAALKVQGKPELILKRSDAYIGVMIDDLVTKGTLEPYRLLTSRAEYRLILRHDNADMRLTEIGYEIGLVDEERYAIFKKRQMQFENELERLDSIKLKPVSETNKRIQELGFKPLTDALTAKEFMRRPQITYAVATDFVGCADEPLDSKVIELLETEIKYEGYIKKALDQVAKMKRMEEKRIPPHIDWDDIDSIATEARQKFKKINPETLGQASRISGVNPADISILMVYLEGRQKGRKNIN

SEQ ID NO: 10291 - DNA, 1119 bp, Streptococcus agalactiae
atgactgataattcaaacattcgtgtcgttgtaggcatgagtggaggtgttgattcatcagtaactgccctgcttttaaaagagcaaggttatgatgttattggtgtttttatgaaaaattgggatgacacagatgaatttggtgtttgtacggctactgaagattataaagatgttgctgctgttgctgatcagatcggcataccatactactctgtcaactttgaaaaagagtattgggacagggttttcgaatattttttagcagaatatcgagcaggtcgtacgccaaatccagatgttatgtgtaataaggaaattaaatttaaagcatttctagattatgcgatgacattaggtgctgactatgtagcaacaggtcattatgcacaagtaacacgtgatgagaacggaatagttcatatgcttagaggagcagataataataaggatcaaacttattttctaagtcaattatctcaggagcaattgcaaaaaacgttatttccacttggtcatttacaaaaaccagaagttcgccgtatagctgaagaagcaggacttgcgaccgctaagaaaaaagactctactggtatttgttttattggagaaaaaaatttcaaggatttcctgggtcaatatttaccggctcaaccaggtcgtatgatgactgttgatggtcgtgacatgggtgaacatgctggtttaatgtattatactattggtcaaagagggggccttggtattggtgggcaacatggtggagataataaaccttggtttgtagttggaaaggatttaagtaaaaacattctttatgtaggtcaaggtttctatcatgactcattgatgtcaactagcttgacagcttctgaaatccactttacacgtgatatgcctaatgaatttaagctagaatgtacagctaagttcagatatcgtcaacctgacagtaaagttacagtttacgtaaaaggtaatcaagcaagggttgtgtttgatgatttacaacgagcaatcacaccaggtcaagctgttgttttttataatgaacaagaatgtttaggcggtgggatgattgatcaggcttatcgtgatgataaaatctgtcaatacatt

SEQ ID NO: 10292 - protein, 373 aa, Streptococcus agalactiae
MTDNSNIRVVVGMSGGVDSSVTALLLKEQGYDVIGVFMKNWDDTDEFGVCTATEDYKDVAAVADQIGIPYYSVNFEKEYWDRVFEYFLAEYRAGRTPNPDVMCNKEIKFKAFLDYAMTLGADYVATGHYAQVTRDENGIVHMLRGADNNKDQTYFLSQLSQEQLQKTLFPLGHLQKPEVRRIAEEAGLATAKKKDSTGICFIGEKNFKDFLGQYLPAQPGRMMTVDGRDMGEHAGLMYYTIGQRGGLGIGGQHGGDNKPWFVVGKDLSKNILYVGQGFYHDSLMSTSLTASEIHFTRDMPNEFKLECTAKFRYRQPDSKVTVYVKGNQARVVFDDLQRAITPGQAVVFYNEQECLGGGMIDQAYRDDKICQYI

SEQ ID NO: 10293 - DNA, 537 bp, Streptococcus agalactiae
atgaagaaagaaaatattccgaatctattaactgtagtcagaattttaatgattccgttatttatagtattaacttcagtaacaacaagtacaacttggcatattgttgcagctattgtatttgctattgcaagtttgaccgattacctagatggttatctagcacgtaaatggcaagtagtaacaaattttgggaaatttgcagacccattagctgataaaatgctagttatgagtgcttttatcatgttagttggactagacttagcaccagcttgggtttcagctattatcatttgtagagagttagcagttacaggtttgcgtttacttttagttgaaacaggtggaacagtacttgctgcagctatgccagggaaaataaagacggctactcaaatgtttgcagttatttttttgttagtacattggatgacacttggtaacatcatgttatacattgctctattctttaccttgtattcaggctacgactattttaaaggtgcaggcttcttatttaaggatacttttaaa

SEQ ID NO: 10294 - protein, 179 aa, Streptococcus agalactiae
MKKENIPNLLTVVRILMIPLFIVLTSVTTSTTWHIVAAIVFAIASLTDYLDGYLARKWQVVTNFGKFADPLADKMLVMSAFIMLVGLDLAPAWVSAIIICRELAVTGLRLLLVETGGTVLAAAMPGKIKTATQMFAVIFLLVHWMTLGNIMLYIALFFTLYSGYDYFKGAGFLFKDTFK

SEQ ID NO: 10295 - DNA, 1425 bp, Streptococcus agalactiae
atggaaaaagaaaaaaaattaggtcttttaccactaacaatgcttgtcattggctctcttatcggtggcggaatctttgatttaatgcaaaatatgagttccagagccggtttggtaccaatgcttattgcttgggtaattactgctatcgggatggggactttcgttttaagttttcaaaatttatctgaaaaaaggccggacctaacagctggaatctttagttacgctaaagaggggtttggaaactttatgggatttaactctgcatggggttattggttatcagcttggcttggaaatgttgcctacgctgcactcttattcagttcactcggttatttctttaaattctttggtaatggaaataatatcatctcaattattggagcaagtatagttatttgggttgtccatttcttaattttaagaggtgttaatacagctgcatttattaataccatagttacctttgcaaaattagtacctgttattattttcttaatttcagcgttattagctttcaaatttaacatttttagtcttgatatctggggaaatggattacatcaatcaattttcaaccaagtcaattcaactatgaaaaccgctgtttgggtatttattggtattgagggcgccgttgtcttctcaggtcgtgctaaaaaacactctgatattggtaaagcaagtatcctagcattattcactatgatttcactttatgtattgatttctgttttatcacttggtatcatgtcacgtccagaacttgcaaacttaaaaacaccagctatggcttacgttctagaaaaggctgttggtcactggggcgctatcttagttaaccttggtgttatcatttcagtatttggcgctattcttgcttggactttatttgcagcagaattaccatatcaagctgctaaagaaggtgcttttcctaaattctttgcaaaagaaaataaaaacaaagctccaatcaattcactcttagtcactaatctttgtgtacaagcattcttaatcacgttcttattcacacaaagtgcttatcgttttggtttcgcattagcatcatctgctatcttaattccttatgcttttacagcactatatcaattacaattcacactccgtgaggataagtcaactccaggacatcaaaagaatttaattatcggtatcctcgctacaatctatgctgtttaccttatctacgctggtggttttgattacttacttttgacaatgattgcttacactctaggtatgattctctatattaaaatgagaaaagatgacaagcttcctatctttgtgggatatgaaaaaattagtgccattgtcattctagcgctttgcttattatgtattattgaaattatgactggacaaattgacattgctgcaatcctagcaggt

SEQ ID NO: 10296 - protein, 475 aa, Streptococcus agalactiae
MEKEKKLGLLPLTMLVIGSLIGGGIFDLMQNMSSRAGLVPMLIAWVITAIGMGTFVLSFQNLSEKRPDLTAGIFSYAKEGFGNFMGFNSAWGYWLSAWLGNVAYAALLFSSLGYFFKFFGNGNNIISIIGASIVIWVVHFLILRGVNTAAFINTIVTFAKLVPVIIFLISALLAFKFNIFSLDIWGNGLHQSIFNQVNSTMKTAVWVFIGIEGAVVFSGRAKKHSDIGKASILALFTMISLYVLISVLSLGIMSRPELANLKTPAMAYVLEKAVGHWGAILVNLGVIISVFGAILAWTLFAAELPYQAAKEGAFPKFFAKENKNKAPINSLLVTNLCVQAFLITFLFTQSAYRFGFALASSAILIPYAFTALYQLQFTLREDKSTPGHQKNLIIGILATIYAVYLIYAGGFDYLLLTMIAYTLGMILYIKMRKDDKLPIFVGYEKISAIVILALCLLCIIEIMTGQIDIAAILAG

SEQ ID NO: 10297 - DNA, 1359 bp, Streptococcus agalactiae
atgacggaaaacgaacaactattttggaatagagtactagagctatctcgttctcaaatagcaccagcagcttatgaattttttgttctagaggctagactcctcaaaattgaacatcaaactgcagttattactttagataacattgaaatgaaaaagctattctgggaacaaaatttggggcctgttatcctaacagctggttttgaaattttcaatgctgaaattacagctaactatgtctcaaacgatttacatttacaagaaactagtttttctaactaccagcaatctagcaatgaagtaaatactttaccaattagaaaaatcgactctaaccttaaagagaaatatacttttgctaattttgttcaaggagatgaaaatagatgggctgtttcagcatcaattgctgtagctgatagtcctggcacgacttataatcctctatttatctgggggggacctggtctaggaaagacgcatctactaaatgctattggaaatcaagtcttaagagataatccaaacgcgagggttttatacatcactgctgagaattttattaatgaatttgtcagtcatattcgtttagattcgatggaagaattaaaagaaaagtttcgcaacttagacttactcctgattgatgatattcagtcgcttgctaagaaaaccttaggggggacccaagaggagttcttcaatactttcaatgctttacatacaaacgataaacaaatcgtattgaccagtgaccgaaatccaaatcaattaaatgatctagaagaacgtctagtcacgcgctttagttggggactcccagtaaatatcacaccacctgattttgaaacacgagttgctattttaaccaataaaattcaagaatatccttatgattttcctcaagataccattgaatacttagcaggagaatttgattccaacgtacgtgaattagaaggagccttgaaaaatattagtctagttgctgactttaagcatgctaaaactattacagtagatatagctgcagaagctatcagagcacgtaaaaatgatggtcctattgttactgtcattcctatagaagaaattcaaatacaagttggtaaattctatggcgtaactgtaaaagagataaaagcaactaaaagaacacaagatattgtccttgcaagacaggtagccatgtacttagctcgtgagatgacagataacagtctcccaaaaataggtaaagaatttgggggacgagatcactcaactgttctccacgcttataataaaataaaaaatatggttgctcaagatgacaacttacgaattgagatagaaactatcaaaaataaaatcaga

SEQ ID NO: 10298 - protein, 453 aa, Streptococcus agalactiae
MTENEQLFWNRVLELSRSQIAPAAYEFFVLEARLLKIEHQTAVITLDNIEMKKLFWEQNLGPVILTAGFEIFNAEITANYVSNDLHLQETSFSNYQQSSNEVNTLPIRKIDSNLKEKYTFANFVQGDENRWAVSASIAVADSPGTTYNPLFIWGGPGLGKTHLLNAIGNQVLRDNPNARVLYITAENFINEFVSHIRLDSMEELKEKFRNLDLLLIDDIQSLAKKTLGGTQEEFFNTFNALHTNDKQIVLTSDRNPNQLNDLEERLVTRFSWGLPVNITPPDFETRVAILTNKIQEYPYDFPQDTIEYLAGEFDSNVRELEGALKNISLVADFKHAKTITVDIAAEAIRARKNDGPIVTVIPIEEIQIQVGKFYGVTVKEIKATKRTQDIVLARQVAMYLAREMTDNSLPKIGKEFGGRDHSTVLHAYNKIKNMVAQDDNLRIEIETIKNKIR

SEQ ID NO: 10299 - DNA, 780 bp, Streptococcus agalactiae
gtgttctatacagaacagaaagatgatgaaaaaaaacaagtcattaatatactaaggtcttttaaagaaagtgatcatctaatgattataggaggagatggtaccttatcaaaagtaatgacttatctcccccaacatattccgtgcacttattatcctgttggttcgggaaatgattttgccagagctttgaaaattcctaacctcaaagaaacccttaccgctattcagacagaaagattaaaggaaattaattgctttatttatgataaagggctgattttgaatagtttagatttaggttttgcagcctatgtcgtttggaaagcatctaactctaaaataaaaaatattttgaatagatatcgtctaggaaaaataacttacattgttatagctatcaaatcattattacattcttctaaagtacaagtattagtggaaggagagacaggacagcagataaaactaaatgacctttattttttcgcattagcaaataacacttattttggaggtggcattactatttggcctaaagcaagtgctttaactgcagagttagatatggtttacgctaaagggcatacttttctaaaacgattaagtattttattatctttggtttttaaaaggcatactacctctaaaagtataaaacaccagactttcaaagctatgaccgtatattttcctaaaaatagtttgattgaaatagatggcgaaatagttgagttagatcagattagtttaaaatgtcaaaaaaggtatttatatatg

SEQ ID NO: 10300 - protein, 260 aa, Streptococcus agalactiae
MFYTEQKDDEKKQVINILRSFKESDHLMIIGGDGTLSKVMTYLPQHIPCTYYPVGSGNDFARALKIPNLKETLTAIQTERLKEINCFIYDKGLILNSLDLGFAAYVVWKASNSKIKNILNRYRLGKITYIVIAIKSLLHSSKVQVLVEGETGQQIKLNDLYFFALANNTYFGGGITIWPKASALTAELDMVYAKGHTFLKRLSILLSLVFKRHTTSKSIKHQTFKAMTVYFPKNSLIEIDGEIVELDQISLKCQKRYLYM

SEQ ID NO: 10301 - DNA, 573 bp, Streptococcus agalactiae
atggtaaaaatgattgttggattaggaaatccaggaagtaaatataatgatacaaaacataatattggatttatggctgttgacagaattgtaaaagaccttgacgtcaactttacagaagataaaaattttaaagcagagataggtagtgattttatcaacggtgaaaaaatttattttatcaaaccgactacttttatgaataacagtggtattgctgtaaaagccctgcttacttactacaacatttctattaaggatatgattatcatatatgatgatttagacatggaagtcggtaaaatacgttttcgtcaaaaaggatctgctgggggacataatggtatcaagtctattattgctcatttaggtactcaagaatttgatcgtattaaagtaggtataggacgtccgaatggacgtatgacagttattaatcatgttctagggaaatttgataaaaatgatgaaattatgatattaaatacccttgataaggttgacaatgctgtcaattattatttacagacgaatgattttcaaaaaacaatgcagaaatacaacggtttaaaa

SEQ ID NO: 10302 - protein, 191 aa, Streptococcus agalactiae
MVKMIVGLGNPGSKYNDTKHNIGFMAVDRIVKDLDVNFTEDKNFKAEIGSDFINGEKIYFIKPTTFMNNSGIAVKALLTYYNISIKDMIIIYDDLDMEVGKIRFRQKGSAGGHNGIKSIIAHLGTQEFDRIKVGIGRPNGRMTVINHVLGKFDKNDEIMILNTLDKVDNAVNYYLQTNDFQKTMQKYNGLK

SEQ ID NO: 10303 - DNA, 150 bp, Streptococcus agalactiae
ttggtaactgttgtcataacatatcctctaaataaaatttcctctgtcaagctttggataaagtatgcaagaaataaaaagaaaaaaggtccaaaagaaaaggaattgctggaagaaatttccacaaaacctgataaccagtggcaaata

SEQ ID NO: 10304 - protein, 50 aa, Streptococcus agalactiae
MVTVVITYPLNKISSVKLWIKYARNKKKKGPKEKELLEEISTKPDNQWQI

SEQ ID NO: 10305 - DNA, 114 bp, Streptococcus agalactiae
gtgactactttaacacttgccactctaggggctgctacagttcttaccggtgctactttagctactggagctggtgtttcagcggcaacagaagctggtgatactgttgttgac

SEQ ID NO: 10306 - protein, 38 aa, Streptococcus agalactiae
MTTLTLATLGAATVLTGATLATGAGVSAATEAGDTVVD

SEQ ID NO: 10307 - DNA, 183 bp, Streptococcus agalactiae
ttgttacgcctttttgttattgactgtgatgacgagcatatacctatttcctatggctgcccgctacgaaatgtctcttttagataccgtgaaaaagagctttataatggcatgtttaaacttgaaatggactggtgtattgatgtttttattaatcatgacttggtttattatggtgcagtc

SEQ ID NO: 10308 - protein, 61 aa, Streptococcus agalactiae
MLRLFVIDCDDEHIPISYGCPLRNVSFRYREKELYNGMFKLEMDWCIDVFINHDLVYYGAV

SEQ ID NO: 10309 - DNA, 435 bp, Streptococcus agalactiae
atgaagaaagtctgttttgtttgtcttggaaatatctgccgtagcccgatggctgagtttgttatggcgaatttagataaggaggatagcctcttggttgagagtcgtgcgacttcaacatgggagcatggaaatcctatacataggggaacgcaagcgattttgcagcgttatcaaattccttacattaacgataaagggtcacaacctatttctaaagacgatttagcatattttgattatatcatcggtatggatgagcaaaatgtcaaggatttaaaagctctatcacaaggaacctatgatgataagattagtcttttttgtgatggtggtgttcctgatccatggtatactggtgattttgaggaaacctatcgtctagtcaatgatggctgtaaacagtggttaacgctaataaataatagtagagat

SEQ ID NO: 10310 - protein, 145 aa, Streptococcus agalactiae
MKKVCFVCLGNICRSPMAEFVMANLDKEDSLLVESRATSTWEHGNPIHRGTQAILQRYQIPYINDKGSQPISKDDLAYFDYIIGMDEQNVKDLKALSQGTYDDKISLFCDGGVPDPWYTGDFEETYRLVNDGCKQWLTLINNSRD

SEQ ID NO: 10311 - DNA, 117 bp, Streptococcus agalactiae
atggggcttaacggtatggctcttatcgaaaagatcaaaagatcaaaagcaattgagggggactttgttccttatttccatgggaatttttggagtcagcttccttaccatgtttgt

SEQ ID NO: 10312 - protein, 39 aa, Streptococcus agalactiae
MGLNGMALIEKIKRSKAIEGDFVPYFHGNFWSQLPYHVC

SEQ ID NO: 10313 - DNA, 321 bp, Streptococcus agalactiae
ttgttgattggtgaagctgaacctttcgcacgtggacggaaacgtttcattgttggtccttcgttagcgaatgtttcagatactaccaagtttgctttttccaaaccaaagttgttttctgcatttgcaattgctgagttaagagttttctcaataacacgagctgctttgtttggagtgaattttaagattgcgattgcgtcagcaacattcttaccacggataagatcaagtactaaacgtgttttacgaggtgaaacacgcactgtacgagccattgctttagctgaagtaatttctgccattgtgtcctcctcctat

SEQ ID NO: 10314 - protein, 107 aa, Streptococcus agalactiae
MLIGEAEPFARGRKRFIVGPSLANVSDTTKFAFSKPKLFSAFAIAELRVFSITRAALFGVNFKIAIASATFLPRIRSSTKRVLRGETRTVRAIALAEVISAIVSSSY

SEQ ID NO: 10315 - DNA, 114 bp, Streptococcus agalactiae
atgaaggtaagaccatcggttaaaccaatttgcgaatactgtaaagttattcgtcgtaacggtcgtgttatggtaatttgtccgacaaacccaaaacacaaacaacgtcaagga

SEQ ID NO: 10316 - protein, 38 aa, Streptococcus agalactiae; identical to SEQ ID NO: 7244

SEQ ID NO: 10317 - DNA, 363 bp, Streptococcus agalactiae
atggctcgtattgctggagttgatattccaaatgacaaacgtgtagtaatttcacttacttatgtatacggaattggtctttctacatctaaaaaaatcttagcagctgcaggtatttctgaagatatccgcgttaaagatttgacaccagatcaagaggacgctatccgtcgtgaagttgatgcaatcaaagttgaaggtgacctacgtcgtgaggtaaacttgaatattaaacgtttgatggaaatcggttcataccgtggaatccgtcaccgtcgtggacttcctgtccgtggacaaaatactaaaaataacgctcgcactcgtaaaggtaaagctgttgcgattgcaggtaagaaaaaa

SEQ ID NO: 10318 - protein, 121 aa, Streptococcus agalactiae
MARIAGVDIPNDKRVVISLTYVYGIGLSTSKKILAAAGISEDIRVKDLTPDQEDAIRREVDAIKVEGDLRREVNLNIKRLMEIGSYRGIRHRRGLPVRGQNTKNNARTRKGKAVAIAGKKK

SEQ ID NO: 10319 - DNA, 120 bp, Streptococcus agalactiae
ttggatgacttgtgggtagcggagaaattccaaacgaacttggagatagctggttctctccgaaatagctttagggctagcgtcgatgttaagtctcttggaggtagagcactgtttggg

SEQ ID NO: 10320 - protein, 40 aa, Streptococcus agalactiae
MDDLWVAEKFQTNLEIAGSLRNSFRASVDVKSLGGRALFG

SEQ ID NO: 10321 - DNA, 93 bp, Streptococcus agalactiae
ttgactagagaagctggtattatttatcaatcatgtgttttgggttttacccgtaaactaactgttagattaacatttaatttaaggagtttt

SEQ ID NO: 10322 - protein, 31 aa, Streptococcus agalactiae
MTREAGIIYQSCVLGFTRKLTVRLTFNLRSF

SEQ ID NO: 10323 - DNA, 96 bp, Streptococcus agalactiae
gtgaacatagtatcacagctttatgacttgaatatgacctctaaaaataatgatattttatcattaaattatttaaaaaatagcttgacaattttt

SEQ ID NO: 10324 - protein, 32 aa, Streptococcus agalactiae
MNIVSQLYDLNMTSKNNDILSLNYLKNSLTIF

SEQ ID NO: 10325 - DNA, 96 bp, Streptococcus agalactiae
ttgcattatctaaaaggtttatccaaacttgcatcagcaagtcagagtttgagtaaacagtatatggttttgaatccagttgaaaatttatccttt

SEQ ID NO: 10326 - protein, 32 aa, Streptococcus agalactiae
MHYLKGLSKLASASQSLSKQYMVLNPVENLSF

SEQ ID NO: 10327 - DNA, 915 bp, Streptococcus agalactiae
atgacacgtaaaattggaattataggcatggggcacgttggatcaactgttgcacacgctcttattgcacaaggtattggtgatgattatgtctttattgatactaatgttgataaggttaatgctgatatgattgattttcaagatgctctggcaaatgctacttatcacgctaatctagtattaaacgactatgacgcgttgtcagatgctgatgttgtgatttcagccttaggtgatatttcactacagaataacaaagaagctaatcgctttgctgaactaccatttaccagtaaagaagtctacgacgttagccaaaagttaaaatcatctggttttagagggatccttattgtcgttactaatcctgttgatgccattacccagctttatcaagaatatactcaatttcctaaatcacgcgttatcggaacaggaaccttattggatactgctcggatgaaaagagtgcttggtcaacgcctacaagttgatccaaggagtatcggtggttataatctaggagagcatggtaactcccaatttgtcgcttggagtcaggtaactgtaaaaggacaaccagctatatcactattaaaagcagaagaattagaacagataaaagaagcttctttaaaaggcgggcacactgtcttttttggtaaaaaatatactagttatggtatcgctaccgcagctgtccgcatcgttttaactgtgttaaatgattcccatgagttactacctgtatctaccttctatgagtccgaaggggtttaccttggatatccagctattattggtagagtaggaattgtagaaagaatttctctttcactaagcccaaaagaagagcaacaactcacagattcagcggcatttattcgaaattatcttaagcatatcaatctt

SEQ ID NO: 10328 - protein, 305 aa, Streptococcus agalactiae
MTRKIGIIGMGHVGSTVAHALIAQGIGDDYVFIDTNVDKVNADMIDFQDALANATYHANLVLNDYDALSDADVVISALGDISLQNNKEANRFAELPFTSKEVYDVSQKLKSSGFRGILIVVTNPVDAITQLYQEYTQFPKSRVIGTGTLLDTARMKRVLGQRLQVDPRSIGGYNLGEHGNSQFVAWSQVTVKGQPAISLLKAEELEQIKEASLKGGHTVFFGKKYTSYGIATAAVRIVLTVLNDSHELLPVSTFYESEGVYLGYPAIIGRVGIVERISLSLSPKEEQQLTDSAAFIRNYLKHINL

SEQ ID NO: 10329 - DNA, 186 bp, Streptococcus agalactiae
atggctaaagtatgttatttcacaggacgtaaaacagtttctggtaacaaccgttcacacgcgatgaaccaaacaaaacgtactgttaaaccaaaccttcaaaaagttactgttcttatcgacggtaaaccaaaaaaagtttgggtttcagctcgtgcgcttaaatctggtaaagtagaacgcgtt

SEQ ID NO: 10330 - protein, 62 aa, Streptococcus agalactiae
MAKVCYFTGRKTVSGNNRSHAMNQTKRTVKPNLQKVTVLIDGKPKKVWVSARALKSGKVERV

SEQ ID NO: 10331 - DNA, 363 bp, Streptococcus agalactiae
atgactgtaaaaatcaatacaagagatggtcaaattgaactctctgatgacgttattgcaactgtcgttggaggttcagcaacggaaatttttggcgttgttggtatggcaagtaaaagtgctatcaaagataactttcaagcacttttgcgtaaggaaaactacgcaaaaggtgttgttgtgaggtctagtgaagcgggcatcgtagtagatgtttatactgtcatgagttacggcgtcaaaattagtgaagtttcaaaaaatattcaagagcgagtgaaattcaatctcgaaaatcagcttggtttatctgctgatatggtgaatgtttatgtgcaaagtattaaggttgtaggagaagat

SEQ ID NO: 10332 - protein, 121 aa, Streptococcus agalactiae
MTVKINTRDGQIELSDDVIATVVGGSATEIFGVVGMASKSAIKDNFQALLRKENYAKGVVVRSSEAGIVVDVYTVMSYGVKISEVSKNIQERVKFNLENQLGLSADMVNVYVQSIKVVGED

SEQ ID NO: 10333 - DNA, 93 bp, Streptococcus agalactiae
ttgtatgaatgttttaaaacaattctaacacaatttgtcaaaattttcaaaatactgatgctttatcatactaaaatagaaactctgataaaa

SEQ ID NO: 10334 - protein, 31 aa, Streptococcus agalactiae
MYECFKTILTQFVKIFKILMLYHTKIETLIK

SEQ ID NO: 10335 - DNA, 114 bp, Streptococcus agalactiae
atggctgaaaaaacagacctatcgtcagcctatcgcagacttaaaagtcctaacattaaaactagaaaacgtgctctgaaaatcattcatgagtacaaacgttacggtaaaaaa

SEQ ID NO: 10336 - protein, 38 aa, Streptococcus agalactiae; identical to SEQ ID NO: 7390

SEQ ID NO: 10337 - DNA, 288 bp, Streptococcus agalactiae
atgaaacttaaaatcagtgttttaacagcagcttcagctgtcactctattattagctactttagcaagtcttgcgaaggcagacacagtgtcttatccttcacgtgatgccggatttgtctactctcgtgggtatgcgccttctgaatcaagctatccttcacgcgatgccgggtttatctactctcgtgggtatgcgccttctgaatcaagctatccttcacgcgatgccggatttatctactctcgtgggtatgctccaaaacacttcctaagtgcttacgataaa

SEQ ID NO: 10338 - protein, 96 aa, Streptococcus agalactiae; identical to SEQ ID NO: 9020

SEQ ID NO: 10339 - DNA, 105 bp, Streptococcus agalactiae
gtgtctgccttcgcaagacttgctaaagtagctaataatagagtgacagctgaagctgctgttaaaacactgattttaagtttcattataaaatcctttcaaaga

SEQ ID NO: 10340 - protein, 35 aa, Streptococcus agalactiae
MSAFARLAKVANNRVTAEAAVKTLILSFIIKSFQR

SEQ ID NO: 10341 - DNA, 228 bp, Streptococcus agalactiae
atgaaaaataatgttgttacaacaaaggagagaaatattgctaaaccaccactacttggcattggtactttgttgattcttcgagcgttcggtttatcaaccgctcctaccttcaaagatataactcgaataataggagttagaatgattgataataaaaatgctccaatcaatacaaaaatatactcaattgtaaaaggtatcattttatcccatctcaatcatttg

SEQ ID NO: 10342 - protein, 76 aa, Streptococcus agalactiae
MKNNVVTTKERNIAKPPLLGIGTLLILRAFGLSTAPTFKDITRIIGVRMIDNKNAPINTKIYSIVKGIILSHLNHL

SEQ ID NO: 10343 - DNA, 132 bp, Streptococcus agalactiae
atgaacaatgttcctgagaacctagttactatgaccaaatatctaaatacaggatttagcgaaaataatcctgatggtatgttatactacgaaaatagattagatagttggttggcaaatcataaaaatttc

SEQ ID NO: 10344 - protein, 44 aa, Streptococcus agalactiae
MNNVPENLVTMTKYLNTGFSENNPDGMLYYENRLDSWLANHKNF

SEQ ID NO: 10345 - DNA, 135 bp, Streptococcus agalactiae
atgtcaaggatgtggactattgatttttgtccaccaatcgtttaccagcaatatgtttttatcattactattagtattagcattgcgatgtctatttttgctatttatcgctatgcttcattgaagaaaacgata

SEQ ID NO: 10346 - protein, 45 aa, Streptococcus agalactiae
MSRMWTIDFCPPIVYQQYVFIITISISIAMSIFAIYRYASLKKTI

SEQ ID NO: 10347 - DNA, 237 bp, Streptococcus agalactiae
atgaaagaaaaattattagtacctgctttaaattgtttgctaggtctactcttcctaggtgatcactggtttttatttcgtcttcaaaatggagaactttttgctattgtgacgctaatactgctttgcacaacttcatttttaatcaataagaatcaccccaaaaatttgactttaattgctatggttatcacttttttagccgtattatcttttctatctacctttttattagct

SEQ ID NO: 10348 - protein, 79 aa, Streptococcus agalactiae
MKEKLLVPALNCLLGLLFLGDHWFLFRLQNGELFAIVTLILLCTTSFLINKNHPKNLTLIAMVITFLAVLSFLSTFLLA

SEQ ID NO: 10349 - DNA, 96 bp, Streptococcus agalactiae
atgataaacgacaacaacaattggttttacaaagttatcaaaaatgtttttagacgatggtttttatcttatggcttgaaagtgtttttggaaagc

SEQ ID NO: 10350 - protein, 32 aa, Streptococcus agalactiae
MINDNNNWFYKVIKNVFRRWFLSYGLKVFLES

SEQ ID NO: 10351 - DNA, 117 bp, Streptococcus agalactiae
ttggaaaatgtttttgttgctggcgcatttgccctcataggaataactattttattgatgcttttactaggaaggttgatattgctacttatttttcaaggggagatgatgcaattt

SEQ ID NO: 10352 - protein, 39 aa, Streptococcus agalactiae
MENVFVAGAFALIGITILLMLLLGRLILLLIFQGEMMQF

SEQ ID NO: 10353 - DNA, 99 bp, Streptococcus agalactiae
atggagaagtttttccgaaacggtatcaaaaaaggtatcaaaagcaaaaaacgacaaaaaaagcaccttgcaagagacttgcaaaatgcttgtaatcgt

SEQ ID NO: 10354 - protein, 33 aa, Streptococcus agalactiae
MEKFFRNGIKKGIKSKKRQKKHLARDLQNACNR

SEQ ID NO: 10355 - DNA, 324 bp, Streptococcus agalactiae
atggactatgataacgacagctatcttatcccgaaagttttactgcaagatgatttctacagtagtctatctgcgagagatattttagtctatgctgtcttgaaagatagacagatagaagctcctgaaaaaggttggatagatactgatggcagtatatatctaaattttaaactgattgaattagctaaaatgttttcttgcagcagaacgacaatgatagatattatgcaacgactggaagaagttaatttgattgaacgagaaagagtagatgttttttatggctactctttaccctacaaaacctatatcaacgaggta

SEQ ID NO: 10356 - protein, 108 aa, Streptococcus agalactiae
MDYDNDSYLIPKVLLQDDFYSSLSARDILVYAVLKDRQIEAPEKGWIDTDGSIYLNFKLIELAKMFSCSRTTMIDIMQRLEEVNLIERERVDVFYGYSLPYKTYINEV

SEQ ID NO: 10357 - DNA, 123 bp, Streptococcus agalactiae
atgatattacaaataaaagaaaatgactatatatcagctcatatattggttaaagttggtaaatataaattattgaaattacctcataagtttaccaatgagattacggttagaaaggaatac

SEQ ID NO: 10358 - protein, 41 aa, Streptococcus agalactiae
MILQIKENDYISAHILVKVGKYKLLKLPHKFTNEITVRKEY

SEQ ID NO: 10359 - DNA, 111 bp, Streptococcus agalactiae
ttgcttcctcttaataggatattagctactggcctagaagtacatcatgatatttgtagaaattgtggtactattgctagaagttatataaatgacttggagaaattgaaa

SEQ ID NO: 10360 - protein, 37 aa, Streptococcus agalactiae
MLPLNRILATGLEVHHDICRNCGTIARSYINDLEKLK

SEQ ID NO: 10361 - DNA, 489 bp, Streptococcus agalactiae
atgtcaattttagatgactatgaaaaagaattactagttatttcacatcaaataatagcttaccttattaagtcaggtgttaatcctagtcaagcacaggatgttactcaagacgtctttttacaaatactagaatctgatttctcccttccacttgataaaataaaagcttggatgtatcgtactacaattaggaggtatattgatctttatcgaagaaataaacgctataacgaaatcctgcaaaaagaattctttatagaaaataatttgtattacaccgaatcagagaagttttttgaattacatgaagcaatattacacttgaagaaagattatcaaactttaatagatttatattattttaatgatttttcaattaaagaaatatctgaaattactggacaatcacaaagtacaattaaaataagacttatgcgagctagaagagaagttaaaaaatatttagaaaaggataattttaaaata

SEQ ID NO: 10362 - protein, 163 aa, Streptococcus agalactiae
MSILDDYEKELLVISHQIIAYLIKSGVNPSQAQDVTQDVFLQILESDFSLPLDKIKAWMYRTTIRRYIDLYRRNKRYNEILQKEFFIENNLYYTESEKFFELHEAILHLKKDYQTLIDLYYFNDFSIKEISEITGQSQSTIKIRLMRARREVKKYLEKDNFKI

SEQ ID NO: 10363 - DNA, 309 bp, Streptococcus agalactiae
atgattccatcgcaaatgctaaaaggattacttgaaggagctatcctaaaaatcatacagcaagaggagacttatgcttatgaaatctcaaaaaaattaaattcttatggttttggagaaatttccgaagggacaatctaccccattatcttaagactacaaagcaataaatatataaaaggacaacaaaagccttcccctcaaggacctaagcgtaaatattatacgttaaccaatgaaggcgtggagcaattagcccaatttaaacagaattgggagtcacttagtaaagcattaaacaaactactc

SEQ ID NO: 10364 - protein, 103 aa, Streptococcus agalactiae
MIPSQMLKGLLEGAILKIIQQEETYAYEISKKLNSYGFGEISEGTIYPIILRLQSNKYIKGQQKPSPQGPKRKYYTLTNEGVEQLAQFKQNWESLSKALNKLL

SEQ ID NO: 10365 - DNA, 261 bp, Streptococcus agalactiae
atgattgaattactattagcattactgttatggaatattttagtatttgcaacctatgctattgataaaaggcgtgcaattagaggggcatggcgtattagtgagaaaacattgatgatagagagtttattattagggggatttggtgcattcctaggtggagaagtttttcgtcataaaacgactaaatggtatttcagactagtttggtatatcggaatgattattgatttagctattatttggctaatttggtgttat

SEQ ID NO: 10366 - protein, 87 aa, Streptococcus agalactiae
MIELLLALLLWNILVFATYAIDKRRAIRGAWRISEKTLMIESLLLGGFGAFLGGEVFRHKTTKWYFRLVWYIGMIIDLAIIWLIWCY

SEQ ID NO: 10367 - DNA, 129 bp, Streptococcus agalactiae
ttggtcaatggtatggaatactgtagctgtcaatatcataatccttatcattgggttgctcatattatcaatttgccaatacttactgctaaaaaatttttggaagaagcttgtttagtaaaaaggttt

SEQ ID NO: 10368 - protein, 43 aa, Streptococcus agalactiae
MVNGMEYCSCQYHNPYHWVAHIINLPILTAKKFLEEACLVKRF

SEQ ID NO: 10369 - DNA, 246 bp, Streptococcus agalactiae
ttgacaatcgcttgttggatagagatgtttttagaaatagcaaaagtttatttacaaggtttagggcttgccagcataactgttattttagttggtataatttgggtcttttggcgtgccaagaaaaacatagataaaacagctagagaacgccaatctgttctttatgatgtccttctgatagctcttatgacagctccaatacttgcctttgcatttgtagctatcattttaatgataaaagct

SEQ ID NO: 10370 - protein, 82 aa, Streptococcus agalactiae
MTIACWIEMFLEIAKVYLQGLGLASITVILVGIIWVFWRAKKNIDKTARERQSVLYDVLLIALMTAPILAFAFVAIILMIKA

SEQ ID NO: 10371 - DNA, 120 bp, Streptococcus agalactiae
atgaaatatatgaggaatgatcgttttttcggatatgagaacgttttacgcttgatttttccatttaatttaggtattatttactttgatataaaggataggacttatattaaaacgatt

SEQ ID NO: 10372 - protein, 40 aa, Streptococcus agalactiae
MKYMRNDRFFGYENVLRLIFPFNLGIIYFDIKDRTYIKTI

SEQ ID NO: 10373 - DNA, 99 bp, Streptococcus agalactiae
ttgtcatattttgaaatgacaaaaatatctaaaaagtttacttctgattttttatactatgattatagtaaaggagaaccaaatggcaaaagatataat

SEQ ID NO: 10374 - protein, 33 aa, Streptococcus agalactiae
MSYFEMTKISKKFTSDFLYYDYSKGEPNGKRYN

SEQ ID NO: 10375 - DNA, 108 bp, Streptococcus agalactiae
atggcatctcgactggaaaaaaactatcacagccaatccttttctcgtgctattttaagtgcctccaaacgattattaactcctaatttatcaaaaatatttgacgtg

SEQ ID NO: 10376 - protein, 36 aa, Streptococcus agalactiae
MASRLEKNYHSQSFSRAILSASKRLLTPNLSKIFDV

SEQ ID NO: 10377 - DNA, 90 bp, Streptococcus agalactiae
atggacttgcgaaaactttcattctcaacctctttcttctttaaaaaattttatgttaaagatacagcctcaaaagttggcgttctctgt

SEQ ID NO: 10378 - protein, 30 aa, Streptococcus agalactiae
MDLRKLSFSTSFFFKKFYVKDTASKVGVLC

SEQ ID NO: 10379 - DNA, 150 bp, Streptococcus agalactiae
atgggtaaagataaatggactcataaacaaacgtctctgcaaaatctcttacaaaatattttactattagtgggtggagatgacagagataaactcccaaggttgaaggggctaatacaacaattattttctttaagaatcccgagggct

SEQ ID NO: 10380 - protein, 50 aa, Streptococcus agalactiae
MGKDKWTHKQTSLQNLLQNILLLVGGDDRDKLPRLKGLIQQLFSLRIPRA

SEQ ID NO: 10381 - DNA, 255 bp, Streptococcus agalactiae
ttgtcattctctctatctttgatatactttattaactattataacaaaataagaaagggaaggtctattcttatggataattgtactttagaattcccttatagttttgaaaataactttaaacctattttgtccgcttttacatctaatgaaatgccaagctaccccatgctcccattatgtttacaaaaagcacctccatcactcatcggacaaaaaaagacacctcaaaaaggtgtctttttagtatcaata

SEQ ID NO: 10382 - protein, 85 aa, Streptococcus agalactiae
MSFSLSLIYFINYYNKIRKGRSILMDNCTLEFPYSFENNFKPILSAFTSNEMPSYPMLPLCLQKAPPSLIGQKKTPQKGVFLVSI

SEQ ID NO: 10383 - DNA, 537 bp, Streptococcus agalactiae
atgtttcacacaaaaagcctaatccagatggctatgatggctactttattggtggtacttggtttcattcctgctctaccacttggtttcattccggtccctatcgtcttacaaaacctaggggttatgatggctggtgttattttgggcggaagaaaagggagtttatctattttgctcttctttcttgtcggtttagttattcctgtattctcaggtttacgttcgactatacctgtattgacaggaccaacagctggttatgttattgcttggttgtttgttcctttgcttatctcatatggtgtaaaattagtaaataaaaagaattttatagctattttccttattgtatggctagcaggggtcctttttgtagatgtagcaggagcagtttggctggcatcttatacgaacatcccattagataaatcacttcttcaaaacttagtatttatcccaggagatacaataaaagccattatagctgctgttgttgctgttaaatataaagatagttttttcttgactgaaaaa

SEQ ID NO: 10384 - protein, 179 aa, Streptococcus agalactiae
MFHTKSLIQMAMMATLLVVLGFIPALPLGFIPVPIVLQNLGVMMAGVILGGRKGSLSILLFFLVGLVIPVFSGLRSTIPVLTGPTAGYVIAWLFVPLLISYGVKLVNKKNFIAIFLIVWLAGVLFVDVAGAVWLASYTNIPLDKSLLQNLVFIPGDTIKAIIAAVVAVKYKDSFFLTEK

SEQ ID NO: 10385 - DNA, 774 bp, Streptococcus agalactiae
atgaaattaacaacgttaggttgttggggtggttatccttataaagatggaggaaccacaagttttctattaactggagaaaataattttcacttattaatagatgcgggaagtcgttcaatcaatgagctagaaaaagaaataagcccgttggatttggatgcagttatcatcagtcattatcatccagatcatgtagcagatttgggtgtgttgtatcattatcgtttgctataccctaaagataaatgggaacccaaagtattgccagtttatggacataatgaggatgattatgagttttctaaattgacattacctaacgttgctcaaggaattgcttatcataccaatggagttgagcaagttggtcccttcaatattacgtttatcaaaacagtccacccagtcgtctgctatgccatgaggattacagaaagagaaactggtcaagtattagtctttacaggagattctgggtattttgctgaccttgtaccttttacaaaaggcgcagatttatttttagcagacgtttatctttacgagggaaatgaaaatcatattgcacatttgactagtaaagaagcaggtgagattgcttataacgctaaagttaagaaattagttttaacacatgttccgcagtttccgggagaaggaataaaccccgaaaatcatttggaagaacttcgactacagtctgaaaagtatgcaggtggcatctctgttgatttagctcagccacataaatcttgggacttaggaaaacta

SEQ ID NO: 10386 - protein, 258 aa, Streptococcus agalactiae
MKLTTLGCWGGYPYKDGGTTSFLLTGENNFHLLIDAGSRSINELEKEISPLDLDAVIISHYHPDHVADLGVLYHYRLLYPKDKWEPKVLPVYGHNEDDYEFSKLTLPNVAQGIAYHTNGVEQVGPFNITFIKTVHPVVCYAMRITERETGQVLVFTGDSGYFADLVPFTKGADLFLADVYLYEGNENHIAHLTSKEAGEIAYNAKVKKLVLTHVPQFPGEGINPENHLEELRLQSEKYAGGISVDLAQPHKSWDLGKL

SEQ ID NO: 10387 - DNA, 504 bp, Streptococcus agalactiae
atgcagaaatttacccaagaagaaaaagaatggtttatgacagaagctctaaaggaggcaaaatcctccttagagaaagaagaaattcctataggttgtgtcattgtaaaagatggtcatattattggaagaggacataatgctcgtgaagagtttaataaagctattttacatgctgaaatcatggctattaacaatgcaaatgagaaggtagggaattggcgcttattagatactactttatttgttactgtagaaccttgtgtaatgtgtagtggagctattggcttagctagaattccccacgttatatatggcgctaagaatacgaaatttggagcagcgggaagtctctatgatattttaagtgatagccgacttaatcatagagttgaggttgaaaccggcattttagaagatcaatgcgctaaaataatgcaggatttctttcgaaaaggacgacaacgcaagaaagaagctaaactaagtgaaaaaactaagatt

SEQ ID NO: 10388 - protein, 168 aa, Streptococcus agalactiae
MQKFTQEEKEWFMTEALKEAKSSLEKEEIPIGCVIVKDGHIIGRGHNAREEFNKAILHAEIMAINNANEKVGNWRLLDTTLFVTVEPCVMCSGAIGLARIPHVIYGAKNTKFGAAGSLYDILSDSRLNHRVEVETGILEDQCAKIMQDFFRKGRQRKKEAKLSEKTKI

SEQ ID NO: 10389 - DNA, 102 bp, Streptococcus agalactiae
gtgggtcaggggaggaatccagcagccctaagcgatgctaaatgtgtgctctttttattttcaaaagtcaaagtgtttttggaaataattatgaaagtttca

SEQ ID NO: 10390 - protein, 34 aa, Streptococcus agalactiae
MGQGRNPAALSDAKCVLFLFSKVKVFLEIIMKVS

SEQ ID NO: 10391 - DNA, 132 bp, Streptococcus agalactiae
atgtgtgctctttttattttcaaaagtcaaagtgtttttggaaataattatgaaagtttcataaaaattggtagcgtttcaaaaaatatgaaaatacagttaaaaaaccttgaaaaaaaactcacaaaagag

SEQ ID NO: 10392 - protein, 44 aa, Streptococcus agalactiae
MCALFIFKSQSVFGNNYESFIKIGSVSKNMKIQLKNLEKKLTKE

SEQ ID NO: 10393 - DNA, 459 bp, Streptococcus agalactiae
atgataataaattcattcgataatagtagaaaagcgattattaatcctgaagatattaattcaccaataaaaggttttccaaagactgttattacctgtttcgcgcgggagactttcaatcgtattttagaagaattgcctcatcgtgaaattgctagaactagtgtagcaaacttagaaattcccatttatgaattagaatttaaaggacaaaagattggctttttcaatgcttatgttggtgcttcagcttgcgtagcaatcttggaagatattatagtatttggaatggaaagtttaattgtttttggaacatgtggcgtccttgattcgtcaattgaggagacatccattattattccaagaagtgctattagggatgaagggacatcatttcattattcggaagcaagttctgaaattgcagtaaacacaaattcaatttttttactctgcgga

SEQ ID NO: 10394 - protein, 153 aa, Streptococcus agalactiae
MIINSFDNSRKAIINPEDINSPIKGFPKTVITCFARETFNRILEELPHREIARTSVANLEIPIYELEFKGQKIGFFNAYVGASACVAILEDIIVFGMESLIVFGTCGVLDSSIEETSIIIPRSAIRDEGTSFHYSEASSEIAVNTNSIFLLCG

SEQ ID NO: 10395 - DNA, 387 bp, Streptococcus agalactiae
atgcatatcaaagaagttagtaaaaagactggcattacgtcagataccatcaggtattatgagagaattaatcttattccccctattcatcggagtgaatcaggaattcgtgagttcacacaaaacgatattgatattttagaatttgtccgctattttagaggcgcaggtgtttccgttgaaagtctcattgattatattcatttggttgaaaaaggcgattccactatcccagctaggctagaaattttaaaagatgaacgcgacaatcttgaagataggcttcaaggcctccaagaagcacttaatcgtctaaatcacaaaatagacaattatcaaaataaagttgttcctagagaacaagaactttttgatccaacaacgaaa

SEQ ID NO: 10396 - protein, 129 aa, Streptococcus agalactiae
MHIKEVSKKTGITSDTIRYYERINLIPPIHRSESGIREFTQNDIDILEFVRYFRGAGVSVESLIDYIHLVEKGDSTIPARLEILKDERDNLEDRLQGLQEALNRLNHKIDNYQNKVVPREQELFDPTTK

SEQ ID NO: 10397 - DNA, 186 bp, Streptococcus agalactiae
atgagtgatattgaggtatattctgtattagtttctcgtattgaatattctgatggtacaggttcaaaggttcgtcctgctgtagtagtcaaatttaatgatgaagtaataaaaactttaagatttactactaaatatgaaaataagtctgacaatataagaagtcagtatttagaagttattgat

SEQ ID NO: 10398 - protein, 62 aa, Streptococcus agalactiae
MSDIEVYSVLVSRIEYSDGTGSKVRPAVVVKFNDEVIKTLRFTTKYENKSDNIRSQYLEVID

SEQ ID NO: 10399 - DNA, 267 bp, Streptococcus agalactiae
ttgaagaatatcttcgatatgtataaatactatttctttcaaaatcaatatcatcccaagttactctataaaattgtttacgaaaataaactattcaaagaaataaccattgatttagaaatttcaaaggaatgtttagaaatacgacttttccatctacttaaagattattccaatttgaacaataaagaaataagtacgatcgttagtaactttcaaagaaataaaaatcaaaccatgaatttagctctttatgatatcataaca

SEQ ID NO: 10400 - protein, 89 aa, Streptococcus agalactiae
MKNIFDMYKYYFFQNQYHPKLLYKIVYENKLFKEITIDLEISKECLEIRLFHLLKDYSNLNNKEISTIVSNFQRNKNQTMNLALYDIIT

SEQ ID NO: 10401 - DNA, 213 bp, Streptococcus agalactiae
atgttaacgatgcttaacaattcagctaaggagaaagccataaaagagtacttacgtgtcctaaaacctggtggacgtttactcacacatgatgtttcttatcaagatgaagacactgccaagctgatcgatcaacttagacatactatgaatgttaacgttgctcctctaaaaatagatgattggcaaaatttattcttacaaaatggtttt

SEQ ID NO: 10402 - protein, 71 aa, Streptococcus agalactiae
MLTMLNNSAKEKAIKEYLRVLKPGGRLLTHDVSYQDEDTAKLIDQLRHTMNVNVAPLKIDDWQNLFLQNGF

SEQ ID NO: 10403 - DNA, 201 bp, Streptococcus agalactiae
atggtgtcagcgctacttaagtttgattttagcgttgtaaggcataatatggctattaaagttaataatagttttttaatcattatgggaacctcgtttctcttactgctagcttatcatatcaaaaaagaaggaaaagagatactatcttctctgtttgttataagcaattttttgataactctaccttattttttgtta

SEQ ID NO: 10404 - protein, 67 aa, Streptococcus agalactiae
MVSALLKFDFSVVRHNMAIKVNNSFLIIMGTSFLLLLAYHIKKEGKEILSSLFVISNFLITLPYFLL

SEQ ID NO: 10405 - DNA, 288 bp, Streptococcus agalactiae
atggattacaagttagtgatgattattctcatcttagtcatattgatttatttgttgttgcgccttcactatttagaagagttgctaaaacattatcacttcaaaaatgatgaaggagtttgttcattatcaagaacaaaaaatccattgtatctattaatggcaatgattacttttttgccaaatcttatcaattggatagctaatggttttgaggcaatagacattgttcgcctgattcctgtggtagtctttttatggttgtattattgtggagatgacgacgaa

SEQ ID NO: 10406 - protein, 96 aa, Streptococcus agalactiae
MDYKLVMIILILVILIYLLLRLHYLEELLKHYHFKNDEGVCSLSRTKNPLYLLMAMITFLPNLINWIANGFEAIDIVRLIPVVVFLWLYYCGDDDE

SEQ ID NO: 10407 - DNA, 93 bp, Streptococcus agalactiae
atgctaaaaaaatcagaccacgaagtgaagctcctccacaatagtttagcatcagctgtagtcccagaagaaagaacaccaaaatcagctagt

SEQ ID NO: 10408 - protein, 31 aa, Streptococcus agalactiae
MLKKSDHEVKLLHNSLASAVVPEERTPKSAS

SEQ ID NO: 10409 - DNA, 90 bp, Streptococcus agalactiae
ttgaataaacagtttgctattggaagtgaccgaaaaataagcattctgaatgctaaaaaaatcagaccacgaagtgaagctcctccacaa

SEQ ID NO: 10410 - protein, 30 aa, Streptococcus agalactiae
MNKQFAIGSDRKISILNAKKIRPRSEAPPQ

SEQ ID NO: 10411 - DNA, 387 bp, Streptococcus agalactiae
atgtctaccatctattttatttctttatgcatgagttttatcttaagttattatgatataaaataccaagagtatcctatttttctatggatattattcaccatttcaacgataattctcacaccgattacaaaagtttctattgttttgtgtttatttgggattttagctgaagtggttgatattaatatcggaagtggagatttcctttatttagccacaattggcttatctttacctcttcatcaaatgctttttattattcaaataggtgcttggttaggaattatttattgtttagttatgagaaaaatgaaaaaaacgatagcttttctaccgtttttaagtatcgcttatataatcgtcaccagttactctcttttattc

SEQ ID NO: 10412 - protein, 129 aa, Streptococcus agalactiae
MSTIYFISLCMSFILSYYDIKYQEYPIFLWILFTISTIILTPITKVSIVLCLFGILAEVVDINIGSGDFLYLATIGLSLPLHQMLFIIQIGAWLGIIYCLVMRKMKKTIAFLPFLSIAYIIVTSYSLLF

SEQ ID NO: 10413 - DNA, 243 bp, Streptococcus agalactiae
atgttttacttaattgttgcccttttgattgccttgtattacttttttatggcaccaaaaacagtacgtaatactttgaacgctattggtttagtaggtttggtagccttattacttgtcttggcagttatgagttttattaaaatccttcaattgccaggtgaattgtatattgggcttataatgattcctctaggatatacagcatttaaagaaacattgaatttgtcagaaaagaagaaa

SEQ ID NO: 10414 - protein, 81 aa, Streptococcus agalactiae
MFYLIVALLIALYYFFMAPKTVRNTLNAIGLVGLVALLLVLAVMSFIKILQLPGELYIGLIMIPLGYTAFKETLNLSEKKK

SEQ ID NO: 10415 - DNA, 252 bp, Streptococcus agalactiae
atgatattagtactattaatattattaaaaacaattagggtctattcttatatcttactagcctatgccttgttatcttggtttccaggagcatacgattcatggattggtagactagtggtacagattgttgatccgattattcgcccactcagaagatttaatctacaatttttaggtctagattttacagtaatagtagcattctttttactaaatatgttgagtagatttttaatcttgctttttaca

SEQ ID NO: 10416 - protein, 84 aa, Streptococcus agalactiae
MILVLLILLKTIRVYSYILLAYALLSWFPGAYDSWIGRLVVQIVDPIIRPLRRFNLQFLGLDFTVIVAFFLLNMLSRFLILLFT

SEQ ID NO: 10417 - DNA, 102 bp, Streptococcus agalactiae
atgactactgagaaaaatcgttatttgcggattttagacgataaaatcgttaaaaagttagtaaaaatgttgcttttcatgttgctttggtcacttttgtgt

SEQ ID NO: 10418 - protein, 34 aa, Streptococcus agalactiae
MTTEKNRYLRILDDKIVKKLVKMLLFMLLWSLLC

SEQ ID NO: 10419 - DNA, 228 bp, Streptococcus agalactiae
atggaatcacatttagtgagaatcatcaatcgcctcgaattaatggcgactgatggtggtaatttaaaacgtaattttgaacgtgaaggtgttgttgtagcagaagtatcttttagtaatgaccctgaaaacggtcctgttttcacattacgtgatgtagaagcgcgtgaatcatattcatttgacagcattgaccttatcgcaatggaaatttacgatttattatac

SEQ ID NO: 10420 - protein, 76 aa, Streptococcus agalactiae
MESHLVRIINRLELMATDGGNLKRNFEREGVVVAEVSFSNDPENGPVFTLRDVEARESYSFDSIDLIAMEIYDLLY

SEQ ID NO: 10421 - DNA, 195 bp, Streptococcus agalactiae
atgtcagaaaaagctatactattaattatccttattgcttttgttattatcgctattataaagatagctctgttaaagttatatatgaatacgataaaacctaaagtagataatgaaggaaacatcataacaaagcctgtaaaggatgatttaacacccgaggaacgtgaagaacgtgaatttgataaagattgg

SEQ ID NO: 10422 - protein, 65 aa, Streptococcus agalactiae
MSEKAILLIILIAFVIIAIIKIALLKLYMNTIKPKVDNEGNIITKPVKDDLTPEEREEREFDKDW

SEQ ID NO: 10423 - DNA, 114 bp, Streptococcus agalactiae
gtgactgaaaatatgattgaatttagaaaactaaattcattttttcgtgtgatcttggtaactgccaagatcttttttattgccatgactattgttaatagtttcataaaagca

SEQ ID NO: 10424 - protein, 38 aa, Streptococcus agalactiae
MTENMIEFRKLNSFFRVILVTAKIFFIAMTIVNSFIKA

SEQ ID NO: 10425 - DNA, 180 bp, Streptococcus agalactiae
ttgggaaaaagggtaaaaacaactggcattgcacaaattgtggaagaacgtttaagacaaaataaaaaagccccacgctcaaattttgtccaaggagagcgtgaggcaaattctagtatagtaaaaacctgctttttgggaggggtttttaccatacctattttaacagaaaatgaggta

SEQ ID NO: 10426 - protein, 60 aa, Streptococcus agalactiae
MGKRVKTTGIAQIVEERLRQNKKAPRSNFVQGEREANSSIVKTCFLGGVFTIPILTENEV

SEQ ID NO: 10427 - DNA, 195 bp, Streptococcus agalactiae
ttgttttatacctcattttctgttaaaataggtatggtaaaaacccctcccaaaaagcaggtttttactatactagaatttgcctcacgctctccttggacaaaatttgagcgtggggcttttttattttgtcttaaacgttcttccacaatttgtgcaatgccagttgtttttaccctttttcccaaccaaacc

SEQ ID NO: 10428 - protein, 65 aa, Streptococcus agalactiae
MFYTSFSVKIGMVKTPPKKQVFTILEFASRSPWTKFERGAFLFCLKRSSTICAMPVVFTLFPNQT

SEQ ID NO: 10429 - DNA, 141 bp, Streptococcus agalactiae
atgagaccaaaacaatatccgtatagcggaaataaaaaagaatctattgcggtaacagtagattccaaaacgctagccgagaaactagagattactgaccaatcgaatatttcccaagcgaaacaccgattatttggtctg

SEQ ID NO: 10430 - protein, 47 aa, Streptococcus agalactiae
MRPKQYPYSGNKKESIAVTVDSKTLAEKLEITDQSNISQAKHRLFGL

SEQ ID NO: 10431 - DNA, 99 bp, Streptococcus agalactiae
ttgatttcatcttcacatcaagaattcaaaatgccgtttgtctacttgtttacagaccaaataatcggtgtttcgcttgggaaatattcgattggtcag

SEQ ID NO: 10432 - protein, 33 aa, Streptococcus agalactiae
MISSSHQEFKMPFVYLFTDQIIGVSLGKYSIGQ

SEQ ID NO: 10433 - DNA, 129 bp, Streptococcus agalactiae
atgttaattaataaaaatttagtaagagacattagacttgctatcaatgaatacgatgataattatgacgaagataacgcagaagtttgtatagaagtcattagacgattgattgaacaggaggaattc

SEQ ID NO: 10434 - protein, 43 aa, Streptococcus agalactiae
MLINKNLVRDIRLAINEYDDNYDEDNAEVCIEVIRRLIEQEEF

SEQ ID NO: 10435 - DNA, 129 bp, Streptococcus agalactiae
atgaatattgaagacattgaacgtattatttcagaatatctaatttttaggtctgacattgatggttgtgcagtaattgacattgaagattttttaaagcatattcgtttttcgtatgagcgactaaaa

SEQ ID NO: 10436 - protein, 43 aa, Streptococcus agalactiae
MNIEDIERIISEYLIFRSDIDGCAVIDIEDFLKHIRFSYERLK

SEQ ID NO: 10437 - DNA, 213 bp, Streptococcus agalactiae
atgatttatagagacaaaaacacaggagcagtagtcgttactgactgtgcgctgttaggcgactgggagattgttcctaacacagtagataagacaccgacaagtgatgaaaaatcttggaccgttcaaactctgaaagaacatttgacagggctaggaattgagtataactcgtctgctacaaaatctgagttattagaattactccctaaa

SEQ ID NO: 10438 - protein, 71 aa, Streptococcus agalactiae
MIYRDKNTGAVVVTDCALLGDWEIVPNTVDKTPTSDEKSWTVQTLKEHLTGLGIEYNSSATKSELLELLPK

SEQ ID NO: 10439 - DNA, 333 bp, Streptococcus agalactiae
ttgattgaagtaattatcaaaaaatatttagacgagcatttagatgtgccgtctttttttgaacatcaaaaagatgaacctgcacgattcatcattttagaaaagactagcggggctaagcaaaatcatttgctaagttccacgtttgcttttcaaagttatgccgaatcgttgtatgaggcggctttacttaatgacaaagtaaagcaagtaattgagcagcttgatgtcttgccacaagtttctggtgtacatcttaacgctgactacaattttacagatacagcaactaagcgctatcgctatcaagctgtatttgacattaatcattat

SEQ ID NO: 10440 - protein, 111 aa, Streptococcus agalactiae
MIEVIIKKYLDEHLDVPSFFEHQKDEPARFIILEKTSGAKQNHLLSSTFAFQSYAESLYEAALLNDKVKQVIEQLDVLPQVSGVHLNADYNFTDTATKRYRYQAVFDINHY

SEQ ID NO: 10441 - DNA, 234 bp, Streptococcus agalactiae
ttgacaacatctactgcctcttcaacagcatctttagcatcatctgctagttctttacctttagcaattgttttttcgacaaaaccttttgcctctaactctttatcgccagttagcttaccagctccttcttttaggctacctgatgcttgttcaacttttgattttagtttttcttgtgacataatgtgtctccttattatttttattaattataacatctatatctttctt

SEQ ID NO: 10442 - protein, 78 aa, Streptococcus agalactiae
MTTSTASSTASLASSASSLPLAIVFSTKPFASNSLSPVSLPAPSFRLPDACSTFDFSFSCDIMCLLIIFINYNIYIFL

SEQ ID NO: 10443 - DNA, 198 bp, Streptococcus agalactiae
gtgcctattcaggccttatgccaactcttgaaggggtctcgttcaggctattacaagtggctcaatcgtcaaaaaacagattttgagacaaaaaatacaaagctaatggctaaaatcaaggaacttcatagactctacaatggtatcttaggttatcgccgtatgacaacatttattaatcgtcaacttgggacaact

SEQ ID NO: 10444 - protein, 66 aa, Streptococcus agalactiae
MPIQALCQLLKGSRSGYYKWLNRQKTDFETKNTKLMAKIKELHRLYNGILGYRRMTTFINRQLGTT

SEQ ID NO: 10445 - DNA, 207 bp, Streptococcus agalactiae
atgtcccggattggcaaatgtattgataatgcaccaactgaaagtttctttgggtttttcaagactgagtcttaccaccttaagaaatacaactcttatgatgagttggtcaatgatgtggcacgttatatcgaattctacaacacacaacgttatcaatcaaaattaaacaacctgactcctctagaattcaggaatcaggttgca

SEQ ID NO: 10446 - protein, 69 aa, Streptococcus agalactiae
MSRIGKCIDNAPTESFFGFFKTESYHLKKYNSYDELVNDVARYIEFYNTQRYQSKLNNLTPLEFRNQVA

SEQ ID NO: 10447 - DNA, 114 bp, Streptococcus agalactiae
ttggtaaccatttttatgaaattttttaaagttaaaaatataatttataatactatcttcttccattttctgattttagttctgaaagttccaaaaggtgcaaccgtatttaca

SEQ ID NO: 10448 - protein, 38 aa, Streptococcus agalactiae
MVTIFMKFFKVKNIIYNTIFFHFLILVLKVPKGATVFT

SEQ ID NO: 10449 - DNA, 234 bp, Streptococcus agalactiae
ttgttttttccgaatattgacaacataattaaaaactatatcaaagagatgattacacattccgatataccagacttacaaaaacaactggaaacagcatatcaagttccatattctttcgctcttggtatttatatctcaacaattgaaagtattattttaaattggatagatcatgactttactgaagagcctgaagaaatagcaagatatattacatctgtcgtgagaatt

SEQ ID NO: 10450 - protein, 78 aa, Streptococcus agalactiae
MFFPNIDNIIKNYIKEMITHSDIPDLQKQLETAYQVPYSFALGIYISTIESIILNWIDHDFTEEPEEIARYITSVVRI

SEQ ID NO: 10451 - DNA, 390 bp, Streptococcus agalactiae
gtgaactattatttgaatttgtattgtataatcacattcgataagatttataactttaagattttatataaaggtgatagtatattggtaagttcagataacactaatttaaaatttttaaaagctttctcagaattgttaaagatgaggagctttgagcaaattaaagttagcgatttagcaaaaaaagctcgacttagtagaagatctttctataatcattacaattcaaaagaagacttccttagggagtctattttaataatctttgatgatatcacaaaaattttaaataatgatttattatatgaagaagtggtcttaaaggagatgcttagctatatgtatataaataaagaaattattaaatcctttgttttttccgaatat

SEQ ID NO: 10452 - protein, 130 aa, Streptococcus agalactiae
MNYYLNLYCIITFDKIYNFKILYKGDSILVSSDNTNLKFLKAFSELLKMRSFEQIKVSDLAKKARLSRRSFYNHYNSKEDFLRESILIIFDDITKILNNDLLYEEVVLKEMLSYMYINKEIIKSFVFSEY

SEQ ID NO: 10453 - DNA, 327 bp, Streptococcus agalactiae
atgcttaggaagtataagcaaagaaattataatgtcgcacatacgaaacagcgtttttcgattaagaaattcaaatttggtgtagcatcggtattaattggattgacatttctaggaatgagtagtcattctgttttggcggatgagtcaagcattatgagtactgaggtaccacaaacagctggtgtaaaaccggaagttactgttacacagcctacttcagatgtaacaagtcttgcgacagatacgtcaacttcagcagtgttatcaacagatgcatctcattctaatcctacagaatcagcggagcatgctgtaggattagaa

SEQ ID NO: 10454 - protein, 109 aa, Streptococcus agalactiae
MLRKYKQRNYNVAHTKQRFSIKKFKFGVASVLIGLTFLGMSSHSVLADESSIMSTEVPQTAGVKPEVTVTQPTSDVTSLATDTSTSAVLSTDASHSNPTESAEHAVGLE

SEQ ID NO: 10455 - DNA, 318 bp, Streptococcus agalactiae
gtgttacaatctgttttaaaagacacaaaaacgaaaggacaacctatgtcaacatttaaacgctatgatgaagaattcaaacaatctcttgttaacctttatcaaactggaaaaactcagtctgaactctgtaaagactatagggtatccacttctgcgcttgcaaaatggatcaaacagtactctcaattcaaactcgaagataattctgtacttactgccaagcaaatacaagagttacaaaaacgtaatgcgcagcttgaagaggagaaccttatcctaaaaaaagcaagtgccatattcatgcaaaacttaaag

SEQ ID NO: 10456 - protein, 106 aa, Streptococcus agalactiae
MLQSVLKDTKTKGQPMSTFKRYDEEFKQSLVNLYQTGKTQSELCKDYRVSTSALAKWIKQYSQFKLEDNSVLTAKQIQELQKRNAQLEEENLILKKASAIFMQNLK

SEQ ID NO: 10457 - DNA, 186 bp, Streptococcus agalactiae
atgagcggattgctaagagcaattgtcaaaatttctcagtctatgctagaagagttcttcttaatcccaatatgtcatttgtcacgattaacacggattggaaataacatcaatcaaattgcgcgtgctatcaaccaaagccatctaatttctcaggctcagtatcactttcatcgagaagcacgt

SEQ ID NO: 10458 - protein, 62 aa, Streptococcus agalactiae
MSGLLRAIVKISQSMLEEFFLIPICHLSRLTRIGNNINQIARAINQSHLISQAQYHFHREAR

SEQ ID NO: 10459 - DNA, 144 bp, Streptococcus agalactiae
atggggaatggtcattttgtgaccatcatcgactatggcacaggtaatccctatacctcaacaacgcctcttattactgggaaaattggtgaggattttgcttattacttaaccgaatcagagcaacccccctgctgttgggct

SEQ ID NO: 10460 - protein, 48 aa, Streptococcus agalactiae
MGNGHFVTIIDYGTGNPYTSTTPLITGKIGEDFAYYLTESEQPPCCWA

SEQ ID NO: 10461 - DNA, 96 bp, Streptococcus agalactiae
ttgttttcatcattttattttgtagtctttacaaacctaaagaaaaattctagaaatgataatgaaggcggtctatcaaatggttacattcgattt

SEQ ID NO: 10462 - protein, 32 aa, Streptococcus agalactiae
MFSSFYFVVFTNLKKNSRNDNEGGLSNGYIRF

SEQ ID NO: 10463 - DNA, 93 bp, Streptococcus agalactiae
ttgaaaattcatatcgtcgacgaaaaacaattagaagttctagaactattagctatatttgaatttcaaaatggaaagcacttaggatactct

SEQ ID NO: 10464 - protein, 31 aa, Streptococcus agalactiae
MKIHIVDEKQLEVLELLAIFEFQNGKHLGYS

SEQ ID NO: 10465 - DNA, 102 bp, Streptococcus agalactiae
atgatatttgaagagtccaaagatctaatagatagtccagttagagaagcgttgattataagtgataaggattttcaaaaattaaaacaagagctattattt

SEQ ID NO: 10466 - protein, 34 aa, Streptococcus agalactiae
MIFEESKDLIDSPVREALIISDKDFQKLKQELLF

SEQ ID NO: 10467 - DNA, 108 bp, Streptococcus agalactiae
gtgtcactccaatcttttaaactgtttttaggacattttttaaagacagagataaggttatcaatgtccttgaatcgccttattcaaacaccaaacttgagcaaccaa

SEQ ID NO: 10468 - protein, 36 aa, Streptococcus agalactiae
MSLQSFKLFLGHFLKTEIRLSMSLNRLIQTPNLSNQ

SEQ ID NO: 10469 - DNA, 303 bp, Streptococcus agalactiae
atgggacgttctaatattttgagtaggtgtgaacaatgttctgataatcaatgtggcttgtataaaacgcggcttaaagacaagttactattagtagtccaactggttggaaatattaggtattctgagtttcttacggaaggtggtgtatatcataagggagaaaccttgttggaagttataaccttaggaatttcttatgaatataaaagttatggggatatcaaagtaatcaagaagtactgtgctgatggcagtgtcgttgattataacatgccaatactattaatggaaaggattgaa

SEQ ID NO: 10470 - protein, 101 aa, Streptococcus agalactiae
MGRSNILSRCEQCSDNQCGLYKTRLKDKLLLVVQLVGNIRYSEFLTEGGVYHKGETLLEVITLGISYEYKSYGDIKVIKKYCADGSVVDYNMPILLMERIE

SEQ ID NO: 10471 - DNA, 474 bp, Streptococcus agalactiae
atgaccaagctaagtagtgaagaaattataaaaatgttacctcatcgctatccgtttctaatggtggatagagtgcagagttataaaaaaggtatcattgaatgtcgtaagaatattactatcaacgaaccttactttcaaggacattttccacaacgtcctatagttccgggtgttttgatgattgagatggcagctcaatctgcagctttactttatattttagatgcacttgatggtagcctcccctctcttgatgaattaacagcagagaaaatagcagaaaaagtaggttatttagccagtgtgaagaatttcaaattcaagaaaattgttactccaggagaccagctaaacattacatgtaaatctcaatcaaaattggggcatcttttagaaattcaagtcgttattagagatgagaataaaaaagaggttgcctcaggaaggatgttggtatcagaaaatggaaat

SEQ ID NO: 10472 - protein, 158 aa, Streptococcus agalactiae
MTKLSSEEIIKMLPHRYPFLMVDRVQSYKKGIIECRKNITINEPYFQGHFPQRPIVPGVLMIEMAAQSAALLYILDALDGSLPSLDELTAEKIAEKVGYLASVKNFKFKKIVTPGDQLNITCKSQSKLGHLLEIQVVIRDENKKEVASGRMLVSENGN

SEQ ID NO: 10473 - DNA, 339 bp, Streptococcus agalactiae
atgagtgaattcctttcagccaaacctattggtcataatgattcatctaatactattttaagaattatagagaatacgaaatatattcatcactatgatggaaaagttgttgtcgaaattcctcctcaaaaagagcctatcaaagtcttttttatggattcacgtcttcattatttagaattttcagacatatgtcggtatgtaactgttgttttgaaaaatagtaccgttgataatataaccaatttagggccagataatcatattgtttatgacaatggtgatgatatggttgatccgttgccgagtattcagcatggattatttcttaatgatgat

SEQ ID NO: 10474 - protein, 113 aa, Streptococcus agalactiae
MSEFLSAKPIGHNDSSNTILRIIENTKYIHHYDGKVVVEIPPQKEPIKVFFMDSRLHYLEFSDICRYVTVVLKNSTVDNITNLGPDNHIVYDNGDDMVDPLPSIQHGLFLNDD

SEQ ID NO: 10475 - DNA, 135 bp, Streptococcus agalactiae
gtgtttgatgcagcacacgccgtacaaagtagtaggcttaaagcaacagttgatagctttgttatattcttcatgcattctccttattgtctggaaaacatagctttaccaaagtgtcaaacgtttttctggttt

SEQ ID NO: 10476 - protein, 45 aa, Streptococcus agalactiae
MFDAAHAVQSSRLKATVDSFVIFFMHSPYCLENIALPKCQTFFWF

SEQ ID NO: 10477 - DNA, 192 bp, Streptococcus agalactiae
ttgctaacaagttatgcaaaaagtatagatgtcttgaatcaattaattacttctctacaaggcggcatgttagtagtatctattatcctagtgatgatggctctgctattctggattggtggtagaacccatgagacaggtattttattagctattggtaagtctaaagcaattatcattgtcagtacgcag

SEQ ID NO: 10478 - protein, 64 aa, Streptococcus agalactiae
MLTSYAKSIDVLNQLITSLQGGMLVVSIILVMMALLFWIGGRTHETGILLAIGKSKAIIIVSTQ

SEQ ID NO: 10479 - DNA, 96 bp, Streptococcus agalactiae
atgatatcggctccagaaatgattgctacggtagaggtattcttgattagattaacaacttggttggtcattggtggtaaaattgttctgacagct

SEQ ID NO: 10480 - protein, 32 aa, Streptococcus agalactiae
MISAPEMIATVEVFLIRLTTWLVIGGKIVLTA

SEQ ID NO: 10481 - DNA, 456 bp, Streptococcus agalactiae
ttggacttagtcttatcaagccagacggacttgactaattatgttaagaaggtgtctatagaagattttggatgtcagtttttacatactgcacattggaataatcgcttaagaacaactggaggacgcttctttccaaacgatagacaccttgactttaatcccaaaatttatcgtgagtttggtattgatatttttcgtaagattgtaagacatgagctttgccattatcatctctatatacaaggtaaaggatatcaacatagggataaagcttttaaagagttactagaaaaagtcgatggcttacgatatacccctagagttacggctgttaaagtgaattatcatcattactcttgccaatcttgcggtcaagtataccgacgtaggagacgtgttaatttacgcaagtttgcttgtggttattgtcatggtcgcttgatagagagtttt

SEQ ID NO: 10482 - protein, 152 aa, Streptococcus agalactiae
MDLVLSSQTDLTNYVKKVSIEDFGCQFLHTAHWNNRLRTTGGRFFPNDRHLDFNPKIYREFGIDIFRKIVRHELCHYHLYIQGKGYQHRDKAFKELLEKVDGLRYTPRVTAVKVNYHHYSCQSCGQVYRRRRRVNLRKFACGYCHGRLIESF

SEQ ID NO: 10483 - DNA, 168 bp, Streptococcus agalactiae
atgaatgaagagactgcagatgtaactgctagacttgccagcatcgctagtaagaaactccagacaggtgttaaacttagtgctagtaataagaaagagattagcacagtggttatactgaagagagcgatacgagcaaaaaagactagctcacgcaacttagcactg

SEQ ID NO: 10484 - protein, 56 aa, Streptococcus agalactiae
MNEETADVTARLASIASKKLQTGVKLSASNKKEISTVVILKRAIRAKKTSSRNLAL

SEQ ID NO: 10485 - DNA, 273 bp, Streptococcus agalactiae
atgtcatcaccacttaagcaagagcaaactcacgaaagcaaaacagagcaagctcaaccaaaatttcaagtatttcaagaatttgatcacagtgctaagttgcgtgagctagtcttttttgctcgtatcgctctcttcagtataaccactgtgctaatctctttcttattactagcactaagtttaacacctgtctggagtttcttactagcgatgctggcaagtctagcagttacatctgcagtctcttcattcatttggtcactcagacaa

SEQ ID NO: 10486 - protein, 91 aa, Streptococcus agalactiae
MSSPLKQEQTHESKTEQAQPKFQVFQEFDHSAKLRELVFFARIALFSITTVLISFLLLALSLTPVWSFLLAMLASLAVTSAVSSFIWSLRQ

SEQ ID NO: 10487 - DNA, 93 bp, Streptococcus agalactiae
atggactgggcaactgtttccaaggccacttatttttggaaagcccagcctttttcttttaatagtcatgattataattttgggattacttta

SEQ ID NO: 10488 - protein, 31 aa, Streptococcus agalactiae
MDWATVSKATYFWKAQPFSFNSHDYNFGITL

SEQ ID NO: 10489 - DNA, 441 bp, Streptococcus agalactiae
atgataatgagtaatcgaagtattttagacgagcgattatgttttacggttagtgaaacacatcgacttttcaataaattttaccaaaaagctttggatgaatttcaattgacttatctccaatacgttatcttgttagtcctttgggaagaggatcatcggcatatgaaggaacttagttatgcactatctcttaattcgaataccctaactccagttttaaagcgtatggaaaatcgtgggtggattgtacgagaaaaaccaagagatgataaaaggcaactcattattcatctaagtaacaaaggtattgagtcacaagatgccgttgtcaatgcggtgcaatcgtgcgggtattttttctcagaaattagtcctgaatcttatcaaaaaactgtttctgccctttcttcacttaaccaagttataaaatcacattta

SEQ ID NO: 10490 - protein, 147 aa, Streptococcus agalactiae
MIMSNRSILDERLCFTVSETHRLFNKFYQKALDEFQLTYLQYVILLVLWEEDHRHMKELSYALSLNSNTLTPVLKRMENRGWIVREKPRDDKRQLIIHLSNKGIESQDAVVNAVQSCGYFFSEISPESYQKTVSALSSLNQVIKSHL

SEQ ID NO: 10491 - DNA, 114 bp, Streptococcus agalactiae
atgaaagttttgaattcaatggttttctcctttaaaataatcacttataagtatatgaagaatactaagcaaggtcaagtgagtcgtttcactaatctaaatacctttttaaga

SEQ ID NO: 10492 - protein, 38 aa, Streptococcus agalactiae
MKVLNSMVFSFKIITYKYMKNTKQGQVSRFTNLNTFLR

SEQ ID NO: 10493 - DNA, 117 bp, Streptococcus agalactiae
gtggcaactgacataagtgtcaaaaagcctgctgcaagttttgatcttgttttcatgatttataactcctttttgtcattaactccattattatatcataatttcttaaaaatgcct

SEQ ID NO: 10494 - protein, 39 aa, Streptococcus agalactiae
MATDISVKKPAASFDLVFMIYNSFLSLTPLLYHNFLKMP

SEQ ID NO: 10495 - DNA, 243 bp, Streptococcus agalactiae
ttgaacaatcaaattaatcattgtttcaaaagcataatggttttaggagttactcaaatgaaaaaggaatttattattacaggtcggatggttgcaagagttatggaaaccctagtttgcttatgtatggtaagtaatcttgttcttgatatgcttgatataatagaaataaatgaaattgtattttgtgtgttggtagcatcaattgcagggcttgagttttgtttgcaaaaagaaagggag

SEQ ID NO: 10496 - protein, 81 aa, Streptococcus agalactiae
MNNQINHCFKSIMVLGVTQMKKEFIITGRMVARVMETLVCLCMVSNLVLDMLDIIEINEIVFCVLVASIAGLEFCLQKERE

SEQ ID NO: 10497 - DNA, 213 bp, Streptococcus agalactiae
atgggattaattttaaaaaatagactcaaagaattgcgtgcacgagatggtatcaatcaaacagaactcgctaaattaacaggagtctcaagacaaacaattagcctaattgaacgcggagaatatacgccatctgttattattgctatgaagatttctcaagtatttaaagaatccctagagaatgtttttagtttagtgtcaatggaggaa

SEQ ID NO: 10498 - protein, 71 aa, Streptococcus agalactiae
MGLILKNRLKELRARDGINQTELAKLTGVSRQTISLIERGEYTPSVIIAMKISQVFKESLENVFSLVSMEE

SEQ ID NO: 10499 - DNA, 126 bp, Streptococcus agalactiae
ttggggtgcgtaacagctgagattatacccattgaacttgatgcagttagtactgtcgaagggaaatgtgtgccattacaagttttttgtggtggaaaagggcgtagtgtcttcttagtagacagc

SEQ ID NO: 10500 - protein, 42 aa, Streptococcus agalactiae
MGCVTAEIIPIELDAVSTVEGKCVPLQVFCGGKGRSVFLVDS

SEQ ID NO: 10501 - DNA, 123 bp, Streptococcus agalactiae
atgcttcgtaaaggtttctttaaaaacttgggcgaaggtcaatctgatatcatttgtgatgggactctctttatttctagggacgtatttttggggaaaattaccccatcaattcgtcttagc

SEQ ID NO: 10502 - protein, 41 aa, Streptococcus agalactiae
MLRKGFFKNLGEGQSDIICDGTLFISRDVFLGKITPSIRLS

SEQ ID NO: 10503 - DNA, 450 bp, Streptococcus agalactiae
atgaagattgataaatatactgcgattttaggaaatactgttagttacccagatatgcacagtttgacggataatcgtccgcttgcttctctaccttttgatggtaagtatcgtttaattgattttcaattatcctctttagctaatgcaggcgttagaagtatttatggtatttttcgtgggaataatgttcgctctgtttttgaccatattagaagtggtcgtgagtggggcttaggtacactgttgagtcactattctttaggattctatgatacagacgatgatactcgtacagtcaatggggattattacgatcaaattttaacttacttgaggcgttcgggtagcgaccagacgatatatatgagttgtgatatgctttgtaatattgacttaagtcaagtaatccacttgcataatgcaaatggtgcgcaagccaccgtggtt

SEQ ID NO: 10504 - protein, 150 aa, Streptococcus agalactiae
MKIDKYTAILGNTVSYPDMHSLTDNRPLASLPFDGKYRLIDFQLSSLANAGVRSIYGIFRGNNVRSVFDHIRSGREWGLGTLLSHYSLGFYDTDDDTRTVNGDYYDQILTYLRRSGSDQTIYMSCDMLCNIDLSQVIHLHNANGAQATVV

SEQ ID NO: 10505 - DNA, 228 bp, Streptococcus agalactiae
atgatattaaatatagtaactatagttagtaattttatttttattgcccttttttatcaactttttgtagatttatttgactggtctaaaatgattaaaatgtcccctcaaaacatctcaaaattaaaagtttttattttgttgataagtatagttggtggctatgtggttagtcattttttattggaagtgattcagttgtgtcaatcaatcttttgggctctccaa

SEQ ID NO: 10506 - protein, 76 aa, Streptococcus agalactiae
MILNIVTIVSNFIFIALFYQLFVDLFDWSKMIKMSPQNISKLKVFILLISIVGGYVVSHFLLEVIQLCQSIFWALQ

SEQ ID NO: 10507 - DNA, 201 bp, Streptococcus agalactiae; identical to SEQ ID NO: 9015

SEQ ID NO: 10508 - protein, 67 aa, Streptococcus agalactiae
MRRNMASSGWKYVLKQIGLIVLVILLALLFLAVGLMLGYSVFGDGEHAYSILSLDKWQNIIGKFLGK

SEQ ID NO: 10509 - DNA, 168 bp, Streptococcus agalactiae
atgaaaggctataattccaaccttatggttaaagggctaggttgttctacgctttacttaattattagtttgacagcgttggttcttttagtgattgctggtgttttctttgtcattaatacttgcaagcttacaaggaaagcagtggagaacctatccataatcaac

SEQ ID NO: 10510 - protein, 56 aa, Streptococcus agalactiae
MKGYNSNLMVKGLGCSTLYLIISLTALVLLVIAGVFFVINTCKLTRKAVENLSIIN

SEQ ID NO: 10511 - DNA, 117 bp, Streptococcus agalactiae
gtgttgaataagttatggaatagtggcacgtatactaagactaaaaatgctaaaatctccattattataccaaaattaattaatttattaccaaaaatagatagtgctttaatagat

SEQ ID NO: 10512 - protein, 39 aa, Streptococcus agalactiae
MLNKLWNSGTYTKTKNAKISIIIPKLINLLPKIDSALID

SEQ ID NO: 10513 - DNA, 228 bp, Streptococcus agalactiae
atgaaaacacaatatcctatgattccctttcctctcattgtaaaggcaacagatggcgataccgaagcgattaaccagattctacatcattacagagggtacataacgaagcgttccctacgacttatgaaagatgaatatggcaatcaaagtatggtcgttgatgaagtcttacgtggaagaatggaaaccagactgattacaaagattttgtcatttgaaattaag

SEQ ID NO: 10514 - protein, 76 aa, Streptococcus agalactiae
MKTQYPMIPFPLIVKATDGDTEAINQILHHYRGYITKRSLRLMKDEYGNQSMVVDEVLRGRMETRLITKILSFEIK

SEQ ID NO: 10515 - DNA, 429 bp, Streptococcus agalactiae
gtgagaaacatgaaaccatcttcttttcagaccacaatagaaaatcagtttgactatatctgtaaacgtgctatggaagacgagcgaaagaattatatgctttatctttcaaggattgcaaagcgtgaggtgtccttttcggatgttggcgattatcttgttagccagtttgcgacaacagataactattcaactgactttcagatttttacactcaatgggttatcagtaggcgttgaaaatgatttgttgagtgaagcattacgtgagttgccagacaagaaacgtgaaattctactgctgttttactttatggacatgagcgattcagaaattgcagacctgttgaaattgaaccgttctactgtctatcggcatagaaccagtggactagccttaattaaaaagtttatggaggaatttgaagaa

SEQ ID NO: 10516 - protein, 143 aa, Streptococcus agalactiae
MRNMKPSSFQTTIENQFDYICKRAMEDERKNYMLYLSRIAKREVSFSDVGDYLVSQFATTDNYSTDFQIFTLNGLSVGVENDLLSEALRELPDKKREILLLFYFMDMSDSEIADLLKLNRSTVYRHRTSGLALIKKFMEEFEE

SEQ ID NO: 10517 - DNA, 141 bp, Streptococcus agalactiae
atgtttttgtttgtcaataaaaaaattggtatagtctttttgattttctgtgataacgagataaacgctatcaaaaattctatctatcttaaaaaaatatatttcttagccattttattacataaaaagaatggtatcaaa

SEQ ID NO: 10518 - protein, 47 aa, Streptococcus agalactiae
MFLFVNKKIGIVFLIFCDNEINAIKNSIYLKKIYFLAILLHKKNGIK

SEQ ID NO: 10519 - DNA, 123 bp, Streptococcus agalactiae
gtggaatctgagtgtttagctcagatttttaaaaaaattattattttacataacttaatttatgtatttatttttatgggagaattaataaaaaagtgctataatataggtgtattcatagtg

SEQ ID NO: 10520 - protein, 41 aa, Streptococcus agalactiae
MESECLAQIFKKIIILHNLIYVFIFMGELIKKCYNIGVFIV

SEQ ID NO: 10521 - DNA, 93 bp, Streptococcus agalactiae
atgaaaacaaataagacagctaatattggcaaaattgaacgttttctcatgtactatcctctctcttttgctctgttatggacaaatctatta

SEQ ID NO: 10522 - protein, 31 aa, Streptococcus agalactiae
MKTNKTANIGKIERFLMYYPLSFALLWTNLL

SEQ ID NO: 10523 - DNA, 117 bp, Streptococcus agalactiae
ttgattatctggcaggatttttccagagagctcaatttagaacaagtatattatttcaatgaggaagatattgatgaagtaatttttggaggtaccatgacgaagagcaagaaagag

SEQ ID NO: 10524 - protein, 39 aa, Streptococcus agalactiae
MIIWQDFSRELNLEQVYYFNEEDIDEVIFGGTMTKSKKE

SEQ ID NO: 10525 - DNA, 144 bp, Streptococcus agalactiae
atgcatacagaaaatatgaattttataaaacctaaaggatcaccaaaattacttgcatataaccctatgcaagatataaatagtccaatccatggaaaaattttaatatatgaatattctatttcaaactcaattaacggtcca

SEQ ID NO: 10526 - protein, 48 aa, Streptococcus agalactiae
MHTENMNFIKPKGSPKLLAYNPMQDINSPIHGKILIYEYSISNSINGP

SEQ ID NO: 10527 - DNA, 108 bp, Streptococcus agalactiae
gtgattccactggctcctgattgtattgcagttgcacaggtggatgcgacggaggcatcactttgtatttttgccatttggtctcctttcttagtctatggtgagttt

SEQ ID NO: 10528 - protein, 36 aa, Streptococcus agalactiae
MIPLAPDCIAVAQVDATEASLCIFAIWSPFLVYGEF

SEQ ID NO: 10529 - DNA, 165 bp, Streptococcus agalactiae
atgttagttatttgttattatcaatcactccgctacgaatttaatattgaagaggagaaatcctttctaatatcatcaaacggcaagtcgccaataccagtatcagatttagaaaatgacatcacgctaaaaaatatacaaggtcaattggtatatattattgac

SEQ ID NO: 10530 - protein, 55 aa, Streptococcus agalactiae
MLVICYYQSLRYEFNIEEEKSFLISSNGKSPIPVSDLENDITLKNIQGQLVYIID

SEQ ID NO: 10531 - DNA, 240 bp, Streptococcus agalactiae
atgaatacacatattaacattactctagatatgggggaaacctcaaaagatttacgtatccctttgaaaattagcgttaagcaattagtaatggaattagatagtatttttagccgtactgaaaggcgtaccaaatatcaactaagagttataaataaaggtattttattgggagagaacgatatattagctcaccatccagtaacaactggtgatcgtataaggatagaggagttttat

SEQ ID NO: 10532 - protein, 80 aa, Streptococcus agalactiae
MNTHINITLDMGETSKDLRIPLKISVKQLVMELDSIFSRTERRTKYQLRVINKGILLGENDILAHHPVTTGDRIRIEEFY

SEQ ID NO: 10533 - DNA, 321 bp, Streptococcus agalactiae
atgttaaaaacacgaacacatattaatgaattagaaacaaaaatcgcccttgatttagtacacagatatctaggtattcaacaacttgttttttcaaagtggaggcattctttagaaactggttcatggtcttctattataacaataaatggcgttaatattatcaattacattgttgatgatattagtgacagtaatagtatttcaggtattatttgtcatcctaaaagttttcatctcagacctagagaaaaaaaggaacctattcagtctattgatgagttagatatcacctggtctttgaatagagaggaaaatgaa

SEQ ID NO: 10534 - protein, 107 aa, Streptococcus agalactiae
MLKTRTHINELETKIALDLVHRYLGIQQLVFSKWRHSLETGSWSSIITINGVNIINYIVDDISDSNSISGIICHPKSFHLRPREKKEPIQSIDELDITWSLNREENE

SEQ ID NO: 10535 - DNA, 336 bp, Streptococcus agalactiae
atgcaaatcatcaaacgtgatggacagattgttgaatttgatcctgaaaaaatctaccaagctatcttgaaagctgctcaaacagtttatgtgcttgatgagtcacttcgtcaagaccttgctcaagtgactaaaaaagtaatcttagatttagaggatgctcaggttgaacgaccaacgatcaatatgattcagtctttggttgaaaatcgtttattggatgcaggatacattcatactgctgaacactatatttcataccgtttgcaacgtgatttagagcgaaatggctatgatgatcaaatcactgttcatttacactttgaaaaaattaag

SEQ ID NO: 10536 - protein, 112 aa, Streptococcus agalactiae
MQIIKRDGQIVEFDPEKIYQAILKAAQTVYVLDESLRQDLAQVTKKVILDLEDAQVERPTINMIQSLVENRLLDAGYIHTAEHYISYRLQRDLERNGYDDQITVHLHFEKIK

SEQ ID NO: 10537 - DNA, 141 bp, Streptococcus agalactiae
atgttaactaataattctagaacaatttcagtgataaataaattacctaaaacaggtgatgatcaaaatgtcatttttaaacttgtaggttttggtttaattttgttaacaagtcgctgcggtttgagacgcaatgaaaat

SEQ ID NO: 10538 - protein, 47 aa, Streptococcus agalactiae
MLTNNSRTISVINKLPKTGDDQNVIFKLVGFGLILLTSRCGLRRNEN

SEQ ID NO: 10539 - DNA, 90 bp, Streptococcus agalactiae
atgcaaaaaagaaagaaccaaactggttctttcttttttgcttttcagctacttaccacaatttgtaagaaattacaagtagtagtaagc

SEQ ID NO: 10540 - protein, 30 aa, Streptococcus agalactiae
MQKRKNQTGSFFFAFQLLTTICKKLQVVVS

SEQ ID NO: 10541 - DNA, 195 bp, Streptococcus agalactiae
atgaaaaaaaggcttcaactattattactgatatttatttctgcagtttcatggtttatcagtaaccaactagcaactaagaatacggtattatctgttttaataggtttagttgcagttattgggataacgtggttaattgtaagtctgctctattatttgatcgtgaagttaattgcagttatatttcatgat

SEQ ID NO: 10542 - protein, 65 aa, Streptococcus agalactiae
MKKRLQLLLLIFISAVSWFISNQLATKNTVLSVLIGLVAVIGITWLIVSLLYYLIVKLIAVIFHD

SEQ ID NO: 10543 - DNA, 345 bp, Streptococcus agalactiae
atggcatttgaaaaagaaataaatcttccagactgcaattacatttacactatcagcccgaacattaaaaaatataccttacgcgatactacattcactcaaaatcgcttaggtaattatgaattagagcgtctcctagaaacagtgcctaattctggcgatggctttcctctaaagattacaatcaataaagaactttctggttttaagctcttaattactgataaatctggccttagaatagtaaatatctttaaatctaccgatcataaaattcttcaagacaaattttatttcttaatggacagcctcgttgagcgtgatatctttacgaaaaccacaaaa

SEQ ID NO: 10544 - protein, 115 aa, Streptococcus agalactiae
MAFEKEINLPDCNYIYTISPNIKKYTLRDTTFTQNRLGNYELERLLETVPNSGDGFPLKITINKELSGFKLLITDKSGLRIVNIFKSTDHKILQDKFYFLMDSLVERDIFTKTTK

SEQ ID NO: 10545 - DNA, 339 bp, Streptococcus agalactiae
atgtctaggaaaacatttaaacgtatactatcgattggagtttgcacgctcgtactatcgatgagtctttattacactgaaaaagcccacgctattgctggtcctagtgaccgccaatacgtagaaaacccaaatcctcacattattgtaaatgttacaggtactgatcaaaacggaaatagcattttaccgcattatatcgaagtcaatgtaaagatgggacaaactttaagtaaaaaagaaattctagattatattgctcgaaatttaaactctagtgtggaggagaaagtaaaaacgttcaatacagcaacatcgagtttaaggaaagtgcttatc

SEQ ID NO: 10546 - protein, 113 aa, Streptococcus agalactiae
MSRKTFKRILSIGVCTLVLSMSLYYTEKAHAIAGPSDRQYVENPNPHIIVNVTGTDQNGNSILPHYIEVNVKMGQTLSKKEILDYIARNLNSSVEEKVKTFNTATSSLRKVLI

SEQ ID NO: 10547 - DNA, 237 bp, Streptococcus agalactiae
atgacactcttcttagattctttactaaaggagctaataatcgtgaatcgtcttagagaatacagaattaaagctagcatatctcaattagctttagcaaaatcagttggtgtcgccagacaaacaataaaccttattgaaaataataaatacaatccttcgctagatctttgtataagactagcggaatgcctacaaacagacctcaatactcttttttgggatagtagacatcta

SEQ ID NO: 10548 - protein, 79 aa, Streptococcus agalactiae
MTLFLDSLLKELIIVNRLREYRIKASISQLALAKSVGVARQTINLIENNKYNPSLDLCIRLAECLQTDLNTLFWDSRHL

SEQ ID NO: 10549 - DNA, 390 bp, Streptococcus agalactiae
atgaaattatacgttcaattaatggttattttaaccttttcattcgctggtgaggttctatctactatattcaacttacctgtaccaggcagtattattggattaatattactattcctagcgttaaaatacaaaatcatcaggctcaggcatattgatgccgtggggaattttctattagcaaatatgaccattttatttttaccaccagcagttggactgatggagcactttcaagacataaagccctatctttttgggatagctatcattatcttaggagcgctatttctcaatattctaactattggactggtatcccaatggatcaaaaagagatatgaaggagattatccagaaattggaggtaaaaatggcaactttaacgaa

SEQ ID NO: 10550 - protein, 130 aa, Streptococcus agalactiae
MKLYVQLMVILTFSFAGEVLSTIFNLPVPGSIIGLILLFLALKYKIIRLRHIDAVGNFLLANMTILFLPPAVGLMEHFQDIKPYLFGIAIIILGALFLNILTIGLVSQWIKKRYEGDYPEIGGKNGNFNE

SEQ ID NO: 10551 - DNA, 243 bp, Streptococcus agalactiae
ttgctgacagcttctatattggttattttagaatcttttggtacaactacactcatctcaatttcagagtatgaagcagttttatttagattatttgtcaaatcaatggttgacttaaatccatataaagtagtagcaacgaaaatagaagctaatactaaaattatagttgtaaaaattctagctttattcttaatacaaagaaataaacttactaaaatgattaaaacaattacaactcca

SEQ ID NO: 10552 - protein, 81 aa, Streptococcus agalactiae
MLTASILVILESFGTTTLISISEYEAVLFRLFVKSMVDLNPYKVVATKIEANTKIIVVKILALFLIQRNKLTKMIKTITTP

SEQ ID NO: 10553 - DNA, 405 bp, Streptococcus agalactiae
atggaaaaaattaggatttaccataacccaaattgtgggacatcaaggaacgtacttgccattattcgtcattgtggtattgaaccagaaattatttattatctgaaaacaccacctagcaggatggaactggttgaactgttgttagaaatgaaactttctgcgagggaacttctaagaacagatgttcctgcttatgagaaattcaatttggaatcttctagcgttacagatgaagaaatgattgatgcgatgatacaagatcctattcttatcaatcgtcccatagttgttacgagtaaaggtgcaaaactctgccgaccctgtgaagcaattttaaccattttacctgtaaagatggaaaaagattttgttaaagaagatggacagattatccaaagttta

SEQ ID NO: 10554 - protein, 135 aa, Streptococcus agalactiae
MEKIRIYHNPNCGTSRNVLAIIRHCGIEPEIIYYLKTPPSRMELVELLLEMKLSARELLRTDVPAYEKFNLESSSVTDEEMIDAMIQDPILINRPIVVTSKGAKLCRPCEAILTILPVKMEKDFVKEDGQIIQSL

SEQ ID NO: 10555 - DNA, 126 bp, Streptococcus agalactiae
gtgctaggagtggctgttgcagttgcggttgaagctgtggagttagacaaatcttgttgtgtggttgtggtgctagtctctttgacagtggtactttcagtctggggagcttcaacattattagtt

SEQ ID NO: 10556 - protein, 42 aa, Streptococcus agalactiae
MLGVAVAVAVEAVELDKSCCVVVVLVSLTVVLSVWGASTLLV

SEQ ID NO: 10557 - DNA, 129 bp, Streptococcus agalactiae
ttgcctagcttttttatcaaaaatttcctcatatcaaatgattttcatcaatttgatagtcctttagcagaccttgaagtctatcaaattcataacaaaaatgttcaggaatatgaccgtcagagccta

SEQ ID NO: 10558 - protein, 43 aa, Streptococcus agalactiae
MPSFFIKNFLISNDFHQFDSPLADLEVYQIHNKNVQEYDRQSL

SEQ ID NO: 10559 - DNA, 414 bp, Streptococcus agalactiae
atggtaatgaaagcaattgaaatttatatgaatattaatggtcgtggggccgaagctattacattttatgaagaggcttttaatacaaaagcagaacacgtcacaacttttgcacagggttggccagattgtccgccagaacttgaacatttaattatgaacgctcaatttaatattgatggtattcgaatgcaactttctgacaataatcctatttttgattttcaaattggacaaaatatgacagcagctttaattgtggaatctgtagaagaagcgcaagagttattcaataagctttctcgagatgcaatgaacattaaaatgcctctacaagcagttccgtggagtccagcttatggaaatgtgactgacaaatatggtatgacatggcaaatcaatactgagcttagc

SEQ ID NO: 10560 - protein, 138 aa, Streptococcus agalactiae
MVMKAIEIYMNINGRGAEAITFYEEAFNTKAEHVTTFAQGWPDCPPELEHLIMNAQFNIDGIRMQLSDNNPIFDFQIGQNMTAALIVESVEEAQELFNKLSRDAMNIKMPLQAVPWSPAYGNVTDKYGMTWQINTELS

SEQ ID NO: 10561 - DNA, 495 bp, Streptococcus agalactiae
atgattatcgactttaaaaccgtttcaactaaaggtttggagacttctccagtggcagaagccttggctggtttgcgtgcaaatgaagctcgctatttctggaataaattcaaagtagcctacgaaacatttccagtatcagactatccagaattgatggcagatattaatcaccttctaaaaaatgaacgtaaccttgtttttgctgcaaagcctttagagatttcacagctttttttagagaatcgtattttatggacacatgttttctatgaggatggtttagccattaatattttatatgaattagataatcctaaaaagagagctgtaggtttaaaattatcagatggaatggatattcctattgaattagcggacaagtttaagtttgctcgtcaaaagtcaaaactcgcaggtataatacgtggttcttattttaccctaaaaggggaaaatgaaactctgatgcagcgttggttggataatatgaag

SEQ ID NO: 10562 - protein, 165 aa, Streptococcus agalactiae
MIIDFKTVSTKGLETSPVAEALAGLRANEARYFWNKFKVAYETFPVSDYPELMADINHLLKNERNLVFAAKPLEISQLFLENRILWTHVFYEDGLAINILYELDNPKKRAVGLKLSDGMDIPIELADKFKFARQKSKLAGIIRGSYFTLKGENETLMQRWLDNMK

SEQ ID NO: 10563 - DNA, 378 bp, Streptococcus agalactiae
atggagaatcactttatttatggctatcgtaccattacacgattgctcaaaaaaatccacggattgactgttaatacaaagaaagtctatcgtatcatgaaaaataatggctggctttgtcggacacgtaccaagaaagttcccaatttgggtaaagcttattatttaacagataataaattgagtcgggatttccatgccgataagcctaaggaaaagctcgtaacagatattacctacctatatttcggtaactgtaaattgtatctctcatcaattatggatctctataaccgagaaattatagcttacactatctcagattgtcaggacacggattttgtactagacacccttaatcagttaaaattgcctaaa

SEQ ID NO: 10564 - protein, 126 aa, Streptococcus agalactiae
MENHFIYGYRTITRLLKKIHGLTVNTKKVYRIMKNNGWLCRTRTKKVPNLGKAYYLTDNKLSRDFHADKPKEKLVTDITYLYFGNCKLYLSSIMDLYNREIIAYTISDCQDTDFVLDTLNQLKLPK

SEQ ID NO: 10565 - DNA, 99 bp, Streptococcus agalactiae
ttgtgctacctcatcaaaaagaagttaggacaaatagctgtcaacaattgccttttgcttatcccttcagttgatgtgataaaagatggtagttgtcat

SEQ ID NO: 10566 - protein, 33 aa, Streptococcus agalactiae
MCYLIKKKLGQIAVNNCLLLIPSVDVIKDGSCH

SEQ ID NO: 10567 - DNA, 123 bp, Streptococcus agalactiae
ttgataaatgagatacatttaatcattatggcaaaagcaagaaaaatagctgtgtcatatgcaaataacccctgtttgctctttaaaaaagacgttatccttatttctctacacacagacgga

SEQ ID NO: 10568 - protein, 41 aa, Streptococcus agalactiae
MINEIHLIIMAKARKIAVSYANNPCLLFKKDVILISLHTDG

SEQ ID NO: 10569 - DNA, 318 bp, Streptococcus agalactiae
gtgttacaatctgttttaaaagacacaaaaacgaaaggacaacctatgtcaacatttaaacgctatgatgaagaattcaaacaatctcttgttaacctttatcaaactggaaaaactcagtctgaactctgtaaagactatggggtatccacttctacgcttgcaaaatggatcaaacagtattcccaagtcaaactcgaagataattctgtacttactgccaagcaaatacaagagttacaaaaacgtaatgcgcagcttgaagaggagaaccttatcctaaaaaaagcaagtgccatattcatgcaaaacttaaag

SEQ ID NO: 10570 - protein, 106 aa, Streptococcus agalactiae
MLQSVLKDTKTKGQPMSTFKRYDEEFKQSLVNLYQTGKTQSELCKDYGVSTSTLAKWIKQYSQVKLEDNSVLTAKQIQELQKRNAQLEEENLILKKASAIFMQNLK

SEQ ID NO: 10571 - DNA, 114 bp, Streptococcus agalactiae
ttgaaaaaatccatatatcctgactttaaatccgaagctctatcaaatccgaagctctatcaaatccatttcctaaaattattaattggtttaccatttcttaagtctcctaaa

SEQ ID NO: 10572 - protein, 38 aa, Streptococcus agalactiae
MKKSIYPDFKSEALSNPKLYQIHFLKLLIGLPFLKSPK

SEQ ID NO: 10573 - DNA, 363 bp, Streptococcus agalactiae
atggaaaatcgttatcgaaccaatttgaaaaaggtgtatttgagtgatcaagaattaattatcctcaataaaaatcttgctcagagtcagtgtccaaacttttcgcattatgccagaaaaaccttactcaatcctcgtatgaattttatcacaatcgatacaagaggttttcaagacctgatttttgaaattcgtaggattggaaataatataaaccagattgcacgttcggtaaatcaaagccacctacttagtcttcaacaagtcaaagaattgcagctcggtatagcagagttagaaacacagttacaacaagattttgacataaagtgtcagcgattgagagaattttatggtcatcac

SEQ ID NO: 10574 - protein, 121 aa, Streptococcus agalactiae
MENRYRTNLKKVYLSDQELIILNKNLAQSQCPNFSHYARKTLLNPRMNFITIDTRGFQDLIFEIRRIGNNINQIARSVNQSHLLSLQQVKELQLGIAELETQLQQDFDIKCQRLREFYGHH

SEQ ID NO: 10575 - DNA, 123 bp, Streptococcus agalactiae
ttgccagaacaagtatttcatgtacatcccggtaaatctgttctactttttggtgctgtaaatattttatccattcttcaagctgctgagatggttggtggtctattttcaataatttacctc

SEQ ID NO: 10576 - protein, 41 aa, Streptococcus agalactiae
MPEQVFHVHPGKSVLLFGAVNILSILQAAEMVGGLFSIIYL

SEQ ID NO: 10577 - DNA, 117 bp, Streptococcus agalactiae
ttgggggcggagccatcaagttatcttatcgttggctgtcaaaactggaaggttttggtcagctggcgatatgatttttgggatattgtggacacaatatctgagctcgcaaagacc

SEQ ID NO: 10578 - protein, 39 aa, Streptococcus agalactiae
MGAEPSSYLIVGCQNWKVLVSWRYDFWDIVDTISELAKT

SEQ ID NO: 10579 - DNA, 339 bp, Streptococcus agalactiae
atgcttgagaaggtcttccctgaggaaacttacccaaataccattctccatagtgaccaaggttggcaataccaacatgaagtctatcaccgctttcttgcaagtaaaggcatacatccttccatgtctcgcaaagggaccagcacggataatggtatgatggaatccttctttggtgtcttgaagaaagagatgttttatggctttgagaagactttcaagtctctggatcaactggagcaagctatcaccgagtatattttttactacaacaataaatgcattaaagaaaaactaaaaggacttagtcctgttcagtatagaattaaatcctttcaa

SEQ ID NO: 10580 - protein, 113 aa, Streptococcus agalactiae
MLEKVFPEETYPNTILHSDQGWQYQHEVYHRFLASKGIHPSMSRKGTSTDNGMMESFFGVLKKEMFYGFEKTFKSLDQLEQAITEYIFYYNNKCIKEKLKGLSPVQYRIKSFQ

SEQ ID NO: 10581 - DNA, 231 bp, Streptococcus agalactiae
ttgcaagttcaaatactccatgagattaataactttattattttagccaactttactaatcgtataaacattctccaaatttctcaacatcaattgagaaatttggctttttccgttgctcagttaaagcgtcctttagttgtatatttcctgttaatatcccttttgaagcataacattgttttcaatgatcgcatccgattgttgacacccattttagaacctattctt

SEQ ID NO: 10582 - protein, 77 aa, Streptococcus agalactiae
MQVQILHEINNFIILANFTNRINILQISQHQLRNLAFSVAQLKRPLVVYFLLISLLKHNIVFNDRIRLLTPILEPIL

SEQ ID NO: 10583 - DNA, 366 bp, Streptococcus agalactiae
atgattaaaaaaaatacttgtgaaatttattgttatgacgaagaaaaggtcaatcgaatacaaggtaatttacagacagtagatatttctagtgttgcccaaatgttaaaagctattgcagataaaaatagagcaaaaattacctatgcattgtgtcaagatgacgaactgtgtgtgtgtgatattgcaaatattataggtgttacggttgcaaatacctctcatcacctgcgaacgctccataagcaagggattgttaagtttcgaaaagagggaaaacttgcattttattccttagatgatgagcatatcagacaaattatgatgattgcattggcacataagaaagaggtgaagatcaatgtc

SEQ ID NO: 10584 - protein, 122 aa, Streptococcus agalactiae
MIKKNTCEIYCYDEEKVNRIQGNLQTVDISSVAQMLKAIADKNRAKITYALCQDDELCVCDIANIIGVTVANTSHHLRTLHKQGIVKFRKEGKLAFYSLDDEHIRQIMMIALAHKKEVKINV

SEQ ID NO: 10585 - DNA, 297 bp, Streptococcus agalactiae
atgaatcagcttgagtttcagcgtaatcacctgcaaatggactattacagcgagagctaccaagattttgaacgtgacttctaccgctactccaacatgaatattccattgatcttcctgaccgatgatatcctcaaaacaatggcgacttcacgtaagaattactttgtcctgaataaggaaaagtccaaagataaccgcgatcacttcttcatatttgaagtaagaaccttagaagagaatccactaatctatcattatacatataagaaaacaactacatacttaacacaaaaa

SEQ ID NO: 10586 - protein, 99 aa, Streptococcus agalactiae
MNQLEFQRNHLQMDYYSESYQDFERDFYRYSNMNIPLIFLTDDILKTMATSRKNYFVLNKEKSKDNRDHFFIFEVRTLEENPLIYHYTYKKTTTYLTQK

SEQ ID NO: 10587 - DNA, 111 bp, Streptococcus agalactiae
ttgattaaaaaggttatggttcataagaaaaacagggctctccatcgaaagcatgggagccctgtttttatcgaaaatttatcgatctatgattttccttatacagcatac

SEQ ID NO: 10588 - protein, 37 aa, Streptococcus agalactiae
MIKKVMVHKKNRALHRKHGSPVFIENLSIYDFPYTAY

SEQ ID NO: 10589 - DNA, 456 bp, Streptococcus agalactiae; identical to SEQ ID NO: 9041

SEQ ID NO: 10590 - protein, 152 aa, Streptococcus agalactiae
MNHLLNLSKENIAKIDFDFLNEALNANIRLKELVDELKISKELDSKGWSKKDSRTIKILYDGLINKHIVSLDRADYNIIQVIPFANVHVLLFLIPERENSKNYRIYNYSDYEMELINEDRQQFSKYETVDLDQLILVDIFNIDDYISSYLTI

SEQ ID NO: 10591 - DNA, 324 bp, Streptococcus agalactiae
ttgataaactatgctgataataaaagcgatagacatattttacaaacctgtttagaatttgctcaaaaaattgtagaatcagataaatctgaatatagtattctcattttactacaaataaaaaaacgattaaacatattaacacaaatggatagcaactatcttcattctctaatgaatcaaagttcggtagaaattaggtttgctgcagcctgtattctaggtaacaaagaacaagccagatattttttcgataaagaattcgctgatgaacaaaaagaacgatttctggaatatccgatttattacctccttagcctagac

SEQ ID NO: 10592 - protein, 108 aa, Streptococcus agalactiae
MINYADNKSDRHILQTCLEFAQKIVESDKSEYSILILLQIKKRLNILTQMDSNYLHSLMNQSSVEIRFAAACILGNKEQARYFFDKEFADEQKERFLEYPIYYLLSLD

SEQ ID NO: 10593 - DNA, 306 bp, Streptococcus agalactiae
atgaatcagcttgagtttaataaaaatctattacaaatggattattttagtgatagctaccgaaaatttgaagaggatttctatcgctactcagccctagatactccacttacttttttaacagatgatattatgcttgccatggcaaaatctcaaaagccttattttaagctaaataaggaaaattcgaaagaccatcgtgaccattattttatgttcaatgtggaaccttcacgagataataatctagttaggctatattgttacgattcaacgaagacacatatttcaaaaaacaggccaaaa

SEQ ID NO: 10594 - protein, 102 aa, Streptococcus agalactiae
MNQLEFNKNLLQMDYFSDSYRKFEEDFYRYSALDTPLTFLTDDIMLAMAKSQKPYFKLNKENSKDHRDHYFMFNVEPSRDNNLVRLYCYDSTKTHISKNRPK

SEQ ID NO: 10595 - DNA, 288 bp, Streptococcus agalactiae
atgttggagcaaattctacaaagtcttttgattttcgcagcaataggactgatgttgtttgtcctttatcggattgtgaaagtttcaggtgctttgtttcttatcggactcatcagtggattagtctttattgaaatctatggaatttacctcttctttactgagagatacctctattcagaagatttagcaactaatggagtttggagttttacaggattttttattgctttgaatctatttcttgtttttagcattattatgaagtggtggagaaatagaatagtt

SEQ ID NO: 10596 - protein, 96 aa, Streptococcus agalactiae
MLEQILQSLLIFAAIGLMLFVLYRIVKVSGALFLIGLISGLVFIEIYGIYLFFTERYLYSEDLATNGVWSFTGFFIALNLFLVFSIIMKWWRNRIV

SEQ ID NO: 10597 - DNA, 351 bp, Streptococcus agalactiae
atgaacacacgtgtctttaaggacatctcaaaggttcaacacagggcatggctgggatttacaactagacaggttatttttgtatttccagctgtcgccctaaccattttggttttgggcttgaacctattttattggcaatttggggattggtttgtctatggttttgtttttagctttaccattccactcatgttatttggggtctatcgccccaacgatttaccatttgaaatatacctcaagtaccgttttcattatgaactaacggtgccagaccgcacatttactggaagaaaaggagaccaacgtgaaaaaattaaaacactcaatgaaatcaaagacctcttc

SEQ ID NO: 10598 - protein, 117 aa, Streptococcus agalactiae
MNTRVFKDISKVQHRAWLGFTTRQVIFVFPAVALTILVLGLNLFYWQFGDWFVYGFVFSFTIPLMLFGVYRPNDLPFEIYLKYRFHYELTVPDRTFTGRKGDQREKIKTLNEIKDLF

SEQ ID NO: 10599 - DNA, 120 bp, Streptococcus agalactiae
atggaacagttttatgacgggcaatctctaagcaagtcacacttaataggaccaattgtagcaagactataccctctattgtcagatactctttcaggaataaactcaccagaagaccgt

SEQ ID NO: 10600 - protein, 40 aa, Streptococcus agalactiae
MEQFYDGQSLSKSHLIGPIVARLYPLLSDTLSGINSPEDR

SEQ ID NO: 10601 - DNA, 156 bp, Streptococcus agalactiae
gtgattctgacagacaatgagaggcagacgaaggttttggtctggcttttggagaatgagctgaatcatctcattcaaacttatcgaatattgacttttaaagcgaagaaatcgtggcgacagcaactcaaaacaatccgtggttttggcaaagag

SEQ ID NO: 10602 - protein, 52 aa, Streptococcus agalactiae
MILTDNERQTKVLVWLLENELNHLIQTYRILTFKAKKSWRQQLKTIRGFGKE

SEQ ID NO: 10603 - DNA, 381 bp, Streptococcus agalactiae
atgcttgaggtatatctaggaaataataccaatacaaatcaagatttactaaccattttgacgacctatggagtggcttatcgttgtacaaaagcatgtgaggtaaaccgtgaaatcatactgtcactctttgccaaaaccacggattgttttgagttgctgtcgccacgatttcttcgctttaaaagtcaatattcgataagtttgaatgagatgattcagctcattctccaaaagccagaccaaaaccttcgtctgcctctcattgtctgtcagaatcacgtctatccagctattgggctagacgaagtacgtacttttcttcccagacaggtaaaagaagagttgtttcaggccagtctgatgaaacaagtgacaggg

SEQ ID NO: 10604 - protein, 127 aa, Streptococcus agalactiae
MLEVYLGNNTNTNQDLLTILTTYGVAYRCTKACEVNREIILSLFAKTTDCFELLSPRFLRFKSQYSISLNEMIQLILQKPDQNLRLPLIVCQNHVYPAIGLDEVRTFLPRQVKEELFQASLMKQVTG

SEQ ID NO: 10605 - DNA, 96 bp, Streptococcus agalactiae
ttgaagaaggttagggtaagtttgatttcctttttcaatccactagaaaacccgcttggattcttccaaacgggttttgtttttatctttcagaaa

SEQ ID NO: 10606 - protein, 32 aa, Streptococcus agalactiae
MKKVRVSLISFFNPLENPLGFFQTGFVFIFQK

SEQ ID NO: 10607 - DNA, 648 bp, Streptococcus agalactiae
atgtcatattttagaaattactggtatcgttttggagcaattttatttattattttagcagtaatattgcttgtttttagacctgactggtcaatgcttcactatctattgtatttttactttatggcacttctagcgcatcaatttgaagaatatcagtttcccggtggggcatcacctatcattaactatgttgtttatgatgaagaagagctgatggattgttttccaggcaatactcagtctattatgttggttaatactattgcttggttgctttacattgctagtattgcttttcctcaagcttattggcttggattaggagtcatgttctttagtctaacgcagctcttgggtcatggttttcagatgaatattaaacttaaaacttggtataatcctggtctagcaacgacagtatttctcctagtaccaatagcttgcgtatacatctatcaagctagtgcagaaggaatgctcacttggggagattggctaggtggttttatcatgttgattgtctgtgtactaactagcattattgcacctgtacagctattgaaggataaggagaccaattatattattagtccttggcaaatggaccgttttcataaggtcgttaattttgtaaggataaaaaaa

SEQ ID NO: 10608 - protein, 216 aa, Streptococcus agalactiae
MSYFRNYWYRFGAILFIILAVILLVFRPDWSMLHYLLYFYFMALLAHQFEEYQFPGGASPIINYVVYDEEELMDCFPGNTQSIMLVNTIAWLLYIASIAFPQAYWLGLGVMFFSLTQLLGHGFQMNIKLKTWYNPGLATTVFLLVPIACVYIYQASAEGMLTWGDWLGGFIMLIVCVLTSIIAPVQLLKDKETNYIISPWQMDRFHKVVNFVRIKK

SEQ ID NO: 10609 - DNA, 501 bp, Streptococcus agalactiae
atgaaagcattgataacaaaatggtacctcttttgtccctatcttgcttctctttttgccttagcattattttttggaaattgggatttacgagtgcagtcactacttatttcgggactttttattcaattacactttttcgaagaatttggtttccctggaggttttccgcttatcactatgctagttgaacttaaatcggttgaaactgatactagtaagtgggacttaaaccatctatcagcctttttcgggaatcagtggtttgcagtgattgtttatcttttgccgattttttgtcccaatataccatttttaacacttgcagtcatgatttttgcatttgcagaacttgccatgcatcttttcttttttaatctttccttgaagaagtggtataatccaggacttcttacgaccttagtaggtcttgtccctgtttctgtctattatttagctcatgattggaagttgtattctggacttgattggtttttaggc

SEQ ID NO: 10610 - protein, 167 aa, Streptococcus agalactiae
MKALITKWYLFCPYLASLFALALFFGNWDLRVQSLLISGLFIQLHFFEEFGFPGGFPLITMLVELKSVETDTSKWDLNHLSAFFGNQWFAVIVYLLPIFCPNIPFLTLAVMIFAFAELAMHLFFFNLSLKKWYNPGLLTTLVGLVPVSVYYLAHDWKLYSGLDWFLG

SEQ ID NO: 10611 - DNA, 90 bp, Streptococcus agalactiae
gtgcataaaacctccaaaggtattgatattataggttcacttgattatactatatggtatcaaatgtcacaaatcttggaggtcatctta

SEQ ID NO: 10612 - protein, 30 aa, Streptococcus agalactiae
MHKTSKGIDIIGSLDYTIWYQMSQILEVIL

SEQ ID NO: 10613 - DNA, 168 bp, Streptococcus agalactiae
atgcaacgtagcctttttggggtctttaccgcatttttagctgtgatttgtgttttatgtgcaattcctgctataaagaaaaaaagatatggattaggaacagtttttttgatgaatgctttcactaaccttgtcaacacaatccatgccttttatggaacattattt

SEQ ID NO: 10614 - protein, 56 aa, Streptococcus agalactiae
MQRSLFGVFTAFLAVICVLCAIPAIKKKRYGLGTVFLMNAFTNLVNTIHAFYGTLF

SEQ ID NO: 10615 - DNA, 216 bp, Streptococcus agalactiae
atgattaaactgtattataaagatgcttacgacactgaacgatgccaagtttttgaaaatccaaatgattttattcgagttttaatgggatgtgttactgttcctgacaattatcctattacgaaaatgacttataaagataaagatattgcttacagtggtacttatggagatctcttcaagacttttattgaatttgattggtccactttggac

SEQ ID NO: 10616 - protein, 72 aa, Streptococcus agalactiae
MIKLYYKDAYDTERCQVFENPNDFIRVLMGCVTVPDNYPITKMTYKDKDIAYSGTYGDLFKTFIEFDWSTLD

SEQ ID NO: 10617 - DNA, 129 bp, Streptococcus agalactiae
gtgctagttgcactcctattagtggaagtaggagttgaattgttagaagtgaccaagtttgcatctgtggccgttacacctgttggagttgttgcagatgtaacactagttgtctcatctgcaagtacc

SEQ ID NO: 10618 - protein, 43 aa, Streptococcus agalactiae
MLVALLLVEVGVELLEVTKFASVAVTPVGVVADVTLVVSSAST

SEQ ID NO: 10619 - DNA, 492 bp, Streptococcus agalactiae
atgattaaatggaatgaaaaagaaacaaaactagttgatacaagtttttcaattatgttgtatctaaaaacgctatttgcagtcggacaagtagtagctggcgttttattatattattttaaacctacacaaataaaacatctcctatttcttttaactgaaggtgaagttcacggtgggattcatggttttatttctgctcatttcttgaaaataagcagttatattaatgattcggctagtcatttagccgctatctatctattaattcatggcggtatcaaattagtagcacttattttattacataaagagaaattatttgcttaccctttatcaattttagttttcgttgggtttatcattttccaactaagggaatatttttctagtcatagcattttaatgatttttctatgtgtatttgatgttatcatgataattttaacatggttagaatatcagaaaatgaaattgaatttttcaaaaagg

SEQ ID NO: 10620 - protein, 164 aa, Streptococcus agalactiae
MIKWNEKETKLVDTSFSIMLYLKTLFAVGQVVAGVLLYYFKPTQIKHLLFLLTEGEVHGGIHGFISAHFLKISSYINDSASHLAAIYLLIHGGIKLVALILLHKEKLFAYPLSILVFVGFIIFQLREYFSSHSILMIFLCVFDVIMIILTWLEYQKMKLNFSKR

SEQ ID NO: 10621 - DNA, 99 bp, Streptococcus agalactiae
ttgattccaaaagacattgctttcttaaccaaagctcgtcctgtcttagagaatgaagatagtaacgtttcagaagtgacaccttctaaatttttaaca

SEQ ID NO: 10622 - protein, 33 aa, Streptococcus agalactiae
MIPKDIAFLTKARPVLENEDSNVSEVTPSKFLT

SEQ ID NO: 10623 - DNA, 171 bp, Streptococcus agalactiae
ttgaataatgactctgccacgctaaaaactcttgaaatagctcatgatttttatctaagcaaagggggtaaatcaaactatcttcatgtgtatttatataccccacaagcgtctcaagattttcaaattgtgcatcataatggtgaatcacatggtttagctccttcgaga

SEQ ID NO: 10624 - protein, 57 aa, Streptococcus agalactiae
MNNDSATLKTLEIAHDFYLSKGGKSNYLHVYLYTPQASQDFQIVHHNGESHGLAPSR

SEQ ID NO: 10625 - DNA, 180 bp, Streptococcus agalactiae
ttggcagcagaatttgaactgctactcggagtactactagcagaggaattttctagtgtttggctggatgatgcccttgtctcatctttttcagtagaaacttggttactagaattttgtccactttctcttataatgacggtttttgaagtagaagaatcagtcttactagagtctttg

SEQ ID NO: 10626 - protein, 60 aa, Streptococcus agalactiae
MAAEFELLLGVLLAEEFSSVWLDDALVSSFSVETWLLEFCPLSLIMTVFEVEESVLLESL

SEQ ID NO: 10627 - DNA, 198 bp, Streptococcus agalactiae
atgccaaaacaaaaaacacaccgcgcatcagctaaacgctttaaacgcacaggttcaggtggattgaaacgcttccgcgcgtttacttcacaccgtttccacggtaaaactaaaaaacaacgtcgtcatcttcgtaaagctactatggtttcatcaggagatttcaaacgtattaaagcaatgcttactcgccttaaa

SEQ ID NO: 10628 - protein, 66 aa, Streptococcus agalactiae
MPKQKTHRASAKRFKRTGSGGLKRFRAFTSHRFHGKTKKQRRHLRKATMVSSGDFKRIKAMLTRLK

SEQ ID NO: 10629 - DNA, 681 bp, Streptococcus agalactiae
atgaactcaattaatattgctattgatggaccagcatcaagtggaaaaagtactgtcgctaagattattgctaaaaatttgaattacacttaccttgatacaggtgctatgtatcgttgtgctacttatctggctttacagcatggatatgaagcacaagatgtttcgaaaattctaggactcctagctgaaagaccaatttcttttggtaaagcagaagatggcagccagacagtctttcttggcacagaagaagttactttagctatccgtcaaaacgatgttactaacaatgtctcgtgggtttctgctatcccagagattcgagaagagttagtaaaccagcagcgtcgtatagccaaagatggtgctattataatggatggtcgtgacataggaacagttgttttgccagatgcagaattgaagatttttttagtggcttctgttgatgaaagagctgagcgtcgctttaaagaaaatcaagaaaaaggcattgagagtgattttgaaacactgaaatcagaaattgctgctcgtgattataaagatagccatcgagaagtttcaccattaaaggcagcagaagatgctattgaatttgatactacaggagtatcaattgaaggtgttgtaacttttattcaagaaaaagcagaaaaaataattgacatgaagaat

SEQ ID NO: 10630 - protein, 227 aa, Streptococcus agalactiae
MNSINIAIDGPASSGKSTVAKIIAKNLNYTYLDTGAMYRCATYLALQHGYEAQDVSKILGLLAERPISFGKAEDGSQTVFLGTEEVTLAIRQNDVTNNVSWVSAIPEIREELVNQQRRIAKDGAIIMDGRDIGTVVLPDAELKIFLVASVDERAERRFKENQEKGIESDFETLKSEIAARDYKDSHREVSPLKAAEDAIEFDTTGVSIEGVVTFIQEKAEKIIDMKN

SEQ ID NO: 10631 - DNA, 501 bp, Streptococcus agalactiae
atggttcagggttcaattaatattgaaaaatataaagatttggcgctccaaaaacaaggcgagcatcgtaaatttttagcaagtttaaaaaagaaagctcctaaaaacttagataaaatagtccaacagatacatcaagaggtttttcaagaaattgattgtacagcatgtgctaattgttgtaaaactttgggtcctctatttacagaagctgatatttctaggatttctaaacatttccggatgaagttatcggcttttgaagatttatttttagaagtagatgaagatggagataaagtatttaaagcgatgccttgtccgtttttaggcgatgataacttatgtagtatatacgatgtcagacctaaagcttgtcgtgaatttccacatactgatcgtaagaaaatctatcaaattaataacttaacgataaaaaatactcttacttgtccagcggcatacctttttgtggaaaaattgaaatcacgtatagggaaa

SEQ ID NO: 10632 - protein, 167 aa, Streptococcus agalactiae
MVQGSINIEKYKDLALQKQGEHRKFLASLKKKAPKNLDKIVQQIHQEVFQEIDCTACANCCKTLGPLFTEADISRISKHFRMKLSAFEDLFLEVDEDGDKVFKAMPCPFLGDDNLCSIYDVRPKACREFPHTDRKKIYQINNLTIKNTLTCPAAYLFVEKLKSRIGK

SEQ ID NO: 10633 - DNA, 804 bp, Streptococcus agalactiae
atgtcaaaaaaaataatattaggaattttatctcttttatctgtcgttactttggtggcgtgtggttcatcagacaaacagctacaagataaagttgagaaaaaagggaagttagttttagcggtgagtccagattatgctccctttgagtttaaagcgcttgttaatgggaaagataaagttgtcggcgcagatattgagttagctcaagctattgctgatgagcttcatgtcaaactagaggtatctcctatgagttttgacaatgttttatcaagtttacaaacaggtaaggctgatatggctatttctggattatcatatactaaagagcgtgctaaagtctatgatttttcaaaaccttattacactacagaaaatgcggttcttgttaggaagtctgatttaggaaaatatacttcaatcgaaagccttaaaggtaaaaaaatagcagtacaaaaaggaagtatcgaagagggagtttctaagaaatcattcaaaaattctcacgtcgtgtcactgacagcgatgggagaagcgattagtgagttaaaatcaggcaaggtagaagctgttgatttagaaaaaaccgtagctgaaggttacttggcccagaatccagaccttgttcttgctaagtttgcccttaaaacaggagaaggggatgctaaggctgtagctttacctaaagacagtggaaaaatgttgaagactgttaacaaagtgataaagagacttgaaaaagaagataaatataaagtttatatttcagatgcggctaaattaactggcaatcaagttgaa

SEQ ID NO: 10634 - protein, 268 aa, Streptococcus agalactiae
MSKKIILGILSLLSVVTLVACGSSDKQLQDKVEKKGKLVLAVSPDYAPFEFKALVNGKDKVVGADIELAQAIADELHVKLEVSPMSFDNVLSSLQTGKADMAISGLSYTKERAKVYDFSKPYYTTENAVLVRKSDLGKYTSIESLKGKKIAVQKGSIEEGVSKKSFKNSHVVSLTAMGEAISELKSGKVEAVDLEKTVAEGYLAQNPDLVLAKFALKTGEGDAKAVALPKDSGKMLKTVNKVIKRLEKEDKYKVYISDAAKLTGNQVE

SEQ ID NO: 10635 - DNA, 243 bp, Streptococcus agalactiae
atgaagcattggtacacagatgaaggcatccgctatttggtattcctttataaaacatatgatttttcaggtgaattacaatcgtcagatgaaggtgatgttgtatggattgaacgttcacaacttgataagattgaactagcatatgatatgcttaactttttgagagtatttgacgaagatgacatctcagagatgttttatagtaagcgacttgaagatggttttataagaaaattttat

SEQ ID NO: 10636 - protein, 81 aa, Streptococcus agalactiae
MKHWYTDEGIRYLVFLYKTYDFSGELQSSDEGDVVWIERSQLDKIELAYDMLNFLRVFDEDDISEMFYSKRLEDGFIRKFY

SEQ ID NO: 10637 - DNA, 186 bp, Streptococcus agalactiae
ttgaaaaaaaagaatttacttcaggagagtattaataaacgtctatctgaagagcgatatcaaattcctaaagaaaaaagagagaaaaaacgatttgacatgcagcttattctgattatttctattttaatagggttaatcatgtctattatcggaattattcgatttttcttaacctacagtagt

SEQ ID NO: 10638 - protein, 62 aa, Streptococcus agalactiae
MKKKNLLQESINKRLSEERYQIPKEKREKKRFDMQLILIISILIGLIMSIIGIIRFFLTYSS

SEQ ID NO: 10639 - DNA, 144 bp, Streptococcus agalactiae
gtgaaagtaaagaagtgtttttcaaatgttggctcaggtaacagatacgtttcaaaattaaacacctcattccaatctagttgctcatattgccaccatgtctccctaaaccttgaagaagaaaaagtattccatggtttatca

SEQ ID NO: 10640 - protein, 48 aa, Streptococcus agalactiae
MKVKKCFSNVGSGNRYVSKLNTSFQSSCSYCHHVSLNLEEEKVFHGLS

SEQ ID NO: 10641 - DNA, 372 bp, Streptococcus agalactiae
ttggcagtatctaaaaacatactcatttctaaaattcctattctttattctattcagtataaaaaaacgctttacagcgtttctcattacatgattgcactaatagcaccaaataccaaaccaccaactgttactagtaccatcaaaataacaacaaaaagagttagtttttcaaacccagttttttttcgttgtccgttatctccaaaagccactcatgtcacctcatttactgaatatatagttaagtctatattaacacgaaacgtcttatttcgcaaactacaaaccgttagcttaaatatatctttattaaatcaatatatctttattaaatcgcttccatatttccttgtgctttataagagttta

SEQ ID NO: 10642 - protein, 124 aa, Streptococcus agalactiae
MAVSKNILISKIPILYSIQYKKTLYSVSHYMIALIAPNTKPPTVTSTIKITTKRVSFSNPVFFRCPLSPKATHVTSFTEYIVKSILTRNVLFRKLQTVSLNISLLNQYIFIKSLPYFLVLYKSL

SEQ ID NO: 10643 - DNA, 291 bp, Streptococcus agalactiae
ttgaatcttaataagttttatgttagaatgtactttgaccatagtggaggaattaacatgtataacctattactcaccattctacttgttttatcagtattattgattatctcaattttcatgcaaccacaaaagaatccaagtagtaatgtttttgatagtagcggttctgaagccctttttgaacgtagtaaagctcgaggatttgaagcttttatgcaacgttttacaggtgttttagtctttttctggctactaatcggcttagtattatctattttatcaagtcat

SEQ ID NO: 10644 - protein, 97 aa, Streptococcus agalactiae
MNLNKFYVRMYFDHSGGINMYNLLLTILLVLSVLLIISIFMQPQKNPSSNVFDSSGSEALFERSKARGFEAFMQRFTGVLVFFWLLIGLVLSILSSH

SEQ ID NO: 10645 - DNA, 174 bp, Streptococcus agalactiae
atgtctaaaaagactgattcaaattatctacattccaattgttctgacaagaaaatttggagcgatgaggcgcctctgcaacaggagactatccctaaagacagagattgtgttatcaaacctgtcattactatgacagttgaacatgtggaaatcccattagatgaccaatct

SEQ ID NO: 10646 - protein, 58 aa, Streptococcus agalactiae
MSKKTDSNYLHSNCSDKKIWSDEAPLQQETIPKDRDCVIKPVITMTVEHVEIPLDDQS

SEQ ID NO: 10647 - DNA, 198 bp, Streptococcus agalactiae
atgatcatgctgttcctaatgattaaaccagattatataaggtatttcaaagtcattgacgatatgcatgataccatgtaccaacagactgtttttcatgttcaactgcaagcttggaaatacaccatgaaatcgattgatcaattagttgtagatgatttgaatcatatcagtaatgagaaaaccactttggttaaa

SEQ ID NO: 10648 - protein, 66 aa, Streptococcus agalactiae
MIMLFLMIKPDYIRYFKVIDDMHDTMYQQTVFHVQLQAWKYTMKSIDQLVVDDLNHISNEKTTLVK

SEQ ID NO: 10649 - DNA, 186 bp, Streptococcus agalactiae
atgagtggtcaaagagctaccagcaccatccagagcgatataaatatctttcatcatatagaagctatttgtataagtaaatctaacagtattgggctccccgcaatacaaaatcacttgggacagctgatccaaagagaacgtctgggtcttttcttctcgataacctattccaaagctcccact

SEQ ID NO: 10650 - protein, 62 aa, Streptococcus agalactiae
MSGQRATSTIQSDINIFHHIEAICISKSNSIGLPAIQNHLGQLIQRERLGLFFSITYSKAPT

SEQ ID NO: 10651 - DNA, 96 bp, Streptococcus agalactiae
atgttaaaagatgttaatgttggaatgagtcatttattagttagaggtgctattattctagtagtagggattgtttttctgttgcaacagattcag

SEQ ID NO: 10652 - protein, 32 aa, Streptococcus agalactiae
MLKDVNVGMSHLLVRGAIILVVGIVFLLQQIQ

SEQ ID NO: 10653 - DNA, 135 bp, Streptococcus agalactiae
gtgattagtctctcaatcttattacttagagtaaatcaagcaaaaatgttagaaaataaaaaatatatgacaaactattccaaacaatatgctcgccaatcgaataatgaatggattttgtatagtggtgcaaac

SEQ ID NO: 10654 - protein, 45 aa, Streptococcus agalactiae
MISLSILLLRVNQAKMLENKKYMTNYSKQYARQSNNEWILYSGAN

SEQ ID NO: 10655 - DNA, 252 bp, Streptococcus agalactiae
ttgtttgtcatgagaacatttgggaactccctgagtggtcccttggttgtgatcttatcttctatactatttagctggtctcacttacatggtctatctgtcgtcgactttgttgtctattttggtatgggtttgattttcgctagtttgcaccactatacaaaatccattcattattcgattggcgagcatattgtttggaatagtttgtcatatattttttattttctaacatttttgcttgatttactc

SEQ ID NO: 10656 - protein, 84 aa, Streptococcus agalactiae
MFVMRTFGNSLSGPLVVILSSILFSWSHLHGLSVVDFVVYFGMGLIFASLHHYTKSIHYSIGEHIVWNSLSYIFYFLTFLLDLL

SEQ ID NO: 10657 - DNA, 330 bp, Streptococcus agalactiae
ttgcttgggcattgggtgattagtttactatcaatagggttagagtggagttggagtatatggattggcattaatcttataatgatgattctgttgagttatgtgctaacaaaaactgagccaatcagtaactaccaagagtcatcatctaacctcaaaaaatggctatttgcaataggtgcttttagcgttttattttgctgggcactactagtaaaaacatttttcccaataaggcaaaaccaggagggattaatagctgatatgaatcaggtcaatcactactttcgagttgtcttattattgactatctgtcttattgccccaatt

SEQ ID NO: 10658 - protein, 110 aa, Streptococcus agalactiae
MLGHWVISLLSIGLEWSWSIWIGINLIMMILLSYVLTKTEPISNYQESSSNLKKWLFAIGAFSVLFCWALLVKTFFPIRQNQEGLIADMNQVNHYFRVVLLLTICLIAPI

SEQ ID NO: 10659 - DNA, 114 bp, Streptococcus agalactiae
atgggaaatactaggtgtgactttaaagaacttctaacttttattgatatgttgttaggcattcttgtagaaacaaatgttaagaaaataaggagttctcatttgtatatttta

SEQ ID NO: 10660 - protein, 38 aa, Streptococcus agalactiae
MGNTRCDFKELLTFIDMLLGILVETNVKKIRSSHLYIL

SEQ ID NO: 10661 - DNA, 96 bp, Streptococcus agalactiae
atgtttgtaatgggtgtccaaagaggaggatcaactgtggttacaagaagaccttctatcttgctaagcaagctcaaagaaactatgaaaaacttt

SEQ ID NO: 10662 - protein, 32 aa, Streptococcus agalactiae
MFVMGVQRGGSTVVTRRPSILLSKLKETMKNF

SEQ ID NO: 10663 - DNA, 159 bp, Streptococcus agalactiae
ttgcaatggtattcaaaagagctgaaattaaaaattttaaggaaattggaagtatcttacttctttattccaatagctaaatcggagattataaaaggttgccaaatttttctttggcaacctttttatattattacttataaatcatggaaactagca

SEQ ID NO: 10664 - protein, 53 aa, Streptococcus agalactiae
MQWYSKELKLKILRKLEVSYFFIPIAKSEIIKGCQIFLWQPFYIITYKSWKLA

SEQ ID NO: 10665 - DNA, 243 bp, Streptococcus agalactiae
ttgaataaacaagagcgtttaggaatgagcgtttatctttactataatcgtgacgctcgtaaattatataaatacggagatgttcattatcattctcgtagattaagatatctagtcatttatgttaataaagaggatattgttagcgttagtaaagagataaaacatttaaaatttgttaaggatgttcggttatcagcaattgatgatattgatcaggattttgttggaaacttatatcgt

SEQ ID NO: 10666 - protein, 81 aa, Streptococcus agalactiae
MNKQERLGMSVYLYYNRDARKLYKYGDVHYHSRRLRYLVIYVNKEDIVSVSKEIKHLKFVKDVRLSAIDDIDQDFVGNLYR

SEQ ID NO: 10667 - DNA, 111 bp, Streptococcus agalactiae
atgatctggaaaatggaccaaatttctaacagtttattctcaataggtgttcccgataatgcaaaacagtttttgacctcaaaagatctcaagctatgggctattttagtt

SEQ ID NO: 10668 - protein, 37 aa, Streptococcus agalactiae
MIWKMDQISNSLFSIGVPDNAKQFLTSKDLKLWAILV

SEQ ID NO: 10669 - DNA, 111 bp, Streptococcus agalactiae
atgattattgaaaaccctaacaaagcggacaaacaagaaaatctgtccattccagaaaaggcttacaaattttataataaaagagaattaaacataaaaggagtttccaaa

SEQ ID NO: 10670 - protein, 37 aa, Streptococcus agalactiae
MIIENPNKADKQENLSIPEKAYKFYNKRELNIKGVSK

SEQ ID NO: 10671 - DNA, 114 bp, Streptococcus agalactiae
gtgcttcagtcttatttacgccctcttggtgattttatttatttatcaagaaatcagacacataccaaatcaataaactatttgagaaagcaggttatttgtgataaaatgagt

SEQ ID NO: 10672 - protein, 38 aa, Streptococcus agalactiae
MLQSYLRPLGDFIYLSRNQTHTKSINYLRKQVICDKMS

SEQ ID NO: 10673 - DNA, 90 bp, Streptococcus agalactiae
atggggaatggcattgtgggacgaaaacttttcaaacttatttttatttggatttattttttcaaacagtttattttttataaagttcat

SEQ ID NO: 10674 - protein, 30 aa, Streptococcus agalactiae
MGNGIVGRKLFKLIFIWIYFFKQFIFYKVH

SEQ ID NO: 10675 - DNA, 228 bp, Streptococcus agalactiae
atgggaataaaaagttatagacgggttgagcttgtagcaaaacttaattttagatattatctagttagtattagtggacgttattacattattgattatgccaatcctagtgatataaaagattattttataggtatttttccagaaagagtagaaaaatatcaaatttatgatgtgactgcggattataagaattttttagtaaacaaaaaaagtcgcctttatctt

SEQ ID NO: 10676 - protein, 76 aa, Streptococcus agalactiae
MGIKSYRRVELVAKLNFRYYLVSISGRYYIIDYANPSDIKDYFIGIFPERVEKYQIYDVTADYKNFLVNKKSRLYL

SEQ ID NO: 10677 - DNA, 123 bp, Streptococcus agalactiae
ttgaaaacggaaatagaaacaaataatcttattaatttaggatggtttcatgataatgctgtttattatgatatgaaaacgaaaaaattatataaatctaatctaaaaaaaatagcacaggta

SEQ ID NO: 10678 - protein, 41 aa, Streptococcus agalactiae
MKTEIETNNLINLGWFHDNAVYYDMKTKKLYKSNLKKIAQV

SEQ ID NO: 10679 - DNA, 237 bp, Streptococcus agalactiae
atggctcaacaacgtcgtggcggattcaaacgccgtaaaaaagttgattatatcgcagctaacaagattgaatatgttgattacaaagatacagagcttcttagccgtttcgtttcagaacgtggaaaaattttaccacgtcgtgtaacaggaacttcagctaaaaaccaacgtaaagtaacaacagcaatcaaacgtgctcgtgttatggctcttatgccttacgtaaatgaagat

SEQ ID NO: 10680 - protein, 79 aa, Streptococcus agalactiae
MAQQRRGGFKRRKKVDYIAANKIEYVDYKDTELLSRFVSERGKILPRRVTGTSAKNQRKVTTAIKRARVMALMPYVNED

SEQ ID NO: 10681 - DNA, 489 bp, Streptococcus agalactiae
atgattaataatgtagtacttgtaggtcgcatgacccgtgatgcagaacttcgttatacaccaagtaatcaagcggtagccactttttcacttgcagttaatcgtaattttaaaaatcaatctggcgaacgtgaggctgattttattaactgtgttatttggcgccaacaagctgaaaacttggctaactgggcaaaaaaaggtgctttggttggaattacaggtcgtatccaaacgcgtaattatgaaaaccaacaaggtcaacgtgtctatgtaacagaagttgttgcggaaagtttccaattattggaaagtcgtgctacacgagaaggtggttcacctaactcttataataacggtggctataacaatgctccgtcaaataatagttattcagcttcttctcaacaaacacctaattttagtcgtgatgagagtccgtttggtaactcaaatccaatggatatttcagatgatgatctaccattc

SEQ ID NO: 10682 - protein, 163 aa, Streptococcus agalactiae
MINNVVLVGRMTRDAELRYTPSNQAVATFSLAVNRNFKNQSGEREADFINCVIWRQQAENLANWAKKGALVGITGRIQTRNYENQQGQRVYVTEVVAESFQLLESRATREGGSPNSYNNGGYNNAPSNNSYSASSQQTPNFSRDESPFGNSNPMDISDDDLPF

SEQ ID NO: 10683 - DNA, 357 bp, Streptococcus agalactiae
atgaaacttctcactaaagaacggtttgatgattctcaacacttttggtaccagatcaatttattacaagagagtaacttcggagcagtttttgaccatgataataaaaacattccacaggttgttgcaactattgttgatgatttacaaggttccggaagttcgaattatttctggtattttggcaatactactgatacttccatccttatgattgctcatttaaatcgaaaattctatattcaggttaatttaaaggactttgactttgcactcaatttaatagctataaataattggaagagtctcctccaaactcaactcgaagctctaaacgataccctagcaatatttcaa

SEQ ID NO: 10684 - protein, 119 aa, Streptococcus agalactiae
MKLLTKERFDDSQHFWYQINLLQESNFGAVFDHDNKNIPQVVATIVDDLQGSGSSNYFWYFGNTTDTSILMIAHLNRKFYIQVNLKDFDFALNLIAINNWKSLLQTQLEALNDTLAIFQ

SEQ ID NO: 10685 - DNA, 123 bp, Streptococcus agalactiae
atgacattaatcagtctccctcgcgttgctttgtcactccattctaccttatttattgaaatattgctagggtatcgtttagagcttcgagttgagtttggaggagactcttccaattattta

SEQ ID NO: 10686 - protein, 41 aa, Streptococcus agalactiae
MTLISLPRVALSLHSTLFIEILLGYRLELRVEFGGDSSNYL

SEQ ID NO: 10687 - DNA, 102 bp, Streptococcus agalactiae
ttgttgttatacttagttcataaaataaataacccaaaagaaagaggtaattcttatgaacaaacttattacagaaaaaaaagtcaacaacgtctcaactgc

SEQ ID NO: 10688 - protein, 34 aa, Streptococcus agalactiae
MLLYLVHKINNPKERGNSYEQTYYRKKSQQRLNC

SEQ ID NO: 10689 - DNA, 105 bp, Streptococcus agalactiae
atgcttgttttattaagtgtttatactaaagataatggtatgggatatcaagaagaattatgtatgcataaaaggttaaaatggttagtggcagctatgtgttta

SEQ ID NO: 10690 - protein, 35 aa, Streptococcus agalactiae
MLVLLSVYTKDNGMGYQEELCMHKRLKWLVAAMCL

SEQ ID NO: 10691 - DNA, 1008 bp, Streptococcus agalactiae
atggtagttaaagttggtattaacggtttcggtcgtatcggtcgtcttgcattccgtcgcatccaaaacgtagaaggtgttgaagttactcgtatcaacgaccttacagatccaaacatgcttgcacacttgttgaaatatgacacaactcaaggtcgtttcgacggtactgttgaagttaaagaaggtggattcgaagttaacggtcaatttgttaaagtttctgctgaacgcgaaccagcaaacattgactgggctactgatggcgtagaaatcgttcttgaagcaactggtttctttgcatcaaaagaaaaagctgaacaacacatccatgaaaatggtgctaaaaaagttgttatcacagctcctggtggaaacgacgttaaaacagttgttttcaacactaaccacgatatccttgatggaactgaaacagttatctcaggtgcttcatgtactacaaactgtcttgctccaatggctaaagctttacaagacaactttggtgttaaacaaggtttgatgactactatccacgcatacactggtgaccaaatgatccttgacggaccacaccgtggtggtgaccttcgtcgtgctcgtgcaggtgctgcaaacatcgttcctaactcaactggtgctgcaaaagctatcggacttgttatcccagaattgaacggtaaacttgatggtgctgcacaacgtgttcctgttccaactggatcagtaactgaattggttgcaactcttgaaaaagacgtaactgtcgaagaagtaaatgcagctatgaaagcagcagctaacgattcatacggttatactgaagatccaatcgtatcatctgatatcgttggtatttcatacggttcattgtttgatgctactcaaactaaagttcaaactgttgacggtaaccaattggttaaagttgtttcatggtacgataacgaaatgtcatacacttcacaacttgttcgtacacttgaatactttgcaaaaattgcaaaa

SEQ ID NO: 10692 - protein, 336 aa, Streptococcus agalactiae
MVVKVGINGFGRIGRLAFRRIQNVEGVEVTRINDLTDPNMLAHLLKYDTTQGRFDGTVEVKEGGFEVNGQFVKVSAEREPANIDWATDGVEIVLEATGFFASKEKAEQHIHENGAKKVVITAPGGNDVKTVVFNTNHDILDGTETVISGASCTTNCLAPMAKALQDNFGVKQGLMTTIHAYTGDQMILDGPHRGGDLRRARAGAANIVPNSTGAAKAIGLVIPELNGKLDGAAQRVPVPTGSVTELVATLEKDVTVEEVNAAMKAAANDSYGYTEDPIVSSDIVGISYGSLFDATQTKVQTVDGNQLVKVVSWYDNEMSYTSQLVRTLEYFAKIAK

SEQ ID NO: 10693 - DNA, 2076 bp, Streptococcus agalactiae
atggctcgcgaattttcacttgaaaaaactcgtaatatcggtatcatggctcacgtcgatgctggtaaaacaacaacaactgagcgtattctttactatactggtaaaatccacaaaatcggtgaaacacacgaaggtgcttcacaaatggactggatggaacaagaacaagaacgtggtatcacaattacatcagctgcaacaacagcacaatgggatggtcaccgtgttaacatcatcgatacaccaggacacgtggacttcacaattgaagttcaacgttcacttcgcgtacttgatggtgcggtaacagttcttgatgctcaatcaggtgtagaacctcaaactgaaacagtttggcgtcaagcaacagaatacggagttccacgtatcgtttttgctaataaaatggataaaatcggtgctgacttcctctattcagtacaatcacttcatgaccgtcttcaagcgaatgcacacccaattcaattgccaattggttcagaagacgatttccgtggtattattgacttaatcaaaatgaaagctgaaatctatactaatgaccttggtacagatatccttgaagaagatattccagcagagtatgttgatcaagcaaatgaatatcgtgaaaaattagtagaagcagttgctgatactgatgaagatttgatgatgaaataccttgaaggtgaagaaatcactaacgaagagttgatggctgctattcgtaaagcaactatcaatgttgaattctaccctgtattgtgtggttcagccttcaagaataaaggtgttcaattgatgcttgatgctgttattgattaccttccaagcccacttgatattcctgcaatcaaaggtattaaccctgatactgacgaagaagaaacacgtcctgcttcagatgaagagccatttgcagcgcttgccttcaagatcatgacagatcctttcgtgggtcgcttaacattcttccgtgtgtactcaggtgttcttaattcaggttcatacgtgttgaatacatctaaaggtaaacgtgaacgtatcggacgtatcttacaaatgcacgcaaatagtcgtcaagaaattgaaactgtttatgctggggatatcgcagcggctgttggtttgaaagatacaactacaggtgattcattgactgatgaaaaatcaaaagttattcttgaatcaattgaagttccagaaccagttatccaattgatggttgagccaaaatctaaagctgaccaagataaaatgggtatcgcccttcaaaaacttgctgaagaagatccaacgttccgcgttgaaactaacgttgaaactggtgaaacagttatctcaggaatgggtgaacttcaccttgatgtccttgttgaccgtatgaaacgtgaattcaaagttgaagcaaacgttggtgcacctcaagtatcataccgcgaaacattccgcgcttctacacaagcacgtggattcttcaaacgccaatctggtggtaaaggtcaatttggtgatgtttggattgaatttacaccaaacgaagaaggtaaaggattcgaattcgaaaatgctatcgtcggtggtgtggttcctcgtgaatttattccagccgttgaaaaaggacttgtagaatctatggcaaacggtgttcttgctggatatccaatggttgacgtaaaagctaaactttacgatggttcataccatgatgttgactcatctgagacagccttcaagattgctgcatcacttgcacttaaagaagctgctaaatcagcgcaaccagctatccttgagccaatgatgcttgttacaattacagctccagaagacaatcttggtgacgttatgggtcacgtgactgcacgtcgcggtcgtgttgatggtatggaagcacgtggtaatacacaagttgttcgtgcctttgttccacttgctgaaatgtttggttatgcaacagttcttcgttctgcaacacaaggacgtggcacattcatgatggtatttgaccactacgaagatgttcctaagtcagttcaagaagaaatcatcaagaaaaactctggtgaa

SEQ ID NO: 10694 - protein, 692 aa, Streptococcus agalactiae
MAREFSLEKTRNIGIMAHVDAGKTTTTERILYYTGKIHKIGETHEGASQMDWMEQEQERGITITSAATTAQWDGHRVNIIDTPGHVDFTIEVQRSLRVLDGAVTVLDAQSGVEPQTETVWRQATEYGVPRIVFANKMDKIGADFLYSVQSLHDRLQANAHPIQLPIGSEDDFRGIIDLIKMKAEIYTNDLGTDILEEDIPAEYVDQANEYREKLVEAVADTDEDLMMKYLEGEEITNEELMAAIRKATINVEFYPVLCGSAFKNKGVQLMLDAVIDYLPSPLDIPAIKGINPDTDEEETRPASDEEPFAALAFKIMTDPFVGRLTFFRVYSGVLNSGSYVLNTSKGKRERIGRILQMHANSRQEIETVYAGDIAAAVGLKDTTTGDSLTDEKSKVILESIEVPEPVIQLMVEPKSKADQDKMGIALQKLAEEDPTFRVETNVETGETVISGMGELHLDVLVDRMKREFKVEANVGAPQVSYRETFRASTQARGFFKRQSGGKGQFGDVWIEFTPNEEGKGFEFENAIVGGVVPREFIPAVEKGLVESMANGVLAGYPMVDVKAKLYDGSYHDVDSSETAFKIAASLALKEAAKSAQPAILEPMMLVTITAPEDNLGDVMGHVTARRGRVDGMEARGNTQVVRAFVPLAEMFGYATVLRSATQGRGTFMMVFDHYEDVPKSVQEEIIKKNSGE

SEQ ID NO: 10695 - DNA, 468 bp, Streptococcus agalactiae
atgagtcgtaaaaatcaagcgcctaaacgcgaagtattgccagatccattgtataactcaaaaatcgttacacgtcttatcaaccgtgtaatgcttgatggtaaacgtggtactgctgcaactatcgtatatgatgcttttgaagcaattaaagaagctactggaacagatgctcttgaagtgttcgaaacagctatggaaaacatcatgcctgtccttgaggtacgtgcacgccgtgttggtggatcaaactaccaagttcctgtcgaagttcgtccagaacgtcgtacaactttaggacttcgttggttggttaacgcatcacgtgctcgtggtgaacacactatgaaagatcgtcttgcaaaagaaatcatggatgctgcaaacaacacaggagcatcagttaagaaacgtgaagatactcacaaaatggctgaagctaaccgtgcctttgcacacttccgttgg

SEQ ID NO: 10696 - protein, 156 aa, Streptococcus agalactiae
MSRKNQAPKREVLPDPLYNSKIVTRLINRVMLDGKRGTAATIVYDAFEAIKEATGTDALEVFETAMENIMPVLEVRARRVGGSNYQVPVEVRPERRTTLGLRWLVNASRARGEHTMKDRLAKEIMDAANNTGASVKKREDTHKMAEANRAFAHFRW

SEQ ID NO: 10697 - DNA, 93 bp, Streptococcus agalactiae
atggtatgtttagtaactgatcaaaatagccggctaaacgaatacgaaaatctatcaggaggtattcaacgtgaaacgtacttatcaaccaag

SEQ ID NO: 10698 - protein, 31 aa, Streptococcus agalactiae
MVCLVTDQNSRLNEYENLSGGIQRETYLSTK

SEQ ID NO: 10699 - DNA, 117 bp, Streptococcus agalactiae
atgtatggtctctttatgtcaacacctttgcttagagatattttaattagcccacaccattattgttatggcattattgaattatttaaagacttattagtattaatattacaactt

SEQ ID NO: 10700 - protein, 39 aa, Streptococcus agalactiae
MYGLFMSTPLLRDILISPHHYCYGIIELFKDLLVLILQL

SEQ ID NO: 10701 - DNA, 471 bp, Streptococcus agalactiae; identical to SEQ ID NO: 9025

SEQ ID NO: 10702 - protein, 157 aa, Streptococcus agalactiae
MGGNEILINKRLRTISLLHYLLALLLLIDIIFTIDFIIHTSTISKNSLSYISYGQGFGWSMILINLIALPICFLVELSAGLLLKLEMHKQHGYYPLERLLMTGNILTVVSLVLLHTLIHNINSLLFLSITVVLLISGKSLSLISIYLLKRKSKHQKV

SEQ ID NO: 10703 - DNA, 489 bp, Streptococcus agalactiae
atgattataagacctgtcctaccctcagatgctaaagaattacttgctatctatgctccctacgttgctgacactacaataacgtttgaatacgatattcctagtatatcggaattcactaatcgtatcaaaaatatcagcaaatctttcccatatttagttgctgaagaaaatgggaaaatattaggttatgcatatgcttcaacttactacgctagagctgcctatgactggacttgcgagctttctatttaccttgataaagatgcacgtagcaaaaaaattggtagccaactatatgatacattggagaaagaattagttaaccaagggtatgttaatctactcgcttgtatcagtttaccaaatgatataagcattgcattccacaaaaaaagaggatttaatcaagtcgcacatttcccaaaaatcggatttaaatttgaacaatggcatgacattgtgtggttacaaaagcgattgaaatct

SEQ ID NO: 10704 - protein, 163 aa, Streptococcus agalactiae
MIIRPVLPSDAKELLAIYAPYVADTTITFEYDIPSISEFTNRIKNISKSFPYLVAEENGKILGYAYASTYYARAAYDWTCELSIYLDKDARSKKIGSQLYDTLEKELVNQGYVNLLACISLPNDISIAFHKKRGFNQVAHFPKIGFKFEQWHDIVWLQKRLKS

SEQ ID NO: 10705 - DNA, 183 bp, Streptococcus agalactiae
atgacagagcgagagcttaagaaaattgctaagaagcaaggttttagtaaaactaactttggcaaagggtcacacgaagtttggaaacatccagacggacggacagtgacgatacctaagccaaaggaaaaagattacagaccaggcacactgaacaacattctcaaagtcttgtatggggag

SEQ ID NO: 10706 - protein, 61 aa, Streptococcus agalactiae
MTERELKKIAKKQGFSKTNFGKGSHEVWKHPDGRTVTIPKPKEKDYRPGTLNNILKVLYGE

SEQ ID NO: 10707 - DNA, 96 bp, Streptococcus agalactiae
gtgtttaccgtccataaggacagagtagagcgtttccgtttcagtcgtgttaaaggttcggctgtccataatatcgctggtaaaggagaaatcacc

SEQ ID NO: 10708 - protein, 32 aa, Streptococcus agalactiae
MFTVHKDRVERFRFSRVKGSAVHNIAGKGEIT

SEQ ID NO: 10709 - DNA, 108 bp, Streptococcus agalactiae
atgacatttggtctagtttcaaccaatacatcacacttaaaagatgatgttttcacaccgtcaatggtaagttcattgatttttgtcatgccattcctcctctcaaat

SEQ ID NO: 10710 - protein, 36 aa, Streptococcus agalactiae
MTFGLVSTNTSHLKDDVFTPSMVSSLIFVMPFLLSN

SEQ ID NO: 10711 - DNA, 210 bp, Streptococcus agalactiae
ttgaccccgttggacactgcatttttcgccccatctattgcattggaaatagtggattttatggaattccaaatattgcttgctgttgaaagtatcccattaaaaattcctgaaatcgtgctactcaaattattaaacaaatttgacccagttgagaccagtccagaccacaaattggaaagagtggaagtgaaacttgaccacagagac

SEQ ID NO: 10712 - protein, 70 aa, Streptococcus agalactiae
MTPLDTAFFAPSIALEIVDFMEFQILLAVESIPLKIPEIVLLKLLNKFDPVETSPDHKLERVEVKLDHRD

SEQ ID NO: 10713 - DNA, 345 bp, Streptococcus agalactiae
atggccaagaaatttttcactagacaagatattcaatctatccttgaaacaaaccctttgaaggctaaggtcttctacatggaacgtgaggagaaatcttctcctgacaatgtcatcttgtattatcggttaacaccaggcagtagcattactgctgatgatagagtgcacatgagaaaagtgactttgcaagttagtcactaccacaagaagaaactagacaacattgaaaatttgatgctgtctaattttatgtgtgagccaaatcaattgaatctaaaacaacctgacactgactatctactgacaacttacagacttgaggtgtttacaaatgggcggtgg

SEQ ID NO: 10714 - protein, 115 aa, Streptococcus agalactiae
MAKKFFTRQDIQSILETNPLKAKVFYMEREEKSSPDNVILYYRLTPGSSITADDRVHMRKVTLQVSHYHKKKLDNIENLMLSNFMCEPNQLNLKQPDTDYLLTTYRLEVFTNGRW

SEQ ID NO: 10715 - DNA, 132 bp, Streptococcus agalactiae
ttgctaggattttccgtccaaacaatcggaaatctacaagaacctatcttcaaagaagtatctcctactggcgtaggaactccatctatttggataacatctacaataagatttcaactgacacagctcagt

SEQ ID NO: 10716 - protein, 44 aa, Streptococcus agalactiae
MLGFSVQTIGNLQEPIFKEVSPTGVGTPSIWITSTIRFQLTQLS

SEQ ID NO: 10717 - DNA, 153 bp, Streptococcus agalactiae
ttggcgtctgctttctttaggtcaaaccttacttttagtaggtcttttctctatgctcttattctaaaactagatttaaaaaaagtcaagagattagctaactttttagttaataatttaaaaaggagggtagatgaatgggaatcggttcaa

SEQ ID NO: 10718 - protein, 51 aa, Streptococcus agalactiae
MASAFFRSNLTFSRSFLYALILKLDLKKVKRLANFLVNNLKRRVDEWESVQ

SEQ ID NO: 10719 - DNA, 183 bp, Streptococcus agalactiae
atggaaagtgatttttatgctgtaactcatgtagggcgacttgtttttgttcttgctcagacagattcacatcaacccctaagaccttggttattggattgtaaaatcccgaactatgccagtcgctggcatcgaacaggcacaattccactccaaactctttacagagttggtctagtttca

SEQ ID NO: 10720 - protein, 61 aa, Streptococcus agalactiae
MESDFYAVTHVGRLVFVLAQTDSHQPLRPWLLDCKIPNYASRWHRTGTIPLQTLYRVGLVS

SEQ ID NO: 10721 - DNA, 177 bp, Streptococcus agalactiae
atgtcatatatttctagtttaatattgattatactttatttatctaaaaaaagacatcagaaagaggtattgtcacttgaaaatctttatggagaagctaagtttactctctttatcacttatcttgctatcaactttttcgacatcaccagccctaccacaaatgatatcttatta

SEQ ID NO: 10722 - protein, 59 aa, Streptococcus agalactiae
MSYISSLILIILYLSKKRHQKEVLSLENLYGEAKFTLFITYLAINFFDITSPTTNDILL

SEQ ID NO: 10723 - DNA, 102 bp, Streptococcus agalactiae
ttgattttttataatgatgtcttttttatctttaagaattataacctagataaatctttgttatatatgttgccaagttttatagaagaagaactctatagt

SEQ ID NO: 10724 - protein, 34 aa, Streptococcus agalactiae
MIFYNDVFFIFKNYNLDKSLLYMLPSFIEEELYS

SEQ ID NO: 10725 - DNA, 102 bp, Streptococcus agalactiae
atgaaagatgttcctagagtacctcctgggaatattttaattatttcgcaaccggcttcaagtgctgttgttacctctgataaggtcatgcaacctggtaaa

SEQ ID NO: 10726 - protein, 34 aa, Streptococcus agalactiae
MKDVPRVPPGNILIISQPASSAVVTSDKVMQPGK

SEQ ID NO: 10727 - DNA, 123 bp, Streptococcus agalactiae
ttggttactattcctactattaatgatgaagaaaaaatcctgaaccctacactcctcttctggattaatcatatgtttgaaagtaattggctgactatttttgacataaaagattctatctac

SEQ ID NO: 10728 - protein, 41 aa, Streptococcus agalactiae
MVTIPTINDEEKILNPTLLFWINHMFESNWLTIFDIKDSIY

SEQ ID NO: 10729 - DNA, 453 bp, Streptococcus agalactiae
atgcctaaattaaccctagtctatatcagtcttagcggcaatactcaaagctttgtcaaacgtcttagtgaacaactgtcaacttggcataactgtcaggtttcgactattaatatcaaggaacaaaatcatcaaacctttcctgttgaccaacctttcgtagcactattacccacttaccttgagggaggaaatggcattgacaatggcgatcaagaaattcttaccattccacttggtgattttatagctgcacacaataatgtcaaaaattgtatcggaattgttggctctggaaatagaaattttaacaatcagtactgtttaactgcaaaacaatactctgaacggtttggatttcctatgttaggagactttgaattgcgaggaacttctagcgacgttgaacgtatcgcaaatattatcgttgaaacattatcgaactttaaagcc

SEQ ID NO: 10730 - protein, 151 aa, Streptococcus agalactiae
MPKLTLVYISLSGNTQSFVKRLSEQLSTWHNCQVSTINIKEQNHQTFPVDQPFVALLPTYLEGGNGIDNGDQEILTIPLGDFIAAHNNVKNCIGIVGSGNRNFNNQYCLTAKQYSERFGFPMLGDFELRGTSSDVERIANIIVETLSNFKA

SEQ ID NO: 10731 - DNA, 288 bp, Streptococcus agalactiae
atgatagattatagccaccatattgaagtttctttagagacagatgaacctaagatagccatgtcttattttacattaaaccataagcaaatttttatcatagaaaattcgatagtcgaggaaagaatagatgcttcacgtttgtttggttatggagcaagtagcaagggagaagatagagggttaggcctttataatgtcatgaaagttattgaccgttatcccaatgcatctattagtacaaatagtgaacaacatactttccgtcagggcttagaaataatcttt

SEQ ID NO: 10732 - protein, 96 aa, Streptococcus agalactiae
MIDYSHHIEVSLETDEPKIAMSYFTLNHKQIFIIENSIVEERIDASRLFGYGASSKGEDRGLGLYNVMKVIDRYPNASISTNSEQHTFRQGLEIIF

SEQ ID NO: 10733 - DNA, 144 bp, Streptococcus agalactiae
ttgatggatttgctaaaatgtggatatacattggatgatatagaaacagccagaccagaggatatggaacgttattatgcccctgaacaaatcagaaaatatggagctttaggaatagaattgaggttattgcatggatatttt

SEQ ID NO: 10734 - protein, 48 aa, Streptococcus agalactiae
MMDLLKCGYTLDDIETARPEDMERYYAPEQIRKYGALGIELRLLHGYF

SEQ ID NO: 10735 - DNA, 381 bp, Streptococcus agalactiae
atgttatctggatacaaatttaaaaaagtcaggagaagagtttctaagcgtagcacacaagttttctttgattttacagaagtagaagttactaaatttattgtcttatctcatttagtggataagacaaagaatttagatgactctattaaagaagtctggggcgactcaaaagctcagtccgaacgagatataaaaaatgaattgaaaatgctatcagaggatttctataaattcttatttgaagcagaagatagtatgtttcagttaaaaaaaaataatcagtctttacagaaacaggttaaggagctgacagagcgattaaacattttagaaaatgagaaggattcaggtatatttaacaaacttaagcgaggtttc

SEQ ID NO: 10736 - protein, 127 aa, Streptococcus agalactiae
MLSGYKFKKVRRRVSKRSTQVFFDFTEVEVTKFIVLSHLVDKTKNLDDSIKEVWGDSKAQSERDIKNELKMLSEDFYKFLFEAEDSMFQLKKNNQSLQKQVKELTERLNILENEKDSGIFNKLKRGF

SEQ ID NO: 10737 - DNA, 108 bp, Streptococcus agalactiae
atgagctttgcaaaagttctaactaagaaaaataaattagacaatgtaaacgatttatggtattttgtaagaaattcaaaaaatagatgggttgctggttcagcccat

SEQ ID NO: 10738 - protein, 36 aa, Streptococcus agalactiae
MSFAKVLTKKNKLDNVNDLWYFVRNSKNRWVAGSAH

SEQ ID NO: 10739 - DNA, 204 bp, Streptococcus agalactiae
atgaatacagaaataccaaatcaattattaccattcctagttccgttgattatgttgcaaggagctttaattatcatttctctagtcaaactaagtaaacttaagatgactaaacacctttcaaagccagtttggtttttggtcattatatttcttaatataattgggccaattgcatttcttattttggaagggaataatgaa

SEQ ID NO: 10740 - protein, 68 aa, Streptococcus agalactiae
MNTEIPNQLLPFLVPLIMLQGALIIISLVKLSKLKMTKHLSKPVWFLVIIFLNIIGPIAFLILEGNNE

SEQ ID NO: 10741 - DNA, 144 bp, Streptococcus agalactiae
atgaattataaaagagcctttcttaagggctcttttataattcattatttttcaatgacaaatattagtgaagttaatttttatttaaccattgttattattaatgctgttttgccacttattaatcaacgaaaaagtttcttc

SEQ ID NO: 10742 - protein, 48 aa, Streptococcus agalactiae
MNYKRAFLKGSFIIHYFSMTNISEVNFYLTIVIINAVLPLINQRKSFF

SEQ ID NO: 10743 - DNA, 300 bp, Streptococcus agalactiae
atgactaaaaagataactgttgtagcattagaaacattgattgcccagcataataatatccatttgatagacgttcgtgaagagcatgagtatcgtggggggcatatttcaggtgcgataaatcttcctttgagtcaactcagtcataagtttgaacagttagataaaaataaggaatattatcttgtttgtcaacgagggggaagatctattagagcatgccaatttcttgagttgaaaggctacaaagtaatcaatgtagatggcggcacagaagcgtggagaggaaatctagaagtg

SEQ ID NO: 10744 - protein, 100 aa, Streptococcus agalactiae
MTKKITVVALETLIAQHNNIHLIDVREEHEYRGGHISGAINLPLSQLSHKFEQLDKNKEYYLVCQRGGRSIRACQFLELKGYKVINVDGGTEAWRGNLEV

SEQ ID NO: 10745 - DNA, 765 bp, Streptococcus agalactiae
atgaacgttaaacatatgatgtatctatctggaactctagtggctggtgcattgttattttcaccagctgtattagaagtacatgctgatcaagtgacaactccacaagtggtaaatcatgtaaacagtaataatcaagcccagcaaatggctcaaaagcttgatcaagatagcattcagttgagaaatatcaaagataatgttcagggaacagattatgaaaaaacggttaatgaggctattactagtgttgaaaaattaaagacttcattgcgtgccaaccctgagacagtttatgatttgaattctattggtagtcgtgtagaagccttaacagatgtgattgaagcaatcactttttcaactcaacatttagcaaataaggttagtcaagcaaatattgatatgggatttgggataactaagctggttattcgcattttagatccatttgcttcagttgattcaattaaagctcaagttaacgatgtaaaggcattagaacaaaaggttttaacttatcctgatttaaaaccaactgatagagctacaatctatacaaaatcaaaacttgataaggaaatctggaatacacgctttactagagataaaaaagtacttaacgtcaaagaatttaaagtttacaatactttaaataaagcaatcacacatgctgttggagttcagttgaatccaaatgttacggtacaacaagttgatcaagagattgtaacattacaagcagcacttcaaacagcattaaaa

SEQ ID NO: 10746 - protein, 255 aa, Streptococcus agalactiae
MNVKHMMYLSGTLVAGALLFSPAVLEVHADQVTTPQVVNHVNSNNQAQQMAQKLDQDSIQLRNIKDNVQGTDYEKTVNEAITSVEKLKTSLRANPETVYDLNSIGSRVEALTDVIEAITFSTQHLANKVSQANIDMGFGITKLVIRILDPFASVDSIKAQVNDVKALEQKVLTYPDLKPTDRATIYTKSKLDKEIWNTRFTRDKKVLNVKEFKVYNTLNKAITHAVGVQLNPNVTVQQVDQEIVTLQAALQTALK

SEQ ID NO: 10747 - DNA, 186 bp, Streptococcus agalactiae
atggtttttgggcataatggaacgattttatctaaaatagtacgcttcttattaaatttattttttaagaaaaacattaggctaatctatttgataaaaatagtgataagtagaaattttctaaaatatttagatttatataaggtggtaaattatcgttatggttttttacatgaaaatataaat

SEQ ID NO: 10748 - protein, 62 aa, Streptococcus agalactiae
MVFGHNGTILSKIVRFLLNLFFKKNIRLIYLIKIVISRNFLKYLDLYKVVNYRYGFLHENIN

SEQ ID NO: 10749 - DNA, 321 bp, Streptococcus agalactiae
atgataaatagtaccgtttttcttgctattcttttaggttttgttgtttcttgggtgccaagagtcgctccattcatatttgtaaaatacaaagggctaccaaatagtcttgtgaaatttttaaaatttcttcctctttctattttatttgccctaacattctctagctttttttcagttaaattaggacaattgccaacactaaaatggttagatttattggctggcataccaactctagttgtcactattcgatatcgaaatttattttacactgttcttactggtatcgttactatggctttattgagattactattt

SEQ ID NO: 10750 - protein, 107 aa, Streptococcus agalactiae
MINSTVFLAILLGFVVSWVPRVAPFIFVKYKGLPNSLVKFLKFLPLSILFALTFSSFFSVKLGQLPTLKWLDLLAGIPTLVVTIRYRNLFYTVLTGIVTMALLRLLF

SEQ ID NO: 10751 - DNA, 99 bp, Streptococcus agalactiae
atgctaaaaaaacagtacgagctgactgatttagctaaaaatagaaaaatcccaaaagttaaacttttgggattttatacgcgtaaatatcactatttc

SEQ ID NO: 10752 - protein, 33 aa, Streptococcus agalactiae
MLKKQYELTDLAKNRKIPKVKLLGFYTRKYHYF

SEQ ID NO: 10753 - DNA, 111 bp, Streptococcus agalactiae
gtggggagagaacctgctgttgagggtattttcaccttttttattgctatttttcgtgttataataagaagactatacttttttgacatggagaagtgcgatgacattcta

SEQ ID NO: 10754 - protein, 37 aa, Streptococcus agalactiae
MGREPAVEGIFTFFIAIFRVIIRRLYFFDMEKCDDIL

SEQ ID NO: 10755 - DNA, 120 bp, Streptococcus agalactiae
atgtcagatactcagctaacactagaagaacaagaatttctcaaacaatatatgtctagaaaataccactactttagggatattattcgttacggtcaagtgttggctaaattgactaaa

SEQ ID NO: 10756 - protein, 40 aa, Streptococcus agalactiae
MSDTQLTLEEQEFLKQYMSRKYHYFRDIIRYGQVLAKLTK

SEQ ID NO: 10757 - DNA, 330 bp, Streptococcus agalactiae
gtgagggctgaaattatcgctgtaggaacagaaattttaacaggacagatcgttaatacaaacgcacaatttttgtcggagaaaatggcagaattgggaattgatatttatttccagacagctgtaggagacaatgaggaacgtttattatcgcttttagatatagctagtcagcgcagtcaattggttatcctatgtggtggacttggccctacagaggatgacttaacgaagcaaacttttgctaaatttttaggtaaatcattaacagtagatttattagctagtcgaaaattggatcgttttttttgcaagtcgtcctcagtttgc

SEQ ID NO: 10758 - protein, 110 aa, Streptococcus agalactiae
MRAEIIAVGTEILTGQIVNTNAQFLSEKMAELGIDIYFQTAVGDNEERLLSLLDIASQRSQLVILCGGLGPTEDDLTKQTFAKFLGKSLTVDLLASRKLDRFFCKSSSVC

SEQ ID NO: 10759 - DNA, 246 bp, Streptococcus agalactiae
atggcaacattaaaaacagaacatgattttgacttaacccgtaactggtaccgcaaatccgtctttctagatgagctctggcatggcatgaccgttgcaacacttaatagttacattcgtcagatgaaagacagcccttacgctttcggtatcaaaggaacacacggcaatgtctttatccactcagaagtctttgtggcgtggtttgactacaaaattgccaatcagtatgtcgcaaagatggcg

SEQ ID NO: 10760 - protein, 82 aa, Streptococcus agalactiae
MATLKTEHDFDLTRNWYRKSVFLDELWHGMTVATLNSYIRQMKDSPYAFGIKGTHGNVFIHSEVFVAWFDYKIANQYVAKMA

SEQ ID NO: 10761 - DNA, 96 bp, Streptococcus agalactiae
ttggtttcttcaaacgatgaagacggttcgccaccccaccgctgggcgagtggtcaatacggtagcccagagcaggtggggaaggtggcaaacggc

SEQ ID NO: 10762 - protein, 32 aa, Streptococcus agalactiae
MVSSNDEDGSPPHRWASGQYGSPEQVGKVANG

SEQ ID NO: 10763 - DNA, 213 bp, Streptococcus agalactiae
atgaatcaaacaagtattgaactacaaatggtggagtgggttgcctactcgccagagacacaagagaaagttttcatcaaaccagaggactgcaaagatttagatgacagagaactctatcaccttatcaagagtacgggatttgaacgattgattgaatctagagccttgcagattgtgaccgactttctcaatcagaaaacacaggtaagc

SEQ ID NO: 10764 - protein, 71 aa, Streptococcus agalactiae
MNQTSIELQMVEWVAYSPETQEKVFIKPEDCKDLDDRELYHLIKSTGFERLIESRALQIVTDFLNQKTQVS

SEQ ID NO: 10765 - DNA, 171 bp, Streptococcus agalactiae
atgaaggttatctttcaacagataatgctcaaaggaatagaacctactattgtcctcaacttctttcaatcgttcaataaggtatctcttaatgaagtaatgttcacctctgcttcacttatttcttttttagtgaagcaaaagtcatctttacttctcttatctatttct

SEQ ID NO: 10766 - protein, 57 aa, Streptococcus agalactiae
MKVIFQQIMLKGIEPTIVLNFFQSFNKVSLNEVMFTSASLISFLVKQKSSLLLLSIS

SEQ ID NO: 10767 - DNA, 168 bp, Streptococcus agalactiae
ttggataagagtgtggtcgctttattagtgattcacccaaactggcataacttacttggattagttatccacggaagtgaatcgggagaaatttctttaggggcagaatatatctctactctttcaatactaactgttagtgaattttcttcatctgacctgtctgct

SEQ ID NO: 10768 - protein, 56 aa, Streptococcus agalactiae
MDKSVVALLVIHPNWHNLLGLVIHGSESGEISLGAEYISTLSILTVSEFSSSDLSA

SEQ ID NO: 10769 - DNA, 483 bp, Streptococcus agalactiae
atgaataaaaaagaaacaagacaccaattaattcgttccttagtctctgagactaaggtgcgtacacaacatgagttaagggaattactagaaaaaaatggcgtttcagtgacgcaagcaacattatctcgagatatgaaggaacttaatttaattaaggttaacgaaagcagtgataatgctacagaaacttattatgagattcatagtatatctcagaagcgttgggaagaacggttacgtttttacatggaagatgccctagtcatgctgtttccagttcaaaaccaaatcgttttgaagacactacctggcttagctcaatcttttggctccatattagattcgattttattacctgagatcttagcaactgtctgtggtgatgatacttgtttgattatttgtaataatagtgaagaagctcaaaagtgttttgagaaattaagtcagtatacgccgcctttcttcttctcaaaaaaa

SEQ ID NO: 10770 - protein, 161 aa, Streptococcus agalactiae
MNKKETRHQLIRSLVSETKVRTQHELRELLEKNGVSVTQATLSRDMKELNLIKVNESSDNATETYYEIHSISQKRWEERLRFYMEDALVMLFPVQNQIVLKTLPGLAQSFGSILDSILLPEILATVCGDDTCLIICNNSEEAQKCFEKLSQYTPPFFFSKK

SEQ ID NO: 10771 - DNA, 690 bp, Streptococcus agalactiae
atgcgcagagatgatattataatgccacaagatggaagaaaaatggctgtattattgggttttattggtggttttattgacgtttatagtcacatgcagtttcactcccttgttgcaacacagacaggtaatattatcttgatggtggcaaatctcggacaaaatgattttcacttttttatcactaaattattttctattttctttttttcaattggttttttggttggtattgtgattaaagaacgtgcagtaacagctttttggcgtctatatgcattatgtccccttttactttctacgatgtttattccttttgttgaaaatgtaaaccacaatatctgggtagctttattagcctttagcacaggtattttaatgttgacattttcaggaagtcgcattgaatcggaaccatatactatcttaatgacttctggtaattatcggaaaatgctacaattttggtatgagtatattgttaatcgtcagagaacggctatgcaaaaaagacgagctatcaattattcactggtagttctagcatttattattggagcattggtagctgcaatagtttacgatatttttgcatatagagctattttaggtgtgacgataacgcttttaattattatgattcattatacgattgaaattattaagaacgatttaacgttacataatgtt

SEQ ID NO: 10772 - protein, 230 aa, Streptococcus agalactiae
MRRDDIIMPQDGRKMAVLLGFIGGFIDVYSHMQFHSLVATQTGNIILMVANLGQNDFHFFITKLFSIFFFSIGFLVGIVIKERAVTAFWRLYALCPLLLSTMFIPFVENVNHNIWVALLAFSTGILMLTFSGSRIESEPYTILMTSGNYRKMLQFWYEYIVNRQRTAMQKRRAINYSLVVLAFIIGALVAAIVYDIFAYRAILGVTITLLIIMIHYTIEIIKNDLTLHNV

SEQ ID NO: 10773 - DNA, 702 bp, Streptococcus agalactiae
gtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatggtaaaggaaataaactaccagcaacaggtgagaatgcaactccattctttaatgttgtagctttgacaattatgtcatcagttggtttattatctgtttctaagaaaaaagaggat

SEQ ID NO: 10774 - protein, 234 aa, Streptococcus agalactiae
MTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNGKGNKLPATGENATPFFNVVALTIMSSVGLLSVSKKKED

SEQ ID NO: 10775 - DNA, 1830 bp, Streptococcus agalactiae
atgaatattgaagatttgaagaaacgtcaagaaaagattagaaacttttcgattatcgctcatattgaccatggaaaatcaaccttagcagaccgtattttagagaaaacagaaacggtttctagtcgtgaaatgcaggcgcaactgttggactctatggatctagaacgtgagcgtggaattactataaagttaaatgctattgagcttaattatactgctaaagatggtgaaacttacatttttcacttgattgacacgccagggcatgttgacttcacatatgaagtatcacgttcattggcagcttgtgagggtgctatactggttgttgatgcagcccaaggaattgaagctcaaactctggcaaatgtttatttggctctagacaatgatttagagatactaccagttattaataaaattgatttaccagcagcagatccagaacgtgtacgtgcagaagtagaggatgttattggtctagatgcttcagaagctgtgcttgcctcagctaaggcagggattggtattgaagaaattttagagcagatcgttgaaaaagttcctgcaccgactggggaagtagatgctcctcttcaagctctaatttttgattctgtttatgatgcttatcgtggagtaattcttcaagtaaggattgtaaatggtatggttaagccaggagataagattcaaatgatgtctaatggtaaaaccttcgacgttactgaggttggtattttcactcccaaagcagttggacgtgattttttagcaactggagatgtagggtatattgctgcctcaattaaaacggttgctgatacacgtgttggtgataccattacccttgctaataacccagcaatagaacccttgcatggctataagcaaatgaacccaatggtttttgccggtctttatccaattgaatcaaataagtataacgatctgcgtgaagcccttgaaaaattacaattgaatgatgctagtctacagtttgaaccggaaacatcacaagcattagggtttggtttccgttgtggtttcttaggacttttacatatggacgttatccaagagcgcttggaacgagagttcaatattgatcttattatgactgcaccatcagtagtttatcatgttaatacaactgacggtgaaatgcttgaagtttcgaatccatctgaatttcctgatcctactcgtgttgacagcattgaagaaccatatgttaaggcgcaaattatggttcctcaagaatttgtcggtgctgtaatggagttagcacaacgtaaacgtggtgactttgtaacaatggattatattgatgataatcgtgttaatgttatttaccaaattcctttagctgaaattgtgtttgacttctttgataagcttaaatcatcaacacgtggctatgctagttttgattatgaaatttccgaatatcgtcgctcacaattagttaaaatggatattcttttaaatggtgataaagtggatgctttaagctttattgttcacaaagaatttgcctatgaacgtggtaaattgatcgttgataagttgaaaaaaatcattcctcgtcagcagtttgaagttcctatccaagcagctattggacaaaaaattgtggcccgttctgatataaaagcactacgtaaaaatgtcttagcaaaatgttatggtggtgacgtttcacgtaaacgtaagttgcttgaaaaacaaaaagctggtaaaaagcgcatgaaagcaattggttccgtcgaagttcctcaggaagctttcttaagtgttttatcaatggacgatgatgacaaaaaa

SEQ ID NO: 10776 - protein, 610 aa, Streptococcus agalactiae
MNIEDLKKRQEKIRNFSIIAHIDHGKSTLADRILEKTETVSSREMQAQLLDSMDLERERGITIKLNAIELNYTAKDGETYIFHLIDTPGHVDFTYEVSRSLAACEGAILVVDAAQGIEAQTLANVYLALDNDLEILPVINKIDLPAADPERVRAEVEDVIGLDASEAVLASAKAGIGIEEILEQIVEKVPAPTGEVDAPLQALIFDSVYDAYRGVILQVRIVNGMVKPGDKIQMMSNGKTFDVTEVGIFTPKAVGRDFLATGDVGYIAASIKTVADTRVGDTITLANNPAIEPLHGYKQMNPMVFAGLYPIESNKYNDLREALEKLQLNDASLQFEPETSQALGFGFRCGFLGLLHMDVIQERLEREFNIDLIMTAPSVVYHVNTTDGEMLEVSNPSEFPDPTRVDSIEEPYVKAQIMVPQEFVGAVMELAQRKRGDFVTMDYIDDNRVNVIYQIPLAEIVFDFFDKLKSSTRGYASFDYEISEYRRSQLVKMDILLNGDKVDALSFIVHKEFAYERGKLIVDKLKKIIPRQQFEVPIQAAIGQKIVARSDIKALRKNVLAKCYGGDVSRKRKLLEKQKAGKKRMKAIGSVEVPQEAFLSVLSMDDDDKK

SEQ ID NO: 10777 - DNA, 762 bp, Streptococcus agalactiae
ttggacgctaaatttgatttcgctaaacaattagtgtataaagctggtcaattcattaaatctgagatgcaaaatacttttgatgttgaggaaaagtctcgatttgatgatttagtgacaagtcttgataaaaaaacacaaaaattattaattcaagaaattattcaacattacccagatgataatatacttgccgaagaagatgatgtgcgctcacccattgcacaaggtaatgtttgggttttagaccctattgatggaactgttaattttattgttcaaaaagataactttgctgttatgttagcttattacgaagaaggcgttggacaatttggtatcatctacgacgttatggctgatattctttacagcgggggaggacattttgatgtctatgctaacgataaaaaaattgttccttttcaagagtgtcctttagaacgttgcttacttggagtaaattctgctatgtatgcagaaaatgattgcggtattgcccatttagcttctgaaaccttaggtgttcgtatctatggtggtgctggaattagcatggcaaaagtcatgcagggcaaattattagcttatttttcgtatattcaaccttgggattatgctgcagcaaaaatcatgggggagacattaggatttaccttattaacgcttgacggggaagaacccaactattcaacaagacaaaaagtaatgttcctaccaaagtcgaaattaaatcttatccaatcctaccttaccaaaaaa

SEQ ID NO: 10778 - protein, 254 aa, Streptococcus agalactiae
MDAKFDFAKQLVYKAGQFIKSEMQNTFDVEEKSRFDDLVTSLDKKTQKLLIQEIIQHYPDDNILAEEDDVRSPIAQGNVWVLDPIDGTVNFIVQKDNFAVMLAYYEEGVGQFGIIYDVMADILYSGGGHFDVYANDKKIVPFQECPLERCLLGVNSAMYAENDCGIAHLASETLGVRIYGGAGISMAKVMQGKLLAYFSYIQPWDYAAAKIMGETLGFTLLTLDGEEPNYSTRQKVMFLPKSKLNLIQSYLTKK

SEQ ID NO: 10779 - DNA, 1371 bp, Streptococcus agalactiae
ttgggaatactgattgtatttccttttttattggttttattgttgactgcttcgtcaagttctcaacaagattgtcaaattacaccagatgtatcttcacaagttgaaacctcaagtgagaatgcttccaatagtgattggacaaaaaagggaacagttgcaaatcaaacagcagagaaggtattcaatgcttgggtaagtaaaggcttatctggtgcgagtgcatcagggattgttggttgggttaattcagaaggtggatttgctatgataggtcgagcagaagggcattatggtaatgatttaaaaacaaattcaattgcctttaatgtgagacctactgggttatcttactatacgactgaagctggaggtggtatttatcaaatcacacctttcacaaagtatgccccattaggcgatcccaaatgggaagatgcagatgccatgaatgcctttgttatgaaatccattaaatcaggagactggaataaagcaatggatttatcaggtggaaatcattcttttgaagagatggcacagatgactgatcccaagcaggccactttagtttggaatgcttacgaacgaggaaatactgcatatattaataaagctcaaaagactgcggatgggcaaaaagcctatgaaatatttaatggttcaaaatataaatttgatgcagaaaaattttctaaaagttttggtggtggttcaaaaacgtcctcgtctggtaagagcgatataatttctgattctacagttttatctctttgtgattcagctagtaatgcggtacagggcttatttggtaaagataagtcagggaaagttaaatacacttcttataatgcatggaaaccagatcaattaccaagtgatttgaaaaagtatgcaatagatcctaagtcagttggtttattttatcgaacgtctagtggatggaatgcgatagcttctactggtggtcaatgtacagatctttcagcaagtttgatgtatggtttatggcttaaaggcggaatgcatccaacgcaaagaatgggaaatggtaatatggttgtttctaattgggtatctgcattcggtggacgctctgaaaatactccatcttctggagctgttttttcaagttcaggtacttctagtgctgggcatactggagtggttagtcatgtatttgaaaatggcgatatgttaatagtagagcaaaattattcaacttattctggagataatagaggatttggaccatattcatggaattatcgttatgtttctactttagaattaaaaaaagagcattatagtttttataatccctctaaagctggttataaattgtctgataaagtgaaaacggtaggtagt

SEQ ID NO: 10780 - protein, 457 aa, Streptococcus agalactiae
MGILIVFPFLLVLLLTASSSSQQDCQITPDVSSQVETSSENASNSDWTKKGTVANQTAEKVFNAWVSKGLSGASASGIVGWVNSEGGFAMIGRAEGHYGNDLKTNSIAFNVRPTGLSYYTTEAGGGIYQITPFTKYAPLGDPKWEDADAMNAFVMKSIKSGDWNKAMDLSGGNHSFEEMAQMTDPKQATLVWNAYERGNTAYINKAQKTADGQKAYEIFNGSKYKFDAEKFSKSFGGGSKTSSSGKSDIISDSTVLSLCDSASNAVQGLFGKDKSGKVKYTSYNAWKPDQLPSDLKKYAIDPKSVGLFYRTSSGWNAIASTGGQCTDLSASLMYGLWLKGGMHPTQRMGNGNMVVSNWVSAFGGRSENTPSSGAVFSSSGTSSAGHTGVVSHVFENGDMLIVEQNYSTYSGDNRGFGPYSWNYRYVSTLELKKEHYSFYNPSKAGYKLSDKVKTVGS

SEQ ID NO: 10781 - DNA, 927 bp, Streptococcus agalactiae
atgaaaacaagatcaaaacttgcagcaggctttttgacacttatgtcagttgccacattagctgcctgctcaggtaaaacatcaaatggaacaaatgttgttacaatgaagggcgacactattacagtctctgatttttatgatcaagtaaaaacatcaaaagctgcacaacaatcaatgcttacattgatcctctcacgtgtttttgatacacagtatggtgataaagtttcagataaaaaagtatcagaagcttataataagacagctaaaggctatggtaattcattttcaagcgcactttcacaagcaggtttgactccggaaggttacaaacaacaaattcgcacaactatgcttgtggaatatgctgtaaaagaagcagctaagaaagaattaacagaagcaaactataaagaagcatataaaaactatactcctgaaacttctgtacaagtaatcaaattggatgcagaagataaagctaaatctgtccttaaagatgtaaaggctgatggagctgattttgcaaagattgcaaaagaaaaaacaacagctactgataagaaagttgagtataaatttgattctgcagggacaaccctccctaaagaagttatgtcagcagcctttaagctagataaaaatggtgtttcagatgtggtttcaacggttgattcaacaacttataaaacaagttactacatcattaaagtaactgataagacagagaaaaaatctgattggaaatcttacaaaaatcgcttaaaagaagttattcttaaggataaaacaagcgatagagccttccaaaataaagtgatttcaaaagccttagaaaaagctaatgttaagattaaagataaagcatttgcaggcatcttatcacaatatgctacaacaagtggttcatcatcacttaaaaaa

SEQ ID NO: 10782 - protein, 309 aa, Streptococcus agalactiae
MKTRSKLAAGFLTLMSVATLAACSGKTSNGTNVVTMKGDTITVSDFYDQVKTSKAAQQSMLTLILSRVFDTQYGDKVSDKKVSEAYNKTAKGYGNSFSSALSQAGLTPEGYKQQIRTTMLVEYAVKEAAKKELTEANYKEAYKNYTPETSVQVIKLDAEDKAKSVLKDVKADGADFAKIAKEKTTATDKKVEYKFDSAGTTLPKEVMSAAFKLDKNGVSDVVSTVDSTTYKTSYYIIKVTDKTEKKSDWKSYKNRLKEVILKDKTSDRAFQNKVISKALEKANVKIKDKAFAGILSQYATTSGSSSLKK

SEQ ID NO: 10783 - DNA, 813 bp, Streptococcus agalactiae; identical to SEQ ID NO: 843

SEQ ID NO: 10784 - protein, 271 aa, Streptococcus agalactiae
LKKKLKTFSLILLTGSLLVACGRGEVSSHSATLWEQIVYAFAKSIQWLSFNHSIGLGIILFTLIIRAIMMPLYNMQMKSSQKMQEIQPRLKELQKKYPGKDPDNRLKLNDEMQSMYKAEGVNPYASVLPLLIQLPVLWALFQALTRVSFLKVGTFLSLELSQPDPYYILPVLAALFTFLSTWLTNKAAVEKNIALTLMTYVMPFIILVTSFNFASGVVLYWTVSNAFQVFQILLLNNPYKIIKVREEAVRVAHEKEQRVKRAKRKASKKRK

SEQ ID NO: 10785 - DNA, 690 bp, Streptococcus agalactiae
atgaataaaatagctaatacagaagttgaaataaatatattcaaccttttaaaaaaattgtggaaaaagaaatttttaatcacatttgttgccattgcatttgcaacagctggacttttctatagtctttttattgttacgccacaatatacttcttcaacaaggatatatgtcattaaccctaatacccctaataatagtattactgcacaagatctacaagcggggagttttcttgcaaatgactataaggagattattacgtctactgacgttctagaaaaagttatttcttctgaaaaattgaattatccttcgtctcagttgttgcaaaaaataacagtttctattttaaaagatacacgtgttatttcaatatcggtcgaagatgctaatccaaaaatgtctcaaaaattagcaaattcagttagagaagcagcagtttcaaaaatcaaggcagttactcaagtagaggatatcactactcttgagaagggaaatttacctaaagcaccatcttctcctaatattaaaaagaatgtactaatcgggtttattgttggtgcaggattatcaactattgttttagttattatgggtattttggatgatcgtgttaatactgaagaagatattgaaaaggtsctaggacttacttctttaggtatagtaccagatttgaataaactt

SEQ ID NO: 10786 - protein, 230 aa, Streptococcus agalactiae; identical to SEQ ID NO: 2768

SEQ ID NO: 10787 - DNA, 669 bp, Streptococcus agalactiae
atgactttacaagacttaactaaaaagaatcaagagtttgttcatattgcaactaatcaacttttagctgatggaaaatcagatgcagaaatcaaagctattttagaagaacatctcccagagattatagataatcagaaaaaaggaattaccgcacgctcactcttaggagcaccaactacttgggcagcctcattcactgagcgacctgaggataaagctagagtatctgtacaaaaaaataccaatccttggttgatgtggttagatacttccttactatttcttggcttagtaactgctttgaatggtttaatgttgctatttggtcaatctaatgtcaatacagggcttatttcaattttaactcttggttttggtggtggtgcggccatgtacgttacttattactatatttatcgccatatgggtaaaccaaaatctgaaagaccaggctggcttaaatctttcgcagtactggcactagttatgttagtttggtttgccttatttgcagtagtacctcttctacctgcaactattaatcctaaacttcctgaggttgttttgtttattattgctttagcatcgtttggtttgcgcttttatttacaacgtaaatataatattcaaagctcaatggcaccagtggcaccmcaacaaagaaga

SEQ ID NO: 10788 - protein, 223 aa, Streptococcus agalactiae; identical to SEQ ID NO: 3552

SEQ ID NO: 10789 - DNA, 540 bp, Streptococcus agalactiae
atgtcaaaaaaaacmacacaaatggtttcttatacttctattttagtagcttttgcaatcatgattcctataatcatgcctgctaaaataattattgggcctgcttctttcaccttagcaagccatgtacctttatttttaagtatttttatatctgttccagttgcaatattggtagctttagggacaggacttggatttctactagctggttttccgattgtaatcgttcttagagctttatcacatatcggatttgcattaattgcggctttcttgattaagtcaaagccctctttattgatgagtaaatggcaaacattgttatttgctgtagctattaacataattcatggtctgctcgaatttattactgtttatataatcacaatgacttctaacagtagttcaacttatttatggtcactattttctttgataggactaggctctttgctacatggattggtagatttttacatagctctcttcatttggaaatggatgacacaaaagttggggaaaacacttaggataaga

SEQ ID NO: 10790 - protein, 180 aa, Streptococcus agalactiae; identical to SEQ ID NO: 8838

SEQ ID NO: 10791 - DNA, 198 bp, Streptococcus agalactiae
gtgggttcgattcctactgcccgtgttttttctaatatggcgggtgtggtgaagtggttaacacatcagattgtggctctgacattcgtgggttcgattcccatcactcgccttttcatggggtatagccaagcggtaaggcaagggactttgactccctcatgcgttggttcgaatccagctaccccagttttaaga

SEQ ID NO: 10792 - protein, 66 aa, Streptococcus agalactiae
MGSIPTARVFSNMAGVVKWLTHQIVALTFVGSIPITRLFMGYSQAVRQGTLTPSCVGSNPATPVLR

SEQ ID NO: 10793 - DNA, 1653 bp, Streptococcus agalactiae
atggcaaaacagaaaaataactggcgccgtgttggagttggtgtccttacacttgcttcagttgcgactcttgctgcatgtggaagtaaatcagcttcccaggattctaatggagcgattaattgggctattccaacagaaatcaatacactagatttatctaaagtcacagacacttactcaaatctagctattggtaactctagtagtaatttccttcgcttagataaagatggaaagacaagaccagatttggctactaaagtagatgtttcaaaagatggcttaacttatacagctacattacgtaaaggcttgaagtggtcagatggcagtaaacttactgcaaaggattttgtttattcatggcaacgtttagttgatcctaaaacagcttcacaatatgcttaccttgctgttgaagggcatgtgcttaatgccgataaaatcaacgaaggacaagagaaagacttgaataagctaggtgttaaggcggaaggcgatgacaaagttgttattactttatctagtccgtctccacaatttatctactaccttgcattcactaacttcatgccacaaaaacaagaagttgttgaaaaatatggaaaagattacgcaactacttcaaaaaatacagtttactcaggaccatatactgttgaaggttggaatggttcgaatggtactttcacgctgaagaaaaacaaaaattattgggacgctaaaaatgtaaaaacaaaagaagttcgcatccagactgttaaaaaaccagataccgccgttcaaatgtataaacgtggtgagttagatgcagctaatatctcaaatacttctgctatttatcaagctaataagaataataaagatgtcacagatgttctagaagcgaccactgcctatatggaatataatactactggttctgtgaaagggcttgataatgttaagattcgtcgcgccttaaacttagcaactaaccgtaaaggagttgttcaagcagccgttgatacaggctcaaaaccggcaattgcttttgcacctactggtttagccaaaacaccagatggaactgatttggcaaaatatgttgccccaggttatgaatataataaaactgaagcagcaaaactctttaaagaaggtttggctgaatcaggcttgactaagctaaaattaacaattacagcagatgctgatgctcctgctgccaaaaactctgttgactatatcaagtctacttgggaagctgctcttccaggacttactgttgaagaaaaatttgtaacctttaaacaacgcttagaagacagtagaaaacaaaactttgacatcgtagtttctctttggggtggggattatccagaaggatcaactttctacggcctctttaagtcagattcacaaaataacgatggaaaatttgctaacaaggactatgatgctgcttataacaaggcaatttctgaagatgcgatgaaaccagcagaatcagcgaaggactataaagaagcagagaaaattttatttgagcaaggtgcttataacccactctacttccgtagtggtaaaggtttacaaaatccaaaattaaaaggtgttattcgtaatactacaggtttgtcaatagactttacacatgcttataaaaaa

SEQ ID NO: 10794 - protein, 551 aa, Streptococcus agalactiae
MAKQKNNWRRVGVGVLTLASVATLAACGSKSASQDSNGAINWAIPTEINTLDLSKVTDTYSNLAIGNSSSNFLRLDKDGKTRPDLATKVDVSKDGLTYTATLRKGLKWSDGSKLTAKDFVYSWQRLVDPKTASQYAYLAVEGHVLNADKINEGQEKDLNKLGVKAEGDDKVVITLSSPSPQFIYYLAFTNFMPQKQEVVEKYGKDYATTSKNTVYSGPYTVEGWNGSNGTFTLKKNKNYWDAKNVKTKEVRIQTVKKPDTAVQMYKRGELDAANISNTSAIYQANKNNKDVTDVLEATTAYMEYNTTGSVKGLDNVKIRRALNLATNRKGVVQAAVDTGSKPAIAFAPTGLAKTPDGTDLAKYVAPGYEYNKTEAAKLFKEGLAESGLTKLKLTITADADAPAAKNSVDYIKSTWEAALPGLTVEEKFVTFKQRLEDSRKQNFDIVVSLWGGDYPEGSTFYGLFKSDSQNNDGKFANKDYDAAYNKAISEDAMKPAESAKDYKEAEKILFEQGAYNPLYFRSGKGLQNPKLKGVIRNTTGLSIDFTHAYKK

SEQ ID NO: 10795 - DNA, 309 bp, Streptococcus agalactiae
atgatgcaagagtactttggtattggtcttgatagtagcagccgctgttaccactatcatactaaattggatattgtcgctttaaaatgtgctgtttgtcaaaaatattatgcttgttataaatgtcatgatgcactcgaggagcattgttttgcagcaacaaaatctgatgaaacgtttcctgtcttatgcggttcttgtcgtcagatgttgacattaaaagagtataaaactggtttttgtccttattgtcgtatgctttttaatccaaattgtcaacgccatgattctatttatttttcgaaggag

SEQ ID NO: 10796 - protein, 103 aa, Streptococcus agalactiae
MMQEYFGIGLDSSSRCYHYHTKLDIVALKCAVCQKYYACYKCHDALEEHCFAATKSDETFPVLCGSCRQMLTLKEYKTGFCPYCRMLFNPNCQRHDSIYFSKE

SEQ ID NO: 10797 - DNA, 453 bp, Streptococcus agalactiae
ttggcagtcaacgaaccgcccgaagtattttggggatgtaggaggaagggagtcactatctcgcctcctctttttatagcttatttagattggagaacatttatgaacacacgtgtctttaaggacatctcaaaggttcaacacagggcatggctgggatttacaactagacaggttatttttgtatttccagctgtcgccctaaccattttggttttgggcttgaacctattttattggcaatttggggattggtttgtctatggttttgtttttagctttaccattccactcatgttatttggggtctatcgccccaacgatttaccatttgaaatatacctcaagtaccgttttcattatgaactaacggtgccagaccgcacatttactggaagaaaaggagaccaacgtgaaaaaattaaaacactcaatgaaatcaaagacctcttc

SEQ ID NO: 10798 - protein, 151 aa, Streptococcus agalactiae
MAVNEPPEVFWGCRRKGVTISPPLFIAYLDWRTFMNTRVFKDISKVQHRAWLGFTTRQVIFVFPAVALTILVLGLNLFYWQFGDWFVYGFVFSFTIPLMLFGVYRPNDLPFEIYLKYRFHYELTVPDRTFTGRKGDQREKIKTLNEIKDLF

SEQ ID NO: 10799 - DNA, 216 bp, Streptococcus agalactiae
gtgaacgtgaaaatgttacaatatcttgaggaggtgaaacatatgtcaaaaacagtagtacgtaaaaacgaatcacttgacgatgcacttcgtcgtttcaaacgttctgtgactaaagctggtactcttcaagaatcacgtaaacgtgaattctacgaaaaaccttctgtaaaacgtaaacgtaaatcagaagcagctcgcaaacgtaaaaaattc

SEQ ID NO: 10800 - protein, 72 aa, Streptococcus agalactiae
MNVKMLQYLEEVKHMSKTVVRKNESLDDALRRFKRSVTKAGTLQESRKREFYEKPSVKRKRKSEAARKRKKF

SEQ ID NO: 10801 - DNA, 801 bp, Streptococcus agalactiae
atgggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacatgaaccaatcagagctgaactcctggcttgaaatggacacggttattggacggattggtggaaaggtccttctcaccttcaatgtcgccttctgtaacttcatctttgccaaactgatggattctaagacagctatcgaaactgctaaacacatacaggtcattaagaggacactctatgataacaagagagacttcttcgaactctttcctgttatcctaacggataatggtggggaattcgctagagtggatgatattgagatagatgtttgtggacagtctcaactcttcttttgtgaccctaatcggtctgaccagaaagcaagaatcgagaagaatcataccctcgtgagagacatactgcctaaggggacttccttcgacaacttgactcaagaggacattaatctggcactatctcatatcaacagcgttaagagacaggctctaaatggtaaaacggcttatgagctattctcttttacttacggaaaagacatcgcaagtatactcggtattgaggaaattactgcggaagacgtctgccaatctcccaaactattaaaagacaaaatc

SEQ ID NO: 10802 - protein, 267 aa, Streptococcus agalactiae
MGVKKGQRIYHILKTNDLEVSSSTVYRHIKKGYLSITPIDLPRAVKFKKRRKSTLPPIPKAIKEGRRYEDFIEHMNQSELNSWLEMDTVIGRIGGKVLLTFNVAFCNFIFAKLMDSKTAIETAKHIQVIKRTLYDNKRDFFELFPVILTDNGGEFARVDDIEIDVCGQSQLFFCDPNRSDQKARIEKNHTLVRDILPKGTSFDNLTQEDINLALSHINSVKRQALNGKTAYELFSFTYGKDIASILGIEEITAEDVCQSPKLLKDKI

SEQ ID NO: 10803 - DNA, 123 bp, Streptococcus agalactiae
ttggagctggagacaatgacatttggtctagtttcaaccaatacatcacacttaaaagatgatgttttcacaccgtcaatggtaagttcattgatttttgtcatgccattcctcctctcaaat

SEQ ID NO: 10804 - protein, 41 aa, Streptococcus agalactiae
MELETMTFGLVSTNTSHLKDDVFTPSMVSSLIFVMPFLLSN

SEQ ID NO: 10805 - DNA, 237 bp, Streptococcus agalactiae
ttgccaatttctgtcttcgttctaccatcaggcttgttctcttcactaggtgagggttgcgatggttctgttgtaggtggattagttgacggatttgtttctggttcacttgatgaactcgattcattttcagaagaagaaccagtactagactggtctagttcatctgatcttttctcctcagataaggtcgtagtcacgacactcgtgtcagtattcttatcacttgtatcagca

SEQ ID NO: 10806 - protein, 79 aa, Streptococcus agalactiae
MPISVFVLPSGLFSSLGEGCDGSVVGGLVDGFVSGSLDELDSFSEEEPVLDWSSSSDLFSSDKVVVTTLVSVFLSLVSA

SEQ ID NO: 10807 - DNA, 210 bp, Streptococcus agalactiae
ttgtctatcaatttcttcgcttcttcaatattcatttgctacctccaaaaatacttcactgcattcattgtactcaattctataaccttttttgtcatttacccatttataaacatgattatccttgctattttagtcgctcatacgaaaaacgaatatgctttaaaaaatcttcaatgtcaattactgcacaaccatcaatgtcagacc

SEQ ID NO: 10808 - protein, 70 aa, Streptococcus agalactiae
MSINFFASSIFICYLQKYFTAFIVLNSITFFVIYPFINMIILAILVAHTKNEYALKNLQCQLLHNHQCQT

SEQ ID NO: 10809 - DNA, 171 bp, Streptococcus agalactiae
gtgctgtttcgaatggttccaaaacacaaaatcttttgttgctcctggacgtattgttttagagctgtgctgtttcgaatggttccaaaacatgtaaggtattgtaaaacttcttcttgcggttttagagctgtgctgtttcgaatggttccaaaacactgttcctataat

SEQ ID NO: 10810 - protein, 57 aa, Streptococcus agalactiae
MLFRMVPKHKIFCCSWTYCFRAVLFRMVPKHVRYCKTSSCGFRAVLFRMVPKHCSYN

SEQ ID NO: 10811 - DNA, 165 bp, Streptococcus agalactiae
atgtggataatactctttaaagtgtggataatactatattataaagctttttatctgatttttctgtattttgaaatcaaattatattttttaattttagtttatatttcaaaaattaaaacaccctataaccaagtatcacagggtgcatatttttatattata

SEQ ID NO: 10812 - protein, 55 aa, Streptococcus agalactiae
MWIILFKVWIILYYKAFYLIFLYFEIKLYFLILVYISKIKTPYNQVSQGAYFYII

SEQ ID NO: 10813 - DNA, 135 bp, Streptococcus agalactiae
atggttccaaaactggttatacatttactaatccatcagcattgttttagagctgtgctgtttcgaatggttccaaaacaagctaattctcatctcaccgagatggatagttttagagctgtgctgttattatgc

SEQ ID NO: 10814 - protein, 45 aa, Streptococcus agalactiae
MVPKLVIHLLIHQHCFRAVLFRMVPKQANSHLTEMDSFRAVLLLC

SEQ ID NO: 10815 - DNA, 360 bp, Streptococcus agalactiae
ttgcttaataaaacctatttaacgacagcaacaatgtcactttcgcgaacaactgtcactttttcgttaccgtctttaacttccagaccagcaccattttcgactaaaacagtatcaccctctgcaacgctcggtgcaactaattcccctgttaaggtacgaataccgtcacccacagcaagaactttggctgtctttgtcgcatcatggcttgctcctgcaagaacaaaaccaccgacagatttctcttcagtttcaacaaacgaaatgatcacacgatcacctaatggttttaacataataaacgaacctccatacgagatatattttgattttttagcactcttatacagagagtgc

SEQ ID NO: 10816 - protein, 120 aa, Streptococcus agalactiae
MLNKTYLTTATMSLSRTTVTFSLPSLTSRPAPFSTKTVSPSATLGATNSPVKVRIPSPTARTLAVFVASWLAPARTKPPTDFSSVSTNEMITRSPNGFNIINEPPYEIYFDFLALLYREC

SEQ ID NO: 10817 - DNA, 123 bp, Streptococcus agalactiae
atgaaaattcagaaaattgtagaaaattttgattttttatgttttaatagtttttgtaattattatgttacaagaaaaggagatttttatgaacacaaaacagcgtttttcaatccggaaata

SEQ ID NO: 10818 - protein, 41 aa, Streptococcus agalactiae
MKIQKIVENFDFLCFNSFCNYYVTRKGDFYEHKTAFFNPEI

SEQ ID NO: 10819 - DNA, 141 bp, Streptococcus agalactiae
atgataccgttttctaacttgaaaatcaacacttattttcaaatattttcaatttgtcaagaaatatgcttacaaagactatcaaaagaggttacctgggtaacctcttttactatttcttattttttcttaagttcacct

SEQ ID NO: 10820 - protein, 47 aa, Streptococcus agalactiae
MIPFSNLKINTYFQIFSICQEICLQRLSKEVTWVTSFTISYFFLSSP

SEQ ID NO: 10821 - DNA, 147 bp, Streptococcus agalactiae
atgatctttttaaaagtgataaagatgatttttgtccgataccaactttatagaggcccttttcgcattcaaactttgataggatatttggataataatagtcaaacatatggtcagaaagtaaaagccagtattgattgggataat

SEQ ID NO: 10822 - protein, 49 aa, Streptococcus agalactiae
MIFLKVIKMIFVRYQLYRGPFRIQTLIGYLDNNSQTYGQKVKASIDWDN

SEQ ID NO: 10823 - DNA, 180 bp, Streptococcus agalactiae
ttgtacaacttgtcaaaaccacattcaggacaacgttcaggtggtccgactgcttcaactttaaacatcatatcggtttcattttcttgtggcggttctattgttttaatgtctggtagggataataagtctgacatattattcatcctttattactctgcggtgttaaggtatcaatta

SEQ ID NO: 10824 - protein, 60 aa, Streptococcus agalactiae
MYNLSKPHSGQRSGGPTASTLNIISVSFSCGGSIVLMSGRDNKSDILFILYYSAVLRYQL

SEQ ID NO: 10825 - DNA, 180 bp, Streptococcus agalactiae; identical to SEQ ID NO: 10823

SEQ ID NO: 10826 - protein, 60 aa, Streptococcus agalactiae; identical to SEQ ID NO: 10824

SEQ ID NO: 10827 - DNA, 105 bp, Streptococcus agalactiae
ttgccaaaagctataaaacgattcccaaataatttcttagtggcttttcccttgtcaactgcaatgggatttatgtacaaacatttttcaaattcgtggaaaaag

SEQ ID NO: 10828 - protein, 35 aa, Streptococcus agalactiae
MPKAIKRFPNNFLVAFPLSTAMGFMYKHFSNSWKK

SEQ ID NO: 10829 - DNA, 105 bp, Streptococcus agalactiae
ttgataactgctattgataataatattattgttttggctggggtccaaggttcttgtttgcttaccattaaccgtccaggtatctaccctgtaatctggattatt

SEQ ID NO: 10830 - protein, 35 aa, Streptococcus agalactiae
MITAIDNNIIVLAGVQGSCLLTINRPGIYPVIWII

SEQ ID NO: 10831 - DNA, 168 bp, Streptococcus agalactiae
atggttccaaaacaaggtacttttagcttgttcttgtggtgttgttttagagctgtgctgtttcgaatggttccaaaacacagctactgtaaattctgcttttacggttgttttagagctgtgctgtttcgaatggttccaaaactagtgcagttgtcaaggagattg

SEQ ID NO: 10832 - protein, 56 aa, Streptococcus agalactiae
MVPKQGTFSLFLWCCFRAVLFRMVPKHSYCKFCFYGCFRAVLFRMVPKLVQLSRRL

SEQ ID NO: 10833 - DNA, 93 bp, Streptococcus agalactiae
ttggtagctattcaatacatgaaatccgttaattttttcttctctgtttgcaatcagtatttttataaatctatcattgcaatgctcagatgg

SEQ ID NO: 10834 - protein, 31 aa, Streptococcus agalactiae
MVAIQYMKSVNFFFSVCNQYFYKSIIAMLRW

SEQ ID NO: 10835 - DNA, 108 bp, Streptococcus agalactiae
ttggaccaaccaaaagtcaacaacagcccaactaaagctgtcaaaccagcatttcctaaaacttcaaaggacccccttaatcctaagagttttcttctttctttgcct

SEQ ID NO: 10836 - protein, 36 aa, Streptococcus agalactiae
MDQPKVNNSPTKAVKPAFPKTSKDPLNPKSFLLSLP

SEQ ID NO: 10837 - DNA, 141 bp, Streptococcus agalactiae
atgggcaattcatcaaaatccaacagaaaggaggagctagatttgtctacctttgaggtcttaacactcatgtttatagcaggtaacttcgttatcgctctcgtgaagttagtccttgaactggtaaaatcgacaaaaaaa

SEQ ID NO: 10838 - protein, 47 aa, Streptococcus agalactiae
MGNSSKSNRKEELDLSTFEVLTLMFIAGNFVIALVKLVLELVKSTKK

SEQ ID NO: 10839 - DNA, 171 bp, Streptococcus agalactiae
atgaatagtaatgtttttgtcatccaatccatcaatgcattaccgattgtctggataaagtcaaataaaccagaaaaagttttcgtaatccaattggtcgttgactctacaaatggtgcgaccggtaacttatgttgtaataaattttccaaaatgatttgtcctctctat

SEQ ID NO: 10840 - protein, 57 aa, Streptococcus agalactiae
MNSNVFVIQSINALPIVWIKSNKPEKVFVIQLVVDSTNGATGNLCCNKFSKMICPLY

SEQ ID NO: 10841 - DNA, 189 bp, Streptococcus agalactiae
atgttaggcagaggcgcaaaagcatatctcaacacaacacacaaagcagataatatagcgactctagtcaatttagttaaagttgaattctttatcatgtctttaattatacctcaaaactatgactaccgcttaaaagtcttttttattacaatttcatttctaatgttacataaacgacctcttttt

SEQ ID NO: 10842 - protein, 63 aa, Streptococcus agalactiae
MLGRGAKAYLNTTHKADNIATLVNLVKVEFFIMSLIIPQNYDYRLKVFFITISFLMLHKRPLF

SEQ ID NO: 10843 - DNA, 132 bp, Streptococcus agalactiae
atgatttatacttgttcctatcataataaaaggaagatagtttatgtcaaaaaaaataatattaggaattttatctcttttatctgtcgttactttggtggcgtgtggttcatcagacaaacagctacaaga

SEQ ID NO: 10844 - protein, 44 aa, Streptococcus agalactiae
MIYTCSYHNKRKIVYVKKNNIRNFISFICRYFGGVWFIRQTATR

SEQ ID NO: 10845 - DNA, 249 bp, Streptococcus agalactiae
gtgctgtttcgaatggttccaaaactaattgccaatgcttacaatatcttcgtcagttttagagctgtgctgtttcgaatggttccaaaacatgttctgaattacctttctcgacactccggttttagagctgtgctgtttcgaatggttccaaaacaccatcaaggctcttatctgcagattgttagttttagagctgtgctgtttcgaatggttccaaaacaaatggttgccaatgactttctagag

SEQ ID NO: 10846 - protein, 83 aa, Streptococcus agalactiae
MLFRMVPKLIANAYNIFVSFRAVLFRMVPKHVLNYLSRHSGFRAVLFRMVPKHHQGSYLQIVSFRAVLFRMVPKQMVANDFLE

SEQ ID NO: 10847 - DNA, 213 bp, Streptococcus agalactiae
atggtaagcaaacaagaaccttggaccccagccaaaacaataatattattatcaatagcagttatcaaagggaatcatctaactctagtattacgaaaccaagctatacaatcactatcgggaatcagaaacaaattgtacaaaatgatgacggtaaaatccaacggtcttactttgaggcagaggcaacgtatcaacgaactctacaagaag

SEQ ID NO: 10848 - protein, 71 aa, Streptococcus agalactiae
MVSKQEPWTPAKTIILLSIAVIKGNHLTLVLRNQAIQSLSGIRNKLYKMMTVKSNGLTLRQRQRINELYKK

SEQ ID NO: 10849 - DNA, 132 bp, Streptococcus agalactiae
atgtgcgatcacggacgttttagagctgtgctgtttcgaatggttccaaaacttttaccaatgcttccatatcgcttatatgttttagagctgtgctgtttcgaatggttccaaaactggttatacatttac

SEQ ID NO: 10850 - protein, 44 aa, Streptococcus agalactiae
MCDHGRFRAVLFRMVPKLLPMLPYRLYVLELCCFEWFQNWLYIY

SEQ ID NO: 10851 - DNA, 168 bp, Streptococcus agalactiae
atgtatggtaaaaagaattggtggcaggtgtattcttcatcagtttattttctgaaaaaagagtataatataggtatcaaaaatgaaaacgttttagagaaggagactagaatatggcttctacaaataatgtttcagatacaaacacacgttttgctaaagaggagt

SEQ ID NO: 10852 - protein, 56 aa, Streptococcus agalactiae
MYGKKNWWQVYSSSVYFLKKEYNIGIKNENVLEKETRIWLLQIMFQIQTHVLLKRS

SEQ ID NO: 10853 - DNA, 120 bp, Streptococcus agalactiae
gtggccgatcaccctctcaggtcggctatgtatcgtcgccttggtgagcctttacctcaccaactagctaatacaacgcaggtccatctcacagtgaagcaattgctccttttaaataac

SEQ ID NO: 10854 - protein, 40 aa, Streptococcus agalactiae
MADHPLRSAMYRRLGEPLPHQLANTTQVHLTVKQLLLLNN

SEQ ID NO: 10855 - DNA, 120 bp, Streptococcus agalactiae; identical to SEQ ID NO: 10853

SEQ ID NO: 10856 - protein, 40 aa, Streptococcus agalactiae; identical to SEQ ID NO: 10854

SEQ ID NO: 10857 - DNA, 120 bp, Streptococcus agalactiae; identical to SEQ ID NO: 10853

SEQ ID NO: 10858 - protein, 40 aa, Streptococcus agalactiae; identical to SEQ ID NO: 10854

SEQ ID NO: 10859 - DNA, 120 bp, Streptococcus agalactiae; identical to SEQ ID NO: 10853

SEQ ID NO: 10860 - protein, 40 aa, Streptococcus agalactiae; identical to SEQ ID NO: 10854

SEQ ID NO: 10861 - DNA, 120 bp, Streptococcus agalactiae; identical to SEQ ID NO: 10853

SEQ ID NO: 10862 - protein, 40 aa, Streptococcus agalactiae; identical to SEQ ID NO: 10854

SEQ ID NO: 10863 - DNA, 120 bp, Streptococcus agalactiae; identical to SEQ ID NO: 10853

SEQ ID NO: 10864 - protein, 40 aa, Streptococcus agalactiae; identical to SEQ ID NO: 10854

SEQ ID NO: 10865 - DNA, 120 bp, Streptococcus agalactiae; identical to SEQ ID NO: 10853

SEQ ID NO: 10866 - protein, 40 aa, Streptococcus agalactiae; identical to SEQ ID NO: 10854

SEQ ID NO: 10867 - DNA, 102 bp, Streptococcus agalactiae
gtgatttttctttacaaatttttatcaagcgtaagtattcattggtttcaagaaattttatctctatttacgccccttattttttgctttaaccttagtgaa

SEQ ID NO: 10868 - protein, 34 aa, Streptococcus agalactiae
MIFLYKFLSSVSIHWFQEILSLFTPLIFCFNLSE

SEQ ID NO: 10869 - DNA, 117 bp, Streptococcus agalactiae
gtgggtatgggtatcaaatatttttatcatatcatcgttctttctttgcttatcgtagctacaagcattaatctttattattataacataagactgaagcattctgatcagaaagag

SEQ ID NO: 10870 - protein, 39 aa, Streptococcus agalactiae
MGMGIKYFYHIIVLSLLIVATSINLYYYNIRLKHSDQKE

SEQ ID NO: 10871 - DNA, 381 bp, Streptococcus agalactiae
gtgctgtttcgaatggttccaaaacgcgatgatggtaagtcatcatggacagcgtgttttagagctgtgctgtttcgaatggttccaaaacttttacacacgatgtcagatataatgtcaagttttagagctgtgctgtttcgaatggttccaaaacagtactgcactaggaattgtagagatcaaagttttagagctgtgctgtttcgaatggttccaaaaccgtaccatctatcaatttaccgcaagctgtgttttagagctgtgctgtttcgaatggttccaaaacttaaaagatttaaactatcaagcgtcaattgttttagagctgtgctgtttcgaatggttccaaaacttctaaatgctggtgactgctttgca

SEQ ID NO: 10872 - protein, 127 aa, Streptococcus agalactiae
MLFRMVPKRDDGKSSWTACFRAVLFRMVPKLLHTMSDIMSSFRAVLFRMVPKQYCTRNCRDQSFRAVLFRMVPKPYHLSIYRKLCFRAVLFRMVPKLKRFKLSSVNCFRAVLFRMVPKLLNAGDCFA

SEQ ID NO: 10873 - DNA, 114 bp, Streptococcus agalactiae
ttgaaaaaaatagtttctatgagaatctttttcttgacaataaaatttagctattataaaatagttctcacgataactaaaataatgattttttcagaaaataatattatttct

SEQ ID NO: 10874 - protein, 38 aa, Streptococcus agalactiae
MKKIVSMRIFFLTIKFSYYKIVLTITKIMIFSENNIIS

SEQ ID NO: 10875 - DNA, 96 bp, Streptococcus agalactiae
ttggtgatagaatttccattttaccaattgctatcaaagtgctataataatagagttaaaattaagattgcttgccaatatgagccagcaggttat

SEQ ID NO: 10876 - protein, 32 aa, Streptococcus agalactiae
MVIEFPFYQLLSKCYNNRVKIKIACQYEPAGY

SEQ ID NO: 10877 - DNA, 102 bp, Streptococcus agalactiae
atgttatttggttcttttttgttgaggagacaaggagaggtcttgatacaggtggttaaaatgagaggagtatttattaaagtatgctatactattttagta

SEQ ID NO: 10878 - protein, 34 aa, Streptococcus agalactiae
MLFGSFLLRRQGEVLIQVVKMRGVFIKVCYTILV

SEQ ID NO: 10879 - DNA, 108 bp, Streptococcus agalactiae
gtgttattatttcaatctcaaactttattaaatagttcaaggataggagaatattatgaaagaaaagaaaaatttggggataaaattaataaaatccctatatggtat

SEQ ID NO: 10880 - protein, 36 aa, Streptococcus agalactiae
MLLFQSQTLLNSSRIGEYYERKEKFGDKINKIPIWY

SEQ ID NO: 10881 - DNA, 252 bp, Streptococcus agalactiae
atgattgtttgtgatttcactaactatattaactatatcatagctatttgcaaaaggaaaattggaaaaaattatataagtatagcttttactaatattattgtggaaataatcataaaggtcagattgatagacttgtgctatactattactaagaaaaaaggacagatattatggatattagacaacttacttactttattgctgttgcagaagcaaaaaattattcacgcgctgcaaaaagtctttttg

SEQ ID NO: 10882 - protein, 84 aa, Streptococcus agalactiae
MIVCDFTNYINYIIAICKRKIGKNYISIAFTNIIVEIIIKVRLIDLCYTITKKKGQILWILDNLLTLLLLQKQKIIHALQKVFL

SEQ ID NO: 10883 - DNA, 123 bp, Streptococcus agalactiae
atgaggataccttcatatttttcattccacttttcttctttaacttcaaaggaagaataccattccctaagtagctcaactatttctataactatccctcctttatcttcaaatcaatatgat

SEQ ID NO: 10884 - protein, 41 aa, Streptococcus agalactiae
MRIPSYFSFHFSSLTSKEEYHSLSSSTISITIPPLSSNQYD

SEQ ID NO: 10885 - DNA, 90 bp, Streptococcus agalactiae
ttggctatttttttcttagtaataagcgaagaagtcataatttctcctttattttatattgaattgctgatgatttattatggtttagtg

SEQ ID NO: 10886 - protein, 30 aa, Streptococcus agalactiae
MAIFFLVISEEVIISPLFYIELLMIYYGLV

SEQ ID NO: 10887 - DNA, 135 bp, Streptococcus agalactiae
atgctggtgactgctttgcataaagttttagagctgtgctgtttcgaatggttccaaaacttgctgctagacccaaacagtttatttttaggttttagagctgtgctgtttcgaatggttccaaaactccttttt

SEQ ID NO: 10888 - protein, 45 aa, Streptococcus agalactiae
MLVTALHKVLELCCFEWFQNLLLDPNSLFLGFRAVLFRMVPKLLF

SEQ ID NO: 10889 - DNA, 105 bp, Streptococcus agalactiae
atgtcatcagttatcatcactctttttatgatagttaagatttttaaactatcatcttttgaaaaacatttcatcttgactatttctgttaataaatcagctcca

SEQ ID NO: 10890 - protein, 35 aa, Streptococcus agalactiae
MSSVIITLFMIVKIFKLSSFEKHFILTISVNKSAP

SEQ ID NO: 10891 - DNA, 108 bp, Streptococcus agalactiae
ttgaagattaagaaaaacaaggttttaatattatattatcagcgagtaggagatggtgagagccctacaatccctaatattgaaattatcattttcaatcattctacc

SEQ ID NO: 10892 - protein, 36 aa, Streptococcus agalactiae
MKIKKNKVLILYYQRVGDGESPTIPNIEIIIFNHST

SEQ ID NO: 10893 - DNA, 102 bp, Streptococcus agalactiae
atgttagccaatcttaaggataataattccaataaaaaaaggctaaccaaagttagtctccctttatctactccgccagtaggactcgaacctacgacatca

SEQ ID NO: 10894 - protein, 34 aa, Streptococcus agalactiae
MLANLKDNNSNKKRLTKVSLPLSTPPVGLEPTTS

SEQ ID NO: 10895 - DNA, 108 bp, Streptococcus agalactiae
ttgataaataatatttttgacaacttttttcattataacaagaaaaaagtaggagaacaattacttaactggttaattagaaaatttgttattttatcattaataact

SEQ ID NO: 10896 - protein, 36 aa, Streptococcus agalactiae
MINNIFDNFFHYNKKKVGEQLLNWLIRKFVILSLIT

SEQ ID NO: 10897 - DNA, 108 bp, Streptococcus agalactiae
atggtgaaaactgtttcttatcccaaagatttatggtttccaaaatatccctcgctttgttactatccttgcaaacctgaaaaatttcgtcataaactgttgaaaaaa

SEQ ID NO: 10898 - protein, 36 aa, Streptococcus agalactiae
MVKTVSYPKDLWFPKYPSLCYYPCKPEKFRHKLLKK

SEQ ID NO: 10899 - DNA, 93 bp, Streptococcus agalactiae
atgactactttatcagaattgcaagaaaaagcaacatgtcaaatatgcttctacatggacttgatggcgaaaaatcaattttgttatcagcaa

SEQ ID NO: 10900 - protein, 31 aa, Streptococcus agalactiae
MTTLSELQEKATCQICFYMDLMAKNQFCYQQ

SEQ ID NO: 10901 - DNA, 147 bp, Streptococcus agalactiae
atgtctcctctctttaagagtgaaagaaaaataaaaaataatttgattatcaaattatcatgctttgtattttatcataaacctagctttcatggcaagataaaaaataaaaaaacggaattaaacttcccgtttttaatagttatc

SEQ ID NO: 10902 - protein, 49 aa, Streptococcus agalactiae
MSPLFKSERKIKNNLIIKLSCFVFYHKPSFHGKIKNKKTELNFPFLIVI

SEQ ID NO: 10903 - DNA, 102 bp, Streptococcus agalactiae
ttgaataccattgcaaattggattttatttctgagagtaggttataaaagatggtatgctcttattccggttctttcaggttttagaaaacatgagagaact

SEQ ID NO: 10904 - protein, 34 aa, Streptococcus agalactiae
MNTIANWILFLRVGYKRWYALIPVLSGFRKHERT

SEQ ID NO: 10905 - DNA, 147 bp, Streptococcus agalactiae
ttgggtttaacaactagcaataacactccgctgattgtatcactattttctttaaaagttattttgtctagtattatgtccggtgtagcttacaatggagttatgtatctaatatttaaaaacaatgttgatattgaaaaagatgaa

SEQ ID NO: 10906 - protein, 49 aa, Streptococcus agalactiae
MGLTTSNNTPLIVSLFSLKVILSSIMSGVAYNGVMYLIFKNNVDIEKDE

SEQ ID NO: 10907 - DNA, 177 bp, Streptococcus agalactiae
ttgctaagagcaattgtcaaaatttctcagtctatgctagaagagttcttcttaatcccaatatgtcatttgtcacgattaacacggattggaaataacatcaatcaaattgcgcgtgctatcaaccaaagccatctaatttctcaggctcagtatcactttcatcgagaagcacgt

SEQ ID NO: 10908 - protein, 59 aa, Streptococcus agalactiae
MLRAIVKISQSMLEEFFLIPICHLSRLTRIGNNINQIARAINQSHLISQAQYHFHREAR

SEQ ID NO: 10909 - DNA, 195 bp, Streptococcus agalactiae
gtgaatcgtcttagagaatacagaattaaagctagcatatctcaattagctttagcaaaatcagttggtgtcgccagacaaacaataaaccttattgaaaataataaatacaatccttcgctagatctttgtataagactagcggaatgcctacaaacagacctcaatactcttttttgggatagtagacatcta

SEQ ID NO: 10910 - protein, 65 aa, Streptococcus agalactiae
MNRLREYRIKASISQLALAKSVGVARQTINLIENNKYNPSLDLCIRLAECLQTDLNTLFWDSRHL

SEQ ID NO: 10911 - DNA, 201 bp, Streptococcus agalactiae
ttgtgtcgtgttttacgtgtcaatcgctccacttactataaatttctaaaacataagccctcaaaaagagaattggataatcaaatttatagaaaacaaatacttgagatttataccaaagcgaacaaaagacttggtgtgaagtctatcaaggtcattcttcaaagagactatgacacaaaaatctctgaaggaagaatt

SEQ ID NO: 10912 - protein, 67 aa, Streptococcus agalactiae
MCRVLRVNRSTYYKFLKHKPSKRELDNQIYRKQILEIYTKANKRLGVKSIKVILQRDYDTKISEGRI

SEQ ID NO: 10913 - DNA, 216 bp, Streptococcus agalactiae
atggcattgaccccgttggacactgcatttttcgccccatctattgcattggaaatagtggattttatggaattccaaatattgcttgctgttgaaagtatcccattaaaaattcctgaaatcgtgctactcaaattattaaacaaatttgacccagttgagaccagtccagaccacaaattggaaagagtggaagtgaaacttgaccacagagac

SEQ ID NO: 10914 - protein, 72 aa, Streptococcus agalactiae
MALTPLDTAFFAPSIALEIVDFMEFQILLAVESIPLKIPEIVLLKLLNKFDPVETSPDHKLERVEVKLDHRD

SEQ ID NO: 10915 - DNA, 240 bp, Streptococcus agalactiae
ttggagttaatagtgagtaaaaaagataagaaaattgaaattcaaatttcagacgctcaagtaacagttaatggaactaaggttgatggataccaactcgttattggaaaaaaaattgtaggtcaaattgcagagctagattctaaatttgctgtgattaaaggtgagcaagtgagtggattctataaaaatttagatcaagctatgggaaatattattgaagaatataatcttaatcgc

SEQ ID NO: 10916 - protein, 80 aa, Streptococcus agalactiae
MELIVSKKDKKIEIQISDAQVTVNGTKVDGYQLVIGKKIVGQIAELDSKFAVIKGEQVSGFYKNLDQAMGNIIEEYNLNR

SEQ ID NO: 10917 - DNA, 303 bp, Streptococcus agalactiae
ttgttggaattatgttataatcttagtaattacagatatgacgcagaaaggaaaaaattattgaataaacaagagcgtttaggaatgagcgtttatctttactataatcgtgacgctcgtaaattatataaatacggagatgttcattatcattctcgtagattaagatatctagtcatttatgttaataaagaggatattgttagcgttagtaaagagataaaacatttaaaatttgttaaggatgttcggttatcagcaattgatgatattgatcaggattttgttggaaacttatatcgt

SEQ ID NO: 10918 - protein, 101 aa, Streptococcus agalactiae
MLELCYNLSNYRYDAERKKLLNKQERLGMSVYLYYNRDARKLYKYGDVHYHSRRLRYLVIYVNKEDIVSVSKEIKHLKFVKDVRLSAIDDIDQDFVGNLYR

SEQ ID NO: 10919 - DNA, 354 bp, Streptococcus agalactiae
gtgaaaaagaacatcgaatctggtgttgctcatattcacgctacattcaataacactattgttatgattacagatgtgcatggtaacgctcttgcatggtcatcagctggtgctcttggatttaaaggttctcgtaaatctactccatttgctgctcaaatggctgctgaagctgctgctaaatctgcacaagaacacggtcttaaaactgttgaagttactgtaaaaggtcctggttcaggtcgtgaatctgctatccgtgcccttgctgcagctggtcttgaagtaactgcaattcgtgatgtgactcctgtaccacataatggtgctcgtcctccaaaacgtcgtcgtgta

SEQ ID NO: 10920 - protein, 118 aa, Streptococcus agalactiae
MKKNIESGVAHIHATFNNTIVMITDVHGNALAWSSAGALGFKGSRKSTPFAAQMAAEAAAKSAQEHGLKTVEVTVKGPGSGRESAIRALAAAGLEVTAIRDVTPVPHNGARPPKRRRV

SEQ ID NO: 10921 - DNA, 408 bp, Streptococcus agalactiae
ttgccttaccaaagagctgcaagcctatatattcgcttttctgttttcgttatcgaaagaaatataaaaatggaagaagaattcgatgataatgacgagcaagatactatttatgctgttctttatgatgggaaacagccagtttcaacaggacgctttcttcctgaaactcaaacagaagctcgtttgactcgaattgcgactttaaaaggttatcgtggtaacggctatggtaccaaaattattatagcactagaaaattatgcaaaagaaaatggttatcactatctaactatacatgctgaattgacagcaaaagatttctaccagacacttgggtatcaagctactgggaatatttatatggaagacggggaagcctgtcaaacactcgaaaaatatttaatt

SEQ ID NO: 10922 - protein, 136 aa, Streptococcus agalactiae
MPYQRAASLYIRFSVFVIERNIKMEEEFDDNDEQDTIYAVLYDGKQPVSTGRFLPETQTEARLTRIATLKGYRGNGYGTKIIIALENYAKENGYHYLTIHAELTAKDFYQTLGYQATGNIYMEDGEACQTLEKYLI

SEQ ID NO: 10923 - DNA, 501 bp, Streptococcus agalactiae
ttgaaattaaataaaataatattatctactgcagctcttactgctctctttttaggatataatagcgttactgcggatacatataataactatcagccacatagatcaaataatatggatttaactgaggaatataactataataaccagatagaacttcaggagcgtataaaaaaactaaatataccttttaaagaaaaacttgccttacttagaaaggttaaatcaagacaagattcttatgtattagacacattaagaaaagaagttgaaaataaaaacagtgagtattcagaactagagcaagaatatcaaagaatttcagctcttattgatgctaagtttccgcaagggaaatctagtttagcagaaaaattacataaagaactaatttgggacttggatggtgttaaatatgatgagggtatttctaagagaactgctctaaaaaaattagaaggtaaaatcaacgaatatactaaaaaatacagttatttattc

SEQ ID NO: 10924 - protein, 167 aa, Streptococcus agalactiae
MKLNKIILSTAALTALFLGYNSVTADTYNNYQPHRSNNMDLTEEYNYNNQIELQERIKKLNIPFKEKLALLRKVKSRQDSYVLDTLRKEVENKNSEYSELEQEYQRISALIDAKFPQGKSSLAEKLHKELIWDLDGVKYDEGISKRTALKKLEGKINEYTKKYSYLF

SEQ ID NO: 10925 - DNA, 495 bp, Streptococcus agalactiae
ttgataaccttaaaatctcaacctcaagcttacaaatcagaagttgactgtaaacttttagaggcttttataaaaactaaagcttatcaaaatagttgtgtaattgctacttacctatcttttgactacgaatacaatacacaacttcttattaaacaagctttatgtgatggcaaacgtgtccttgttcccaaaacttatccaaaaggtaaaatgatttttgtggactatcaaaaagataacttgaggacaacaccgtttggcttattagaacctgttaatgatagagctgttgaaaaagctagtatagacttaattcatgtgcccggacttatctttaacaataaaggttttcgtataggttatggtgcaggttattttgatcgctatttgagtgattttgaaggtgatactattagtactatttataggtgtcagagacaggattttgtagaagagaagcatgacgtagcagttaaggaggtattatgtcta

SEQ ID NO: 10926 - protein, 165 aa, Streptococcus agalactiae
MITLKSQPQAYKSEVDCKLLEAFIKTKAYQNSCVIATYLSFDYEYNTQLLIKQALCDGKRVLVPKTYPKGKMIFVDYQKDNLRTTPFGLLEPVNDRAVEKASIDLIHVPGLIFNNKGFRIGYGAGYFDRYLSDFEGDTISTIYRCQRQDFVEEKHDVAVKEVLCL

SEQ ID NO: 10927 - DNA, 507 bp, Streptococcus agalactiae
ttgatagacaaacagtctattggtaaaggtggtgtcggcgacattccagtagtgaaaacacatattgtaaaagtattactcgaccagattgaccaacctcaaccagaagtgccacggtttgtggctgattggtacgagaagcataaagatagcttagagtgcgatttatatttatatcacatgtcgatatacgatgaagaagtcgaaaaagatgacttctattactggatgcaaacatcaaaaaatccagtctacacacttattaatatgcaccaattcggctacaccatccaaaaagagaagctgtatacggttgagatacctaatccgaatgaaagacagttaagttttgtgctgatgagacaacttagcggaaatgtaagtatcaaagttatgcatagagataacttagacttactaaagacagataatgatttacaactaacagaatccgaaatccgcaaagatttcgactgggcgtggcagtttagagaagaggtggtggaa

SEQ ID NO: 10928 - protein, 169 aa, Streptococcus agalactiae
MIDKQSIGKGGVGDIPVVKTHIVKVLLDQIDQPQPEVPRFVADWYEKHKDSLECDLYLYHMSIYDEEVEKDDFYYWMQTSKNPVYTLINMHQFGYTIQKEKLYTVEIPNPNERQLSFVLMRQLSGNVSIKVMHRDNLDLLKTDNDLQLTESEIRKDFDWAWQFREEVVE

SEQ ID NO: 10929 - DNA, 468 bp, Streptococcus agalactiae
ttgtgtgttgtgttgagatatgcttttgcgcctctgcctaacattcagccaattactgccatttttttgattacagttgtcttattcgatttaaaagaaggtgtagctactgtaactataacaatgctagtttcttcttttttaatgggctttgggccatgggtctttttgcaaatcatttccttcactttaattttatgcttgtggaaatttctgatatatccgctgacaaaagctgtatgttttggtaaaataacggaggtagtacttcaaactttctttgcaggagggttaggggttgtttatggcgtcattattgatacctgttttgcttggttatatcatatgccttggtggacttatgtattagcaggacttagttttaatatggcacacgctttatcaacttgtttattttatcctcttttgttaccgattttaaggagatttaggaatgaaaaaatacat

SEQ ID NO: 10930 - protein, 156 aa, Streptococcus agalactiae
MCVVLRYAFAPLPNIQPITAIFLITVVLFDLKEGVATVTITMLVSSFLMGFGPWVFLQIISFTLILCLWKFLIYPLTKAVCFGKITEVVLQTFFAGGLGVVYGVIIDTCFAWLYHMPWWTYVLAGLSFNMAHALSTCLFYPLLLPILRRFRNEKIH

SEQ ID NO: 10931 - DNA, 474 bp, Streptococcus agalactiae
gtgaatttaccgtctactgaaccacctttgatttcaagagcttctgcatctttagcgaaatcgctaataactttagctggtgcaataacatcttcgttagaaaacgcaactgctgatggaccaacaaaaagttctttaaggtcttcaagacctgctttttcagctgcacgagttaaaattgagtttttgataactttaaactcaacatcgctttcacgaagtgaacgacgtaagttagtatcttgctcaacagtaagaccacgtgaatcaacaacaacgatacttgctgctgctttcattttctcagcaataagttcaacttgttcagctttttttgcaataattgcttcactcattagttttacctccgtttttattttttgggataagcacaaaaaaatcgcacctaaacctagacacgaaagtacaatacgttattttataatgacgttttgtgcctcggtaggaatatta

SEQ ID NO: 10932 - protein, 158 aa, Streptococcus agalactiae
MNLPSTEPPLISRASASLAKSLITLAGAITSSLENATADGPTKSSLRSSRPAFSAARVKIEFLITLNSTSLSRSERRKLVSCSTVRPRESTTTILAAAFIFSAISSTCSAFFAIIASLISFTSVFIFWDKHKKIAPKPRHESTIRYFIMTFCASVGIL

SEQ ID NO: 10933 - DNA, 603 bp, Streptococcus agalactiae
gtggcgcgcgatccatatagtgatagatcgagatatttagatccaaaagttctatcatcctcttttggcgccttttttccagcagataatattaaggtagcttggtctaacaactccagcactttatttacaccacctattaatgcaaactacaccactcagattcaagctattgggacaacgattaagtcacaaattccggaatcgattttgacggttacggataaaaagagcaggaagttcagcattaacaagattgacgaagctaaagaaggcttagtaggtgcgaccttcaccttgtctaaacgcacaacagtagcggcagatcatcaagtacaaggagatttcattcctgtcagcaaagagacgacagtcggtcggacaacccttacctttgacaaccttaaacctggattttatgaccttaaagaaacgaaagcgccgaatgcttacgtacttgatcctaagacttatgttgtggtcgttcaaaattcaggaaaaacgacaattgtggatgaagctaacttcaaagaggctgattacccaatggctgataataccagccatgtggagtgcgtagcgttgctacaacgaagcaaaggg

SEQ ID NO: 10934 - protein, 201 aa, Streptococcus agalactiae
MARDPYSDRSRYLDPKVLSSSFGAFFPADNIKVAWSNNSSTLFTPPINANYTTQIQAIGTTIKSQIPESILTVTDKKSRKFSINKIDEAKEGLVGATFTLSKRTTVAADHQVQGDFIPVSKETTVGRTTLTFDNLKPGFYDLKETKAPNAYVLDPKTYVVVVQNSGKTTIVDEANFKEADYPMADNTSHVECVALLQRSKG

SEQ ID NO: 10935 - DNA, 576 bp, Streptococcus agalactiae
gtgcaatcgaatagacaccgtggactaattgagaagccttatcatatcactttaattgagccaagcgatgaagaaatttatcgcttttctgctcttttgaaccgtgaaaagttttggttggaaaatgaacaggaaccaactattaggctttggtgttataaggttgatagctttgagattggaaaagacgaatttggtgcctgggtggtcgatgttaccttcatctgccaccctaccaagtttttcaagaccactgacatccagacattgactggtaatggggttttgagggttcaagggtcagctcttgcttttccgaagattacagtggttggtcagagcgcttctgagacatcgtttacgataggtaaccaagtgattaagcttgaaaagctctcagaatcgctcgtgatgaccaatgatcctgacaatcctagctttaagacggctagtggaaaactcattaagtgggctggtgattttatcacagttgatactgctaaggggcagaatgtcggtgttgttttaggtgctggcataacatctttgaaatttgaaacagtttgggggtgggca

SEQ ID NO: 10936 - protein, 192 aa, Streptococcus agalactiae
MQSNRHRGLIEKPYHITLIEPSDEEIYRFSALLNREKFWLENEQEPTIRLWCYKVDSFEIGKDEFGAWVVDVTFICHPTKFFKTTDIQTLTGNGVLRVQGSALAFPKITVVGQSASETSFTIGNQVIKLEKLSESLVMTNDPDNPSFKTASGKLIKWAGDFITVDTAKGQNVGVVLGAGITSLKFETVWGWA

SEQ ID NO: 10937 - DNA, 762 bp, Streptococcus agalactiae; identical to SEQ ID NO: 10777

SEQ ID NO: 10938 - protein, 254 aa, Streptococcus agalactiae; identical to SEQ ID NO: 10778

SEQ ID NO: 10939 - DNA, 681 bp, Streptococcus agalactiae
gtgagtccagattatgctccctttgagtttaaagcgcttgttaatgggaaagataaagttgtcggcgcagatattgagttagctcaagctattgctgatgagcttcatgtcaaactagaggtatctcctatgagttttgacaatgttttatcaagtttacaaacaggtaaggctgatatggctatttctggattatcatatactaaagagcgtgctaaagtctatgatttttcaaaaccttattacactacagaaaatgcggttcttgttaggaagtctgatttaggaaaatatacttcaatcgaaagccttaaaggtaaaaaaatagcagtacaaaaaggaagtatcgaagagggagtttctaagaaatcattcaaaaattctcacgtcgtgtcactgacagcgatgggagaagcgattagtgagttaaaatcaggcaaggtagaagctgttgatttagaaaaaaccgtagctgaaggttacttggcccagaatccagaccttgttcttgctaagtttgcccttaaaacaggagaaggggatgctaaggctgtagctttacctaaagacagtggaaaaatgttgaagactgttaacaaagtgataaagagacttgaaaaagaagataaatataaagtttatatttcagatgcggctaaattaactggcaatcaagttgaa

SEQ ID NO: 10940 - protein, 227 aa, Streptococcus agalactiae
MSPDYAPFEFKALVNGKDKVVGADIELAQAIADELHVKLEVSPMSFDNVLSSLQTGKADMAISGLSYTKERAKVYDFSKPYYTTENAVLVRKSDLGKYTSIESLKGKKIAVQKGSIEEGVSKKSFKNSHVVSLTAMGEAISELKSGKVEAVDLEKTVAEGYLAQNPDLVLAKFALKTGEGDAKAVALPKDSGKMLKTVNKVIKRLEKEDKYKVYISDAAKLTGNQVE

SEQ ID NO: 10941 - DNA, 690 bp, Streptococcus agalactiae
gtgtgtcaaaacattgcatggcctaaactgagtgctcaaacgaaaattataattgattatttttctactttaactgtttcagacttagaggatatctacagaattaatacaagtgcagctcgttgtgaggctcaaagatggcaagattttaaagctaaacaacttactctgaatcctgctattaagttattcaacggtcttatgtaccgcaatatcaaaaggcacaacttatccacaagtgaagcacaatttatggaaaattctgtttttattactagtgctctttatggcatcattcctgctatgacactaatatcccctcatcgtttagattttaacactaaaatcaaaatcaacaataactctcttaaagttttttggcgtgaaaattacgatacttttatgcagtcagatgacattatggtttctttgctttctaatgaatttgaaactgtcttttctcctaaagagcgtcaaaaactaatacatcttaactttattgaagatcgagatggccaattaaaaacccactctaccatatcaaaaaaagcaagaggaaagtgtttaactgctatgatggaaaataattgccaaactctagaacacttaaagcaattacgctttgatggcttctgttatgataatgaactctcagactctaagcaattaacttttgttaaaaaacagact

SEQ ID NO: 10942 - protein, 230 aa, Streptococcus agalactiae
MCQNIAWPKLSAQTKIIIDYFSTLTVSDLEDIYRINTSAARCEAQRWQDFKAKQLTLNPAIKLFNGLMYRNIKRHNLSTSEAQFMENSVFITSALYGIIPAMTLISPHRLDFNTKIKINNNSLKVFWRENYDTFMQSDDIMVSLLSNEFETVFSPKERQKLIHLNFIEDRDGQLKTHSTISKKARGKCLTAMMENNCQTLEHLKQLRFDGFCYDNELSDSKQLTFVKKQT

SEQ ID NO: 10943 - DNA, 954 bp, Streptococcus agalactiae
ttggtagaacgtacacttcgtccgcagtatttaagagagtatattggacaagataaggttaaagatcagctaaaaatatttattgaagctgctaaattgcgtgatgagtcattggatcatgtgttattatttggccctcctggtttagggaaaacaaccatggcatttgtaattgctaatgagttgggtgtcaatctcaaacaaacatcaggtcccgcaattgaaaaatcaggggatttagtagccattttaaatgatttagaaccaggtgatgttctttttattgatgaaattcatcgtatgccgatggcggttgaagaggtactttatagtgcaatggaagacttctatattgacattatgatcggtgcaggagaaactagtagaagtgttcatctagatttgccgccctttaccttaattggtgcaacgacacgtgcaggtatgttatctaatcccttacgtgctcgctttggtattacagggcatatggagtattatgaagaaaatgatttgacagaaattattgagcgtacagcagacatttttgaaatgaaaattacttatgaagctgcttctgaattagcgcgtcgcagtcgtggaacgccacgtatcgctaaccgtttattgaaacgtgttcgagattatgctcaaatcatgggagatggtttgatagatgacaatattacagataaagcattaacgatgttagatgttgatcacgaggggcttgattacgtcgatcaaaaaatcttaagaaccatgattgaaatgtataatggaggtcctgttggtttaggaactctatccgttaatattgctgaagaacgagatactgttgaagacatgtacgaaccttatttaattcaaaaaggttttattatgcgtacccgtaccggtcgtgtagctacggttaaggcatatgaacatttaggttatcagcgatttgataaa

SEQ ID NO: 10944 - protein, 318 aa, Streptococcus agalactiae
MVERTLRPQYLREYIGQDKVKDQLKIFIEAAKLRDESLDHVLLFGPPGLGKTTMAFVIANELGVNLKQTSGPAIEKSGDLVAILNDLEPGDVLFIDEIHRMPMAVEEVLYSAMEDFYIDIMIGAGETSRSVHLDLPPFTLIGATTRAGMLSNPLRARFGITGHMEYYEENDLTEIIERTADIFEMKITYEAASELARRSRGTPRIANRLLKRVRDYAQIMGDGLIDDNITDKALTMLDVDHEGLDYVDQKILRTMIEMYNGGPVGLGTLSVNIAEERDTVEDMYEPYLIQKGFIMRTRTGRVATVKAYEHLGYQRFDK

SEQ ID NO: 10945 - DNA, 1233 bp, Streptococcus agalactiae
ttgaaaaaaattattacttctattctattacttagttgcattttttttatgccaaccatctctgctgaatcttttaatgcttccgctaaacatgccttggcagttgatttagattcaggaaaaatcttgtatgaaaaagatgctaacaaacccgctgctattgcttccttgactaaaataatgaccgtttatatggtctataaagaaattgataacggtaacctcaagtggaataccaaagtaaatatatctgactacccttatcaactaacacgcgaatctgatgctagtaatgttcctttagaaaaaaggcgctatactgttaaacagctcgtggacgctgccatgatttctagtgctaacagtgcagccattgctttggctgaacatatttcaggaaccgaaagtaaatttgttgataaaatgactgctcaattggaaaagtggggaattcatgatagccacctagtcaatgcttctggcttaaataatagtatgttaggcaatcacatttatccaaaatcgtcacaaaacgacgaaaataaaatgagtgcacgtgatattgctattgttgcctaccatttggtcaacgaatatccttccattcttaagattactagtaagtccgttgctaaatttgataaagatattatgcattcttataactacatgctaccagatatgcctgtctttagaccaggtattacaggtttgaaaactgggacaacggaattagctggccaatcttttattgctacatctactgaaagtggaatgagactactcactgttattatgcatgctgataaggccgataaagacaaatatgctcgctttacagcaactaactctctcttgaactatatcacaaacacctacgaacctaaccttgtattagctaaaggagctgcatataaaggtaaagaagcaagtgtgagagacggaaaagaacaatcggtcatcgctgttgctaaaaacgatttgaaagtagtacagaagaaaaatatcactaaacaaaatcagttaaaaattaactttaaaaaagagcttactgctcctattacaaaaaaagagaacctagggaaagcttattacgttgaccttaataaggttggaaaaggctatctcataaaggaacctagcgttcatttagtggcaaaagatagtattgagcgcagtttcttcctcaaagtgtggtggaatcattttgtgcgctacgttaacgaaaaactt

SEQ ID NO: 10946 - protein, 411 aa, Streptococcus agalactiae
MKKIITSILLLSCIFFMPTISAESFNASAKHALAVDLDSGKILYEKDANKPAAIASLTKIMTVYMVYKEIDNGNLKWNTKVNISDYPYQLTRESDASNVPLEKRRYTVKQLVDAAMISSANSAAIALAEHISGTESKFVDKMTAQLEKWGIHDSHLVNASGLNNSMLGNHIYPKSSQNDENKMSARDIAIVAYHLVNEYPSILKITSKSVAKFDKDIMHSYNYMLPDMPVFRPGITGLKTGTTELAGQSFIATSTESGMRLLTVIMHADKADKDKYARFTATNSLLNYITNTYEPNLVLAKGAAYKGKEASVRDGKEQSVIAVAKNDLKVVQKKNITKQNQLKINFKKELTAPITKKENLGKAYYVDLNKVGKGYLIKEPSVHLVAKDSIERSFFLKVWWNHFVRYVNEKL

SEQ ID NO: 10947 - DNA, 1041 bp, Streptococcus agalactiae; identical to SEQ ID NO: 8531

SEQ ID NO: 10948 - protein, 347 aa, Streptococcus agalactiae
MNRKIIGLTLLSLSVLTLTACGNRSDKSANKSDIKVAMVTNQGGVDDKSFNQSAWEGLQKWGKKKGLTKGNGFDYFQSSNESDHANNLDTAASSGYNLIFGIGFGLHDTIEKVSENNKDVKYVIVDDIIKGKENVASVTFADNEAAYLAGVAAAKTTKTKTVGFIGGMEGVVVKRFEAGFKAGVKSIDPAIKVAVSYAGSFTDAAKGKTIAATQYATGVDVIYQAAGGTGAGIFSEAKTENETRKESNKVWVIGVDRDQSQEGNYVSKDGKKANFVLASTIKEVGKSLQSVAELTEKKQYPGGKVTVFGLKDSGVDIKEHQLSSEGSVAVKKAKEDIVSGKIQVPMK

SEQ ID NO: 10949 - DNA, 909 bp, Streptococcus agalactiae
ttgacagcgacagctgaatctattgaacaagtaaagcaattgctagcaataggaattgaccgcatctatgtaggggaagaaaattacggtcttcgtttaccacattcattttcagacgatgaattgcgtgaaatcgctaaattagtacatgatgctggtaaagaattgacagtagcttgtaatgcactcatgcatcaagagatgatggataatatcaaaccatttttggagttgatgaaagaaattaatgtggattatttggtagttggtgatgcaggagtattttatatcaacaagcgtgatggttataacttcaaacttatctacgacacttctgtcttcgttacatcaagtcgtcaagttaatttttggggacaacatggagcagtagaaacggttttagcacgtgaaataccttctgaagaactttttaagatgtctgagaatcttgaatttcctgctgagattttagtttatggggcttctgtaattcatcactctaagcgtccgttattgcaaaactattataattttactcatatcactgatgaaaaaacacgtgagcgtggtctttttttagcagaaccaggtgatccagaaagtcactattctatttacgaagataagcatgggactcatatttttattaacaatgatatcaatatgatgactaaagtgactgaactagttgaacatcactttactcactggaaattagatggtatttattgtccaggagataattttgttgctattgctgaaatttttgtcgaaacagctcgtttgattgaaaatggaacattcactcaggatcaggctttcttgtttgatgaacgaattagaaaactgcaccctaaaggacgtggtttagatactggattttatgattttgacccatcaacagtaaaa

SEQ ID NO: 10950 - protein, 303 aa, Streptococcus agalactiae
MTATAESIEQVKQLLAIGIDRIYVGEENYGLRLPHSFSDDELREIAKLVHDAGKELTVACNALMHQEMMDNIKPFLELMKEINVDYLVVGDAGVFYINKRDGYNFKLIYDTSVFVTSSRQVNFWGQHGAVETVLAREIPSEELFKMSENLEFPAEILVYGASVIHHSKRPLLQNYYNFTHITDEKTRERGLFLAEPGDPESHYSIYEDKHGTHIFINNDINMMTKVTELVEHHFTHWKLDGIYCPGDNFVAIAEIFVETARLIENGTFTQDQAFLFDERIRKLHPKGRGLDTGFYDFDPSTVK

SEQ ID NO: 10951 - DNA, 927 bp, Streptococcus agalactiae; identical to SEQ ID NO: 10781

SEQ ID NO: 10952 - protein, 309 aa, Streptococcus agalactiae; identical to SEQ ID NO: 10782

SEQ ID NO: 10953 - DNA, 1434 bp, Streptococcus agalactiae
gtgcgttatgcaccaagtccaacaggattgttacacatcggaaatgcgcgtactgcgctctttaactacctttatgctcgccatcatggtggggattttgttattcgtattgaagatactgaccgaaaacgccacgtcgaagatggtgaacgctctcaattggagaacttacgttggctaggtatggactgggatgaaagtcctgaaacacatgaaaattatcgtcaatcagaacgccttgagctctaccaacgttatattgatcagttgttagcagaaggtaaagcctacaagtcctatgtgactgaggaagaattagcagcagagcgtgaacgccaagaattggcaggcgaaacacctcgctatatcaacgaatttatcggaatgtcagaaactgaaaaagaagcttacattgcagagcgtgaagcagcaggcatcattccgacagtacgccttgctgttaatgaatctgggatttataaatggactgatatggtaaaaggtgacattgagtttgaaggctctaatatcggcggagactgggttattcagaagaaagatggttatccaacttacaatttcgcagtagtcattgatgatcatgacatgcaaatttcgcatgttatccgtggcgatgaccatattgcaaatacgccaaaacaattaatggtttatgaagcactcggttgggaagcgccacaatttggtcacatgacattgattataaactcagagactggtaagaaattatcaaaacgcgacaccaatactcttcaatttatcgaagactatcgtaaaaaaggttatatgtcggaagctgtctttaatttcattgcccttcttggctggaatcctggtggagaagaagaaatcttctcacgcgagcaattaattaatctatttgatgaaaatcgtcttagcaaatcaccagcagcattcgatcagaagaaaatggattggatgagtaatgattacctaaaaaatgctgattttgagagtgtttttgcactttgcaaaccattcttagaagaagctggtcgacttacagacaaagctgaaaaattagttgagctttatcaacctcaattaaaatcagctgatgagattgtaccattaacagaccttttctttgcagattttccagaactaacagaagccgaaaaagaagtaatggcagctgaaacagtcccaacagtcttatctgcttttaaggaaaagttagtatcgctttctgacgaagaattcactagagatactattttccctcaaattaaggctgttcaaaaagaaacaggtattaaaggtaagaacctatttatgcctattcgtattgcggtttctggtgaaatgcatggaccagagttaccagatactatttatttattaggtaaagaaaaatcagttcaacatatcgataatatgttagcaaaatta

SEQ ID NO: 10954 - protein, 478 aa, Streptococcus agalactiae
MRYAPSPTGLLHIGNARTALFNYLYARHHGGDFVIRIEDTDRKRHVEDGERSQLENLRWLGMDWDESPETHENYRQSERLELYQRYIDQLLAEGKAYKSYVTEEELAAERERQELAGETPRYINEFIGMSETEKEAYIAEREAAGIIPTVRLAVNESGIYKWTDMVKGDIEFEGSNIGGDWVIQKKDGYPTYNFAVVIDDHDMQISHVIRGDDHIANTPKQLMVYEALGWEAPQFGHMTLIINSETGKKLSKRDTNTLQFIEDYRKKGYMSEAVFNFIALLGWNPGGEEEIFSREQLINLFDENRLSKSPAAFDQKKMDWMSNDYLKNADFESVFALCKPFLEEAGRLTDKAEKLVELYQPQLKSADEIVPLTDLFFADFPELTEAEKEVMAAETVPTVLSAFKEKLVSLSDEEFTRDTIFPQIKAVQKETGIKGKNLFMPIRIAVSGEMHGPELPDTIYLLGKEKSVQHIDNMLAKL

SEQ ID NO: 10955 - DNA, 1830 bp, Streptococcus agalactiae; identical to SEQ ID NO: 10775

SEQ ID NO: 10956 - protein, 610 aa, Streptococcus agalactiae; identical to SEQ ID NO: 10776

SEQ ID NO: 10957 - DNA, 1371 bp, Streptococcus agalactiae; identical to SEQ ID NO: 10779

SEQ ID NO: 10958 - protein, 457 aa, Streptococcus agalactiae; identical to SEQ ID NO: 10780

SEQ ID NO: 10959 - DNA, 2724 bp, Streptococcus agalactiae
gtggttgagcaagctcaatcgcttggcttacctgtaaaaagtcatgcttctagcgttgaagaaaatgatgctacacgtattgttgagagttttagctcttctaaaactaaagctccaacaaattctgttcaaactaatcaaggtgtgaaaacagaatctaaaactgttgaaaccaaacaaggcttgtccgatgataaaccttcaactcaacctgtagctaaaccgaaaccacaaagtcgtaactttaaggcggagcgcgaggctcgtgctaaagctgaagcggagaagcgtcaacataatggggatcaccgtaagaataatcgccataatgatacacgctctgacgacagacgccatcaaggtcaaaagcgttcaaatggtaatcgtaatgataaccgacaaggtcagcaaaataaccgtaataaaaatgatgggcgttatgctgatcataaacagaaaccccaaacgcgtcctcagcaacctgcaggcaatcgcattgactttaaagctcgagcagcagctttgaaagctgagcaaaatgctgaatactcacgtcatagtgagcagcgtttccgtgaagagcaagaagccaaacgtcaagcagctaaggagcaagaactagctaaagcagcagcgttaaaagcgcaagaagaagctcaaaaagctaaggaaaaacttgcttctaaacctgttgctaaggtaaaagaaattgtcaataaagtagccgctacgccatcacagacagcagatagtcgtcgtaaaaaacaaactcgttctgataagtctcgtcaattttcaaatgaaaatgaagatggacaaaagcaaacaagaaataagaaaaactggaataatcaaaaccaagtgagaaatcaaagaaatagtaactggaatcataataagaaaaataaaaaaggtaagactaatggagctccaaaaccagtaacagagcgtaaattccatgaattaccaaaagaatttgaatatactgagggcatgaccgttgcggaaattgcaaaacgtattaaacgcgaaccagcggaaattgttaaaaaactctttatgatgggagttatggcaacgcagaatcaatcattagatggagacactattgagctattgatggttgactacgggattgaagcacatgctaaggttgaagttgatgaagctgatattgaacgcttctttgcagatgaggattaccttaatcctgataacttaacggaacgtccgcctgttgttactatcatgggacacgttgatcatggtaaaacaactcttcttgatactctacgtaattcacgtgtcgctactggcgaagctggtggaattactcaacatattggtgcttatcagattgaagaagctggcaagaaaattactttcttggatacaccagggcatgcggcctttacttctatgcgtgcgcgtggtgcatcagtaactgatattactatccttatcgttgccgctgatgatggtgttatgccgcagacagttgaggcaattaatcactctaaagctgcgggtgtcccaattattgttgctatcaacaaaattgataaacctggtgcaaatccagaacgcgttatcagtgaattagctgagcatggtgtcatctctactgcatggggtggtgagtctgaatttgttgaaatttcagctaagtttggtaaaaatattcaagaattacttgagacagttcttttagttgctgaaatggaagaattaaaagcagatgcagatgttcgtgctattggtactgttattgaagcccgtcttgataaaggtaagggagccgttgcaacgcttcttgtccaacaaggtactttaaatgtacaagatccaatcgttgttggtaatacatttggacgtgttcgtgcgatgactaatgatcttgggcgtcgtgtcaaagttgcgggtccatctacaccagtttctattactggtttgaacgaagctccaatggctggtgatcattttgctgtttatgcagatgagaaagctgcgcgtgctgcaggtgaagaacgtgcaaaacgtgctctcttaaaacaacgccaaaacacgcaacgtgttagcctcgagaacttatttgatacccttaaagctggtgaagttaagtcagttaatgttattatcaaagctgatgtgcaaggttctgtagaagcacttgcagcttctctccttaagattgatgttgaaggagtaaaagttaacgttgttcactcagcagttggtgctattaatgagtctgatgtaacacttgctgaagcatcaaatgctgttattataggatttaacgtacgccctactccacaagctcgtcaacaagcagatgctgatgatgtcgaaattcgtcaacatagcattatctataaagttatcgaagaagttgaagaagcgatgaaaggtaaacttgatcctgaataccaagaaaaaatccttggtgaagccattattcgtgagacctttaaagtttcaaaagtgggaactattggtggatttatggttatcaatggtaaagttactcgtgattcaagtgttcgtgttatccgtgatggtgttgtcatttttgatggtaaattagcaagtcttaaacactataaagatgatgttaaagaagtcggcaatgctcaagaaggtggtctaatgattgagaattataacgatctcaaagaagatgacactattgaagcatacattatggaagaaattaaacgtaaa

SEQ ID NO: 10960 - protein, 908 aa, Streptococcus agalactiae
MVEQAQSLGLPVKSHASSVEENDATRIVESFSSSKTKAPTNSVQTNQGVKTESKTVETKQGLSDDKPSTQPVAKPKPQSRNFKAEREARAKAEAEKRQHNGDHRKNNRHNDTRSDDRRHQGQKRSNGNRNDNRQGQQNNRNKNDGRYADHKQKPQTRPQQPAGNRIDFKARAAALKAEQNAEYSRHSEQRFREEQEAKRQAAKEQELAKAAALKAQEEAQKAKEKLASKPVAKVKEIVNKVAATPSQTADSRRKKQTRSDKSRQFSNENEDGQKQTRNKKNWNNQNQVRNQRNSNWNHNKKNKKGKTNGAPKPVTERKFHELPKEFEYTEGMTVAEIAKRIKREPAEIVKKLFMMGVMATQNQSLDGDTIELLMVDYGIEAHAKVEVDEADIERFFADEDYLNPDNLTERPPVVTIMGHVDHGKTTLLDTLRNSRVATGEAGGITQHIGAYQIEEAGKKITFLDTPGHAAFTSMRARGASVTDITILIVAADDGVMPQTVEAINHSKAAGVPIIVAINKIDKPGANPERVISELAEHGVISTAWGGESEFVEISAKFGKNIQELLETVLLVAEMEELKADADVRAIGTVIEARLDKGKGAVATLLVQQGTLNVQDPIVVGNTFGRVRAMTNDLGRRVKVAGPSTPVSITGLNEAPMAGDHFAVYADEKAARAAGEERAKRALLKQRQNTQRVSLENLFDTLKAGEVKSVNVIIKADVQGSVEALAASLLKIDVEGVKVNVVHSAVGAINESDVTLAEASNAVIIGFNVRPTPQARQQADADDVEIRQHSIIYKVIEEVEEAMKGKLDPEYQEKILGEAIIRETFKVSKVGTIGGFMVINGKVTRDSSVRVIRDGVVIFDGKLASLKHYKDDVKEVGNAQEGGLMIENYNDLKEDDTIEAYIMEEIKRK

SEQ ID NO: 10961 - DNA, 2793 bp, Streptococcus agalactiae
ttgtcccacccgaaattagaaagtagtagcaataaagaaatcattaccgaagaggtcggtttactgaagcagcttttggatgaagcaacgcaaaaattgattggtagtgaatcatttgacaagattgaaaaaatagtttcattatcattaactgacgattatactggtctgaaggaaactatttcggctttaagcaacgaggagatggttattgtttctcgttacttctctattttgccgctcttaattaatatttcagaagacgttgatttagcatatgaaattaattataaaaataatcttaaccaagattacctaggaaagttatcaacgactattgatgttgtagctggccatgaaaatgctaaagatattcttgaacacgtcaatgttgtgcctgtgctaacagctcatcctactcaggtgcagcgtaaaacggtgctcgaattaacgtctaagattcatgatttattacgtaaatacagagatgtcaaggcaggaatcgtgaatcaagaaaaatggtatgctgacttgcgtcgttacatcggcattatcatgcaaacagacactattcgcgagaaaaaattgaaagtcaaaaatgagataaccaatgtaatggaatattacaaccgttctcttattaaagcagttaccaaattaacagcagaatataaggcactggcagctaaaaaaggtattcacttggagaatcctaagcctctgactatggggatgtggattggtggtgatagagatggcaatccctttgtaactgctgagacactaagattatcagctatggtacaaagtgaagtgattattaaccattatattgagcagctaaatgaactttatcgtaatatgtcactttcaataaatctaactgaagtctctcccgaacttgttacattggcaaaccagtcacaagataattcggtatatagggaaaatgaaccttaccgtaaagctttcaattttatccaagataaactggtacaaaccctactaaatttaaaagttggttcttccccaaaagagaaatttgttagtcgccaagaatcttctgatattgtaggaaggtatataaaatcacatatcgctcaagtagcttctgacatacagacagaagaactaccagcatacgctactgctgaggagtttaaacaagatttgttacttgtgaagcaatctttagttcaatatggacaagattctcttgttgatggcgaattagcttgtcttattcaagcagtagatatctttggattttatttagctactattgatatgcgtcaagattctagtattaatgaagcttgtgtagcagaattattgaagtctgccaatattgtagatgattacagttctctttcagaagaagaaaaatgtcaacttctcttaaaagaattaacagaagatcctagaacattatcttctacgcatgctcctaaatccgagttacttcaaaaagaattggctattttccaaacagcacgtgagttaaaagatcaattgggtgaagacattataaaccagcatatcatttctcacacagagagcgtttcggatatgtttgagttagctatcatgttaaaagaagttggactaattgatgccaatcaagctcgtattcagattgtaccgttatttgaaaccatcgaagatttggataattcacgtgatattatgacccagtatctacattatgaattagttaaaaaatggattgctactaacaacaattatcaagaaataatgctaggttattcagatagtaataaagatggtggctatttatcatctggttggactctatataaagctcaaaatgagctaacaaaaataggtgaagaaaacggtattaaaatcacatttttccacggtcgtggtggaactgttggtcgtggtggtggtccatcttatgaagctatcacatcacaaccttttggttcaatcaaagatcgaattcgcctaacagagcaaggtgaaatcattgagaataaatatggtaatcaagatgcagcctattataaccttgaaatgcttatttcagcttccatagaccgcatggtaacacgtatgattactaaccctaatgaaattgataatttccgtgagacaatggatggtattgtgtctgaaagtaatgccgtttatagaaatttagtttttgataatccttatttctatgactatttctttgaagcaagtccaattaaagaggtatcaagtttaaatattggttctcggccagcagcacgtaaaacaattacagaaatttcaggtttacgtgcaattccatgggtattttcatggtcacaaaatcgtattatgtttccaggatggtatggtgttggatcagccttcaagcactttattgaacaagatgaggcaaacttagcaaaattacaaaccatgtatcaaaaatggccattctttaattctcttttatctaatgtagatatggttttatcaaaatcaaatatgaatattgcgcttcagtatgctcagttagctggaagtaaagaagttcgagatgtttttaatatcatccttaatgaatggcagttaactaaagatatgattttagctattgaacagcatgataatttattagaagaaaacccaatgttacatgcaagtttagattatcgtttgccatatttcaatgttttgaattatgttcaaattgaattgattaaacgtcttcgtagtaaccaactagatgaagactatgagaagttgattcatattactattaatggtattgcaacaggtttacgaaattcaggt

SEQ ID NO: 10962 - protein, 931 aa, Streptococcus agalactiae
MSHPKLESSSNKEIITEEVGLLKQLLDEATQKLIGSESFDKIEKIVSLSLTDDYTGLKETISALSNEEMVIVSRYFSILPLLINISEDVDLAYEINYKNNLNQDYLGKLSTTIDVVAGHENAKDILEHVNVVPVLTAHPTQVQRKTVLELTSKIHDLLRKYRDVKAGIVNQEKWYADLRRYIGIIMQTDTIREKKLKVKNEITNVMEYYNRSLIKAVTKLTAEYKALAAKKGIHLENPKPLTMGMWIGGDRDGNPFVTAETLRLSAMVQSEVIINHYIEQLNELYRNMSLSINLTEVSPELVTLANQSQDNSVYRENEPYRKAFNFIQDKLVQTLLNLKVGSSPKEKFVSRQESSDIVGRYIKSHIAQVASDIQTEELPAYATAEEFKQDLLLVKQSLVQYGQDSLVDGELACLIQAVDIFGFYLATIDMRQDSSINEACVAELLKSANIVDDYSSLSEEEKCQLLLKELTEDPRTLSSTHAPKSELLQKELAIFQTARELKDQLGEDIINQHIISHTESVSDMFELAIMLKEVGLIDANQARIQIVPLFETIEDLDNSRDIMTQYLHYELVKKWIATNNNYQEIMLGYSDSNKDGGYLSSGWTLYKAQNELTKIGEENGIKITFFHGRGGTVGRGGGPSYEAITSQPFGSIKDRIRLTEQGEIIENKYGNQDAAYYNLEMLISASIDRMVTRMITNPNEIDNFRETMDGIVSESNAVYRNLVFDNPYFYDYFFEASPIKEVSSLNIGSRPAARKTITEISGLRAIPWVFSWSQNRIMFPGWYGVGSAFKHFIEQDEANLAKLQTMYQKWPFFNSLLSNVDMVLSKSNMNIALQYAQLAGSKEVRDVFNIILNEWQLTKDMILAIEQHDNLLEENPMLHASLDYRLPYFNVLNYVQIELIKRLRSNQLDEDYEKLIHITINGIATGLRNSG

SEQ ID NO: 10963 - DNA, 2553 bp, Streptococcus agalactiae
gtggctattgtttctaatagcttagagctaggtcttgccatttggatggttaatgtgattaatggtatttttagtttcattcaggaataccgtgcaagccaagcaacacaagctctcgagaaaatgttaccatcttattcacgtgttcttagaaaaggctcagaagaaaagatattatcagagcaactagtcccaggcgatattgttcttattgaagaaggagaccgtatttcagcagatggtcgcttgattaaaacaacagatttgcaagtaaaccaatcagccttgacaggggaatcaaatcctatttataaagatagcaatgttgaaaacgaccagtctaaaacattgattgaatgtgataatatggttttcgcaggaacgacggtctccagtggtagcgcaacaatggttgttacggcaattggaatgcaaactcaatttggtcaaatcgctgatttaacacaagggatgaaatcagaaaaaagccctcttcaaagagaacttgatcggttgaccaaacagatttctatcatttcaattacggtaggaattatctttttcttagcagcgactttttttgttaaggagccagtgtcaaaatcatttatctttgccttggggatgatcgttgcatttatcccagaaggtttactacctaccgttacactttctctagctatggcagtccaacgaatggctaaagaacacgcacttgtcaaaaaactttcttcagttgagactcttggagcaacctcagttatctgttctgataagactggtacattaacgcaaaatgaaatgaccgtcaatcatttgtggcaaaatggaaagagttaccaagtgacaggactgggttatgctccagaaggacagattctttttgaaggtgacaatatttgctttggtaatagtgatagaggagacttagaaaaacttattcgttttgctcatctctgtagcaacgctcaagtattaccaccaaatgatgatcgttcaacttatactgtacttggagatccgacagaagcttgtttgaatgttttattggaaaaatcagggataaacatacaagaaaatcgtaagtttgcaccacgtttgaaagaattaccttttgattcggttagaaaacgcatgacaactattcatagcttaggaggcgatgaaaaggataaaaaaatttcaattacaaaaggtgcgccgaaagaaatacttgatttatcagattatgtcttatctgatggcaaagttatccccttaaacaaggaagaacgtaataaaatacagttggctaacgatacatttgctaaagatggacttcgcgtcttagctgtttcatactgcgatattgaaggcttttcaaaagaacaatggacgcaagaaaatttggaacaacacatggtgtttatagggttgatagcaatgagtgatccacctcgtgaaggcgttcgcgaagctattgataaatgtcatgcagcaagcattcgtattattatggtgactggagattacggattaacggcactaagtatcgctaaaaatattggtattattcgtaacgatgatgctaaagtaatttcaggtttagagttatcagaaatgacggatagccaattgaaaaaagaattgtcaggtgaagtcgtttttgctcgtgtagcaccagaacaaaaatatcgagtagtaacgatattacaggagatgggtgaagtagtagcagttacaggagacggggtcaatgatgcgcctgcgctaaaaaaatccgatattggtgtagccatgggtgttaccggtactgatgttgctaaagaatcagctgatatgattctgacagatgatcattttgcttctattgtacatgctgtggaagaaggacgggctgtttatcaaaacattaagaaattcttgacgtatatttttaatagtaatactcctgaggctgttccgtcggcattcttccttttttctaaaggttttattcctttaccattgactgtaatgcaaatacttgctgttgatttgggaaccgatatgcttcccgctttaggtctgggcgtggaaccaccagaaacagacgttatgaatcgtcctccaagacggctaacagatcgcttattggacaaagggctacttataaaatctttcctttggtacggcactattgaatccgtattagctatgggtggttttttctgggctcattacttacgttatggtaattttacttttttcgtcgcaaacggcataccgtacagagaagcgacaactatgacacttggagctattatctttagccagataggtatggttatgaatagcagaacgagctatcaatctattaaagcactatctatttttggtaataaattaattaattttggtataataatggagattttagcatttttagtcttagtatacgtgccactattccataacttattcaacacagcaagcctaggtttatcacattggctctatttaataagctgcccatttatcatgataggtttagatgaagttcggaaattattcagcagtagaaagaataaacgg

SEQ ID NO: 10964 - protein, 851 aa, Streptococcus agalactiae
MAIVSNSLELGLAIWMVNVINGIFSFIQEYRASQATQALEKMLPSYSRVLRKGSEEKILSEQLVPGDIVLIEEGDRISADGRLIKTTDLQVNQSALTGESNPIYKDSNVENDQSKTLIECDNMVFAGTTVSSGSATMVVTAIGMQTQFGQIADLTQGMKSEKSPLQRELDRLTKQISIISITVGIIFFLAATFFVKEPVSKSFIFALGMIVAFIPEGLLPTVTLSLAMAVQRMAKEHALVKKLSSVETLGATSVICSDKTGTLTQNEMTVNHLWQNGKSYQVTGLGYAPEGQILFEGDNICFGNSDRGDLEKLIRFAHLCSNAQVLPPNDDRSTYTVLGDPTEACLNVLLEKSGINIQENRKFAPRLKELPFDSVRKRMTTIHSLGGDEKDKKISITKGAPKEILDLSDYVLSDGKVIPLNKEERNKIQLANDTFAKDGLRVLAVSYCDIEGFSKEQWTQENLEQHMVFIGLIAMSDPPREGVREAIDKCHAASIRIIMVTGDYGLTALSIAKNIGIIRNDDAKVISGLELSEMTDSQLKKELSGEVVFARVAPEQKYRVVTILQEMGEVVAVTGDGVNDAPALKKSDIGVAMGVTGTDVAKESADMILTDDHFASIVHAVEEGRAVYQNIKKFLTYIFNSNTPEAVPSAFFLFSKGFIPLPLTVMQILAVDLGTDMLPALGLGVEPPETDVMNRPPRRLTDRLLDKGLLIKSFLWYGTIESVLAMGGFFWAHYLRYGNFTFFVANGIPYREATTMTLGAIIFSQIGMVMNSRTSYQSIKALSIFGNKLINFGIIMEILAFLVLVYVPLFHNLFNTASLGLSHWLYLISCPFIMIGLDEVRKLFSSRKNKR

SEQ ID NO: 10965 - DNA, 4650 bp, Streptococcus agalactiae
ttgggaaccctattttttttaggtggtatcacaaatgtagctgctgattctgtcataaataagccatctgatattgcagttgaacagcaagtaaaagacagtccaacgagcatagcaaatgagacacctactaacaacacgtcatcagcccttgcgtcgacagctcaagacaatcttgttacaaaggctaataatagtccaacagaaacacaaccagtagctgagtctcactctcaagccaccgagacattttccccagtcgcaaatcaaccggttgaaagcactcaagaagtttctaaaactcctttaaccaaacaaaatttagcagtcaaatctacaccagctatttctaaagaaacccctcaaaacattgatagtaataaaattatcactgtccccaaagtatggaacacaggctacaaaggagagggaactgttgtagcaattattgactcaggactagatatcaatcacgatgctctccaattaaatgattcgacaaaagcaaaataccaaaacgaacagcaaatgaatgctgctaaagcaaaagctggtataaactatggaaaatggtataacaacaaagtaatctttggtcacaactatgttgatgtcaatacagagctaaaagaggtgaaaagcacttctcatggtatgcacgtaaccagtatcgcaacagctaatcctagcaagaaagatacaaatgaattaatctatggtgttgctcctgaagcacaagtaatgtttatgagagtcttctctgatgaaaaaagaggaactggaccagccctttatgttaaagctattgaagatgccgttaaactcggtgctgacagcattaatttaagtttaggtggagctaatgggtctttagttaatgccgatgaccgacttataaaagctttagagatggctagactcgctggcgtttctgttgttatagcagcaggtaacgacggtacatttgggagtggagcatcaaagccttctgctctttatcctgattatggtttagttggtagtccatcaacagctcgtgaggccatttctgtagcatcatataataatacaacactggttaataaagtcttcaacattatcggattagaaaacaacagaaatctcaacaacggattagctgcttatgcagatcctaaagttagtgataagacctttgaagtagggaaacaatatgattatgttttcgtaggaaaaggaaacgacaatgattataaggacaaaactttaaatggtaaaatcgccttaattgaacgtggagatattacttttacaaaaaaagtcgtcaatgctattaatcacggtgctgtgggagctattatctttaataacaaagctggggaagctaatctaacaatgagtttagatcctgaagcaagtgctattcctgctatttttacccaaaaagagtttggagatgttttagctaaaaacaactataaaattgtatttaacaatatcaaaaataaacaagccaaccctaatgcaggtgtcctatctgacttttcaagctgggggttaacagcagacggacaattaaaacctgacttatctgctcctggaggctctatttacgccgctatcaatgataatgaatatgatatgatgagtgggacaagtatggcttctccccatgtcgctggtgctactgctctagttaaacaatacttattgaaagaacatccagaacttaaaaaaggtgacattgaaagaactgtcaaataccttcttatgagtactgctaaagcacacctaaacaaagatacaggcgcttacacctcaccacgccaacaaggagcaggtattatcgatgtcgcagcagcagttcagacaggattatacctaactggtggggaaaacaactatggcagcgttacattaggaaatattaaagataaaatttcctttgatgttactgttcataatatcaataaagttgcaaaagatttacactatacaacctatttaaatactgatcaagttaaagatggctttgtcacattggctcctcaacaacttggtacatttacagggaaaacgatacggattgaaccagggcaaacccaaacgattacaattgatatagatgtttcgaaataccatgacatgttaaaaaaagtaatgccaaacggctatttcctagaaggctacgtacgttttacagaccctgttgatggtggggaagttcttagtattccttatgttggatttaagggagaattccaaaacttagaagttttagaaaaatccatttataagcttgttgctaacaaagaaaagggattttatttccaaccaaaacaaacaaacgaagttcctggttcagaagattatactgccttaatgactacaagttcagagcctatctactcaacagacggtactagtcctatccaattgaaagccttgggaagctataagtctatagatggaaaatggatcttacaactagatcaaaaaggccagcctcatctagccatttcacctaatgatgaccaaaatcaagatgccgttgcagtgaaaggtgttttcttacgtaatttcaataatttaagagccaaagtctatcgtgcagatgatgttaatttacaaaaaccactatgggtaagtgctccccaagcaggagataaaaattactacagcggaaatactgaaaatccaaaatctacatttttatatgacacagaatggaaaggaaccactactgatggtattcctttagaagatggaaaatacaaatacgttttaacttattactctgatgtccctggctctaagccacaacaaatggtgtttgatatcactttggatagacaagctcctacactaacaacagcaacttatgacaaagatagacgtatcttcaaagctcgtcctgcagtagaacacggggaatctggtatctttagagaacaagttttttacttaaaaaaagataaagatggtcattataatagcgtcttacgtcaacaaggagaagacggtatccttgttgaagataacaaagtatttatcaaacaagaaaaggatggtagctttattctacctaaagaggttaacgatttctctcatgtctactatactgttgaagattatgcaggcaatctagtatcagcaaaactcgaagatttgatcaatattggcaataaaaatggtttagtaaacgtcaaagtgtttagccctgagcttaacagtaatgtcgatattgatttctcttactctgtcaaagatgacaaaggtaatatcatcaaaaagcaacatcacgggaaagacctcaatttattgaaattgccttttggtacctatacgtttgatctattcttatacgatgaggaacgagcaaatctaatcagtcccaaaagtgtcactgtaactatttctgaaaaagatagccttaaagacgtcttatttaaagttaacttactcaagaaagcagccttactcgttgaatttgacaagcttttaccaaaaggagcaacagtccagttggttactaagacaaatactgttgttgatctaccaaaagcaacttattctcctactgactatggtaaaaacatacctgtaggagactatcgtttaaacgtaacgctgcctagtgggtatagcactttagagaacttagatgatttacttgtatccgtaaaagaagatcaggtaaacctaacaaaattgacgctgattaataaagctcctctgattaatgccctagcagaacaaactgatattattacccagcctgtgttttataatgctggaactcacttaaaaaataattacctagctaatcttgaaaaggcacaaactttaattaaaaatagagtggaacaaacaagtattgataatgctattgctgctttgagagaaagtcgccaagctcttaacggtaaagaaacagatacttctttactggcaaaagctattttagctgaaacagaaatcaagggaaactatcaatttgttaatgctagtccattaagccaatcaacttatatcaatcaagtccaattggcgaaaaaccttctacaaaaacctaacgtcactcaatcagaagtagacaaagccttagaaaatcttgatattgctaaaaatcaattaaatggtcatgaaactgattactctggtttacaccatatgataattaaagcaaacgttctgaaacaaacatcatctaaatatcagaacgccagtcaatttgctaaagaaaattataataaccttatcaagaaagcagaattgctgctttccaatagacaagctacacaagctcaagttgaagagttattaaaccaaataaaagcaaccgaacaagagcttgatggccgtgatagagtttcttccgcagagaattatagtcaatcactcaatgataatgactctctcaataccacacctatcaatccgccaaatcagccccaggcgttgatattcaaaaaaggcatgactaaagaaagtgaggttgctcagaagcgtgtcttaggggtgactagccaaaccgataatcaaaaggtaaagacaaacaagcttcctaaaacaggcgaaagcactcctaaaataacctatacaatattgctatttagtctctctatgctaggtctggcaacaatcaaactaaagtctatcaaaagagaa

SEQ ID NO: 10966 - protein, 1550 aa, Streptococcus agalactiae
MGTLFFLGGITNVAADSVINKPSDIAVEQQVKDSPTSIANETPTNNTSSALASTAQDNLVTKANNSPTETQPVAESHSQATETFSPVANQPVESTQEVSKTPLTKQNLAVKSTPAISKETPQNIDSNKIITVPKVWNTGYKGEGTVVAIIDSGLDINHDALQLNDSTKAKYQNEQQMNAAKAKAGINYGKWYNNKVIFGHNYVDVNTELKEVKSTSHGMHVTSIATANPSKKDTNELIYGVAPEAQVMFMRVFSDEKRGTGPALYVKAIEDAVKLGADSINLSLGGANGSLVNADDRLIKALEMARLAGVSVVIAAGNDGTFGSGASKPSALYPDYGLVGSPSTAREAISVASYNNTTLVNKVFNIIGLENNRNLNNGLAAYADPKVSDKTFEVGKQYDYVFVGKGNDNDYKDKTLNGKIALIERGDITFTKKVVNAINHGAVGAIIFNNKAGEANLTMSLDPEASAIPAIFTQKEFGDVLAKNNYKIVFNNIKNKQANPNAGVLSDFSSWGLTADGQLKPDLSAPGGSIYAAINDNEYDMMSGTSMASPHVAGATALVKQYLLKEHPELKKGDIERTVKYLLMSTAKAHLNKDTGAYTSPRQQGAGIIDVAAAVQTGLYLTGGENNYGSVTLGNIKDKISFDVTVHNINKVAKDLHYTTYLNTDQVKDGFVTLAPQQLGTFTGKTIRIEPGQTQTITIDIDVSKYHDMLKKVMPNGYFLEGYVRFTDPVDGGEVLSIPYVGFKGEFQNLEVLEKSIYKLVANKEKGFYFQPKQTNEVPGSEDYTALMTTSSEPIYSTDGTSPIQLKALGSYKSIDGKWILQLDQKGQPHLAISPNDDQNQDAVAVKGVFLRNFNNLRAKVYRADDVNLQKPLWVSAPQAGDKNYYSGNTENPKSTFLYDTEWKGTTTDGIPLEDGKYKYVLTYYSDVPGSKPQQMVFDITLDRQAPTLTTATYDKDRRIFKARPAVEHGESGIFREQVFYLKKDKDGHYNSVLRQQGEDGILVEDNKVFIKQEKDGSFILPKEVNDFSHVYYTVEDYAGNLVSAKLEDLINIGNKNGLVNVKVFSPELNSNVDIDFSYSVKDDKGNIIKKQHHGKDLNLLKLPFGTYTFDLFLYDEERANLISPKSVTVTISEKDSLKDVLFKVNLLKKAALLVEFDKLLPKGATVQLVTKTNTVVDLPKATYSPTDYGKNIPVGDYRLNVTLPSGYSTLENLDDLLVSVKEDQVNLTKLTLINKAPLINALAEQTDIITQPVFYNAGTHLKNNYLANLEKAQTLIKNRVEQTSIDNAIAALRESRQALNGKETDTSLLAKAILAETEIKGNYQFVNASPLSQSTYINQVQLAKNLLQKPNVTQSEVDKALENLDIAKNQLNGHETDYSGLHHMIIKANVLKQTSSKYQNASQFAKENYNNLIKKAELLLSNRQATQAQVEELLNQIKATEQELDGRDRVSSAENYSQSLNDNDSLNTTPINPPNQPQALIFKKGMTKESEVAQKRVLGVTSQTDNQKVKTNKLPKTGESTPKITYTILLFSLSMLGLATIKLKSIKRE

SEQ ID NO: 10967 - DNA, 2160266 bp, Streptococcus agalactiae
gttcatttagaaatagttgatttcaaatataaatgtaacaatgacgtaatataatttcgtgaattttttggtaaaatatttaatgtcttatcgtaaaggagtagtttaataaaaatgaaaaaaagaatattatcagcagtccttgtgagtggagtaactcttggaactgctgccgtaacagtaaacgctgatgactttgactcgaaaattgctgctactgattcagtaatcaatactttatcagggcaacaagcagcagcacaaaaccaggtgactgctattaaaggacaagttggtgctttagagtctcaacaatcagaattagaagcgcaaaatgctcaacttgaggctgtatctcagcagttaggtcaagagattcaaactctttctaataaaattgttgcacgtaacgaatctttgaaaaagcaagttcgtagtgctcaaaagggtaacttgactaactatattaatactattttaaattcgaaatcagtatctgatgctgttaatcgtgttgttgctattcgtgaggttgtttcagctaatgaaaagatgttagcacaacaagaggctgacaaagcggccttagaagctaaacaaattgaaaatcaaaatgctataaatactgtagcagctaacaagcaagctatcgaaaataataaagcagccttagcaacacaaagagcacaattagaagcagctcaattagagttatctgctcaattgactacagtccaaaatgaaaaagcatctttaattcaggcaaaagcacaagctgaggaagctgcgcgtaaggcagctgaagcacaagcagcagctgaagcgaaagcacaagctgaagcgaaagcacaagctgagtctgtagcaaaagcacaggcagcagcacaagttgagtctgccacagctcctactgaaacagttcaaacacaaccgagaactgaaataaagccttctaatcttacggctacttcttcggcaactactgttgctacaactacagctacagctactaatgagccaaaagttactcaaccttctgtagtaactaaagcagttgaagcacctaaagcagttgtttcttcaacacctagagcggtatcaaaacctgttgtcagaagttatgattcaagtaacacatacccaatgggacaatgtacttggggagctaagtcaatggcttcttgggttggtaactattggggaaatgctaatcagtggggtgctagtgcacgtgcagctggttattctgtaggaactacccctcgtgttggtgcagtagctgtttggccatatgatggtggtggttacgggcacgttgcagtagtaacgtcagtggctaacaattcatctatccaagttatggaatcaaactatgctggaaatatgagtattggcaattaccgtggttcatttaaccctagtgcttctggctctgtttactatatttacccaaattaatgaatactaaggagatctttcgtggtctcctttttgtttattaattaggtatggtttattttggattgaaaaattgtgtaaaaagcgttaaaatggtataggactaaagttttggaggaaatcatgtcttattctaatttaaaattgtttgcactgtcatcaaacaaagaactagcgaaaaaagtgtctcagacgattggaattccgctaggtcaatcgacagttcgccaattttctgatggtgagattcaagttaatattgaagagtctattcgtggccatcatgtttttattttacaatcaacaagctcaccagttaatgataatttgatggaaattttaattatggttgacgctttaaagcgtgctagtgcggagtctgttagtgtggtaatgccttactatgggtatgctcgtcaagatcgcaaggcacgttctcgtgaacctattacttcgaaactcgttgcgaacatgctagaagttgctggtgttgatcgtcttttaacagttgatttacatgcagctcaaattcagggattctttgatattcccgttgatcaccttatgggggctccccttattgcagattactttgatcgtcagggattggttggtgatgatgttgttgtcgttagtcctgatcatggtggcgtaacacgtgcacgtaagctggcacagtgtttaaagacaccgattgctatcattgataagcgccgtagtgttactaaaatgaatacatctgaagtaatgaatattattggtaatatcaaaggtaaaaaatgtattttaattgatgatatgattgatactgcaggtactatttgccatgctgcagacgctttagctgaagcaggggcaacagcggtttatgcttcatgtactcaccctgttttatcagggccggctttggataatattcaaaattcagctattgaaaaattaattgtgttagatacgatttacctccctgaagaacgtttgattgataagattgaacaaatttcaattgcggaattgattggtgaagctattatccgtattcacgagaaacgtcctttatcaccattatttgaaatgaataaactaaaatgacaaaaaacctgttattaacaggttttttatcatttaatgacggaaaactggacacaaattatttttcttgtataattaaatatattatttcttatcaggaggttatgatgacattagagaaacgatttaataagtacttagatagaatagaggtctccttaattcgtcagtttgatcaatctatttcagatatacctggaatggtaaaattaactcttggagaaccagattttaccactcctgatcatgttaaagaagcagctaaatcagctattgatgcgaatcaatcgtattacactggtatgagcggtttattagctctaaggcaagctgctgcagattttgcaaaggataaatataatcttacttataatcctgattgtgagatcttggttacgataggtgccacagaagctctgtctgcatctcttatagctattttagaagctggtgatgttgttctattacctgcccccgcttatccaggatatgagccaatagttaaccttgtaggagctgatatcgtagaaattgatactagagaaaatgactttagactaactcctgaaatgttagaaacggctattatccaacaaggtgaaaaattaaaggctgttttacttaattatcctactaaccctacaggtattacctattcaaggcaagaaattgctgcattagctgaagtccttaaaaaatatgatatttttgttattagtgatgaagtttattctgagttaacttacactggtcagcagcatgtttcaattgcagaatatttacctaaccaaactatcttaattaatggcttatcaaaatcacatgctatgactggttggagagttggattggtgtatgctcctgaagcatttattgctcaaatcattaaaagtcatcaatacatggtgacagctgctagtactatttcgcaatttgctggggtagaagccttatctgtgggtaaaaatgatacgttacctatgcgtcaaggatatattaaacgtagagattatatcattgataaaatgtctaaacttggtttcaaaataattaaaccgagtggcgctttttatatctttgctaaaatacctgatagctatccacaggattctttcaagttttgtcaggattttgcttatcaacaagctgtagctattattccaggagtggcttttggtaaatatggtgaaggatatatacgtctttcttatgctgctagtatggaagttattgaaacagcaatggctagattgaaagtttttatggaatcatatgagggttagtcaaacatacggtctcgttttgtataatcgtaattatcgtgaagatgataaattagttaaaatctttacggagactgaggggaaaaggatgttttttgtaaagcatgcttcaaagtcaaaattcaatgctgtgctccaacctttgactattgctcattttattttaaaaattaatgataatggtctttcttatattgatgattataaagaagttttagcatttcaagaaaccaattcagacttgtttaagttgtcatatgcgagttatattacttctttggctgatgtggctattagtgataatgtagcggatgctcaattatttattttcctaaagaaaacgttagaattgattgaggacggtttagattatgagattctaacgaatatttttgaagtacaactactagagaggttcggtgttgctttaaattttcatgattgtgttttttgtcatagggtaggattaccttttgatttttcacacaaatattctggattattatgtccaaaccattattataaagacgagagaagaaaccacctagatcctaatatgctgtacttaatcaatcgttttcagtcaattcaatttgatgatttacaaacaatttctgtgaaacctgagatgaaacttaaaattcgtcaatttttggacatgatttacgatgaatatgtagggattcatcttaaaagtaaaaaatttattgatgatttgtctagttggggaagtattatgaaatcagattaagttgtaaagaggaacatgacattagtgtcatgttcttttttttaatattaggataaactaatatggaattaatttttaggatatttgagatgaaaaaaacattatacattaccaataaactcttttttgctaactggtttgtgccagttattggtgcagttctaattcaagttatcggcatcattgtaagtagacgccttgtagtaaaattgctacctgatgattataaattcaatttatacattgcgcttttactatttgttcctattttggcaagtattttactatttttaatctattttcaaaaaagggattttacttccttgggatttactaaagataataatgttttaacaacgatctcaggatttattactggtagtttactgatgttttttatttatatttgccactggttatcaggttttgtggaaatttcttccagcaattccttttcttttggaccttttttctttttatttcttgcatactttatccaaagcttgacagaggaaattttatttagaggatatgttatgacaacagttaccaaatttaaaggtagttttgcaggtgttttatgtaattctatgttgttttcttttatccactttagaaactatggtatcacagcaatagcactttttaatttatttttacttggtattattttttctattctttttaatatgaccaaaaatattctttttgttacaggagttcatactacatggaattttactatgggatgtgtattaggtaataaggttagtgggggggattctcctgtttctctttttagaattactgaaaattctagctttgctctttggaatggtggggattttggttttgaagggggagtactatgttctttgatattagtaggttgtttagcatacttttctttggaaagcgtgagagtatctgttagatattagctattattgccttcttgtgaaaaaaataaagaaacgtgctataatatagccactaagtttttatgaggagttcattcatgaagaaaattgctatagatgctatgggtggagattacgctcccaaagctattgtagagggtgttaatcaagctatttcagattttagtgatattgaagtacaactctatggcgatcagaaaaaaattgagaaatatttaacagtaacggagcgagttagtattattcatactgaagaaaaaattaattctgatgatgagcctgctaaagctgttcgtcgtaaaaaacagtcttcgatggtcttaggagctaaggcagtcaaagatggtgttgcacaggcctttatttctgcagggaatacaggagctttattagctgctggtttgtttgtagtaggacgtataaaaggtgttgatcgaccaggcttaatgtcaactatgcctacgttagatggtgtgggttttgatatgcttgatttaggagctaatgcagaaaacacagcttctcatcttcatcaatatgctattttagggtcgttttatgcaaaaaatgtccgtggtattgaagttcctcgtgtaggtctcttaaataacggaacggaagaaacaaaaggcgattctcttcataaagaagcttatgaactgttagcagcagagccttctattaattttattggaaatattgaagcacgtgatttgatgtctagtgtagcagatgttgttgtcactgatggttttactggaaatgctgttctaaagacaatggaaggtacagctatgagtattatgggaagcctaaaatcttcaattaaatcaggtggcgtgaaagctaaattaggagcacttctattaaaagatagcctatatcagctaaaagatagtatggactattcaagcgcgggtggagcggttctttttggtttaaaagctccaatagtaaaatgccatggatcaagtgattctaaagctgtttattctactttgaagcaagttcgtacaatgttggaaactcaagtagttgatcaattagttgatgcctttacagatgaataggagtgaactcatgtcaagagatgaagtttttgaaaagatgctggaattattaaggcagcaacttggtgacccacagttagatatcacaccagagtcatcgttacatgatgatttagcaattgactctatcgctttaacagagtttattatcaatttggaagatgtgtttcatctagagattccagatgaggctgtcgaacacatgtcaagcgtccaacaactattagattatatcattgaacataagtaataataaaaaggaagaaaatacgaacgtttcttcttttttttgattttaaataaagtttttgttgtattagataatgttgtgtgttagaataactcttaaaataagagaaaggcgaataatcaagtgactaaccagcttatttatacaggaaaagcgaaagatatttatagtacaaaagatgaaaatgtgattagaacggtctataaagaccaagctactatgttgaatggagctcgtaaggagactattgatggcaagggagcactaaataatcagatttcatctcttatttttgagaaattaaatatggctggtgtggtgacacattatattgagcaaatttcaaaaaacgaacaattgaataaaaaagttgatattattccacttgaggtggtgctacggaatgtgacagcaggctcattttcaaaacgttttggagtggaagaaggacacgttcttgaaacgccaatcgtggaattttactacaaaaatgataatctgaatgatccttttatcaatgatgagcatgtgaagtttttgggtattgttaatgatgaggagattgcttatctgaaaggagagactcgccatattaatgaactcttgaaagattggtttgctcagattgggcttaacttgattgacttcaagttggagttcggatttgacaaggatggcaaaatcatcttggctgatgagttctcacctgacaactgccgtctctgggatgctgatggtaatcatatggacaaggatgtttttcgtagggatcttggtagcttgaccgatgtctatcaagttgtacttgagaagttgatagcattgtaattagaagaggaaggaattgaatccgttcgggaaactcagaaaaaagattgggcttactgaaatctcaatttcagacgtcctcctattttcgagtcgctcccttgtcggacttggtatcttatatgaataaacgtatttttgttgagaaaaaggctgactttggcattaaatcggctagtcttgtgaaagagttgacgcataatctacaactggcttctttgaaggatttgcgtatcgtgcaggtctatgatgtcttcaatttggctgaggatttgctggcgcgtgctgagaagcatattttctctgagcaggtgacagaccgtcttttgacagaagctgaaatcactgcggagcttgataaggttgccttctttgccattgaggcgcttcctggtcaatttgaccaacgtgctgctagttcgcaagaagctttgctattgcttggaagtgacagtcaggtcaaggtcaatacagctcagctttacttggtcaataaggatattgcagaagcagagcttgaagccgttaagaactatcttttgaatcccgttgattcacgtttcaaggatattaccttgccacttgaagtgcaggctttctctgtgtctgataagacaatctctaatcttgatttcttcgaaacttatcaggctgacgattttgcagcctataaggcagagcagggattggctatggaggtcgatgaccttctcttcatccaagattatttcaaatcaatcgggcgtgtgccaactgagactgagttgaaagttttggatacgtattggtcagaccactgccgtcacacaacctttgaaactgaattgaaaaacattgatttttcggcctctaaattccaaaaacaattgcaggcgacttatgacaaatacattgccatgcgtgatgagcttggtcgttctgaaaagccgcagacacttatggatatggcgactatctttggtcgttatgagcgtgccaatggtcgtctggacgatatggaagtctcagatgaaatcaatgcctgctcagttgaaattgaagtagatgttgatggtgtgaaagagccttggctcctcatgtttaagaacgagactcacaaccacccaacagaaattgagccatttggtggagcggcgacttgtatcggtggtgccattcgtgacccattgtcaggacgttcatacgtttatcaggctatgcgtatttcaggcgcaggagatatcacgactccgattgcggaaacacgtgctggtaaattgccacaacaggttatttctaagactgcggcgcacggctattcttcatatggtaaccaaattgggcttgcgacaacttatgtgcgtgagtacttccaccctggcttcgtagctaaacgcatggagcttggagctgtggttggtgctgcacctaaggaaaatgtggttcgtgaaaaaccagaggcaggcgatgtggttgtcttgctcggtggtaaaacaggtcgtgacggtgtcggcggtgcgacaggttcatctaaggttcaaacggttgaatctgtggaaacagctggcgcagaggtacaaaaagggaatgccatcgaagaacgtaagattcaacgccttttccgtgatggtaatgtcactcgcctaatcaagaaatcaaatgacttcggtgcaggtggtgtctgtgttgccatcggtgaattagctgatggtcttgaaatcgatttggacaaggtgccacttaaataccaaggtcttaatggtactgaaattgctatctcagaatctcaagaaaggatgtcagttgttgttggtccaagtgatgtggatgccttcatcgcagcctgtaacaaggaaaatatcgatgcagttgttgttgcgacagttactgaaaaaccaaatcttgtcatgacttggaatggtgaaacaattgttgatttggaacgctgtttccttgataccaacggtgttcgtgtcgtagttgatgccaaagtcgttgacaaggacttaacagttccagaagcgcgcacaacatcagcagagacacttgaagcagatatgcttaaggtcttgtctgacctcaatcacgctagtcaaaaaggtcttcaaactatctttgactcatctgttggtcgttcaaccgttaaccacccaatcggtggtcgttaccaaatcacaccgacagaaagttctgttcaaaaattgccagttcaatatggtgtgacaacaacagcatctgttatggctcaaggttacaatccttatattgcagagtggtcaccttatcacggtgctgcctatgctgttattgaagcgacagctcgcttggtagcaacgggtgctgactggtctcgtgcacgtttctcttaccaagagtatttcgagcgtatggataaacaggcagagcgttttggtcagccagtatcagctcttcttggttctattgaggctcagattcaatttggtttgccatcaatcggcggtaaggactctatgtctggtactttcgaagaattgacagtaccaccaaccttggtagctttcggtgtgacaacagcggacagccgcaaggttctctctcctgagtttaaagcggctggtgagaatatctactacattccaggtcaagctatttcagaagatattgattttgaccttatcaaggctaactttagccagtttgaggctattcaagctcaacataagattaccgctgcctcagccgttaaatacggtggtgtcctagaaagtcttgctctcatgacttttggtaaccgtatcggtgcttctgttgaaattgcagagcttgacagcagcttgacagctcaactcggaggctttgtctttacatcagttgaggaaattgctgacgttgtgaagatcggtcaaactcaggcagactttacagtcactgtcaatggaaatgacctagctggtgcaagccttctatcagccttcgaaggtaaattagaagaagtttacccaacagagtttgaacaggtagatgctattgaggaagttcctgctgtggtatcagatgttgttatcaaggctaaggaaattattgaaaaaccagtagtttacatcccagtctttcctggtactaactcagagtacgattcagctaaggcctttgaacaggttggagctagcgtcaacttggtgccatttgtaaccttgaatgaggctgctattgctgagtcagttgatacgatggttgctaatattgctaaggcaaatatcatcttctttgctggaggtttctcagcagcggatgaaccagatggctctgctaagtttatcgtcaatatcttgcttaacgagaaggttcgcgcagctattgacagcttcatcgaaaaaggtggccttatcatcggtatctgtaatggtttccaagcccttgttaaatcaggtcttcttccatacggaaacttcgaggaagctggtgagacaagtccaaccctcttctataacgatgctaaccagcacgttgcaaagatggttgagactcgtatcgcaaataccaattcaccttggttggcaggagttgaggtcggcgatattcatgtcattccagtttcacacggtgaaggtaaatttgttgtcagcgcttctgaatttgcagagctaagagacaatggtcaaatctggagccaatatgtggactttgacggacaaccatctatggattctaaatacaatccaaacggctctgtcaatgccatcgaagggattaccagcaagaatggtcaaatcatcggtaagatggggcactcagaacgctgggaagacggactcttccaaaatatccctggaaacaaagaccaaaaactctttgaaagtgctgtaaaatactttacagggaagtgagagtgggacaaaaatcggtaattccaaaggaattcgattttgtcgtccccctccgcacagttgagtggggctgtaagagttgatttatcagcgaattagagcccactcaacccctacgttttgcgaactagattataaaaaatatggaggcttaggacttttgtcctagctttagccctcgccttgaattagtgaaggcgaggttagatagaaattcgctatcttttgaacgaagcgagcttaaccgtatctttccgccgtattggtatttgggagtcattgagactaaggttcaatggctagcttgatagattttctattttaatgttggcattgatgacgacagatccaaaattgagaaaatcatcaaagctacttaagaagagatacaaaaagaattaggaaaaaagaatgacatacgaagtaaaatctctaaatgaagaatgtggagtctttggtatctgggggtatcctcaggcagctcaagtcacttactttgggcttcatagccttcaacatcgcggtcaagaaggagctggtattatttcaaatgataatgggaaactctatggttatcgaaatgttgggctcctttctgaagtttttaagaatcaatctgaattagataatttaactgggaatgcggctattggacatgttcggtatgctactgcaggttctgcagatattcgcaatattcagccttttctttataaatttcatgatgggcaatttgctttatgtcataatggtaatttgacaaatgctatttcctcaaggaaagaattagaaaagcaaggtgcaattttcaatgcctcctcagatactgaaattttaatgcatttgattcgtcgaagccataacccaagttttatggggaaggtaaaagaagctttaagcactgtaaagggaggtttcgcctatctactgatgacagaagataaattaattgctgctcttgaccctaatgcctttcgtcctttgtcaattggacaaatgcaaaatggtgcctgggttatttccagtgagacctgtgcttttgaggtggtaggcgcaaaatgggttagagatgttgaacctggtgaagttattcttatagacgatagtggtattcaatgtgatcgttatactgatgaaacgcaactggcaatttgttcgatggaatatgtctattttgcaaggccggattcaactatacatggtgttaatgttcatacggctcgaaaaaatatgggaaagcgtcttgcacaagaatttaaacaggatgctgatattgtaattggtgtcccaaattcgtccttatcggctgctatgggctttgctgaagaatccggattaccaaatgagatgggccttgtaaaaaatcagtatacgcagcgaacctttattcaaccgacacaagaattaagggaacaaggtgttcgaatgaaattatcagcggtatctggtgttgtcaaaggaaagcgcgttgttatgattgatgactcaattgtaagaggaacgacttctagaaggattgtaggattattaagagaagcaggagctactgaagtacatgttgctatagctagtccagaattaaagtatccttgtttttatggaattgatattcaaacaagacgagaattaatttcagcaaatcacgctgttgacgaagtgtgtgatattattggcgcagatagtctaacttatctatcaatcgatgggttaattaaatcaattggactcgaaacaaaagcaccaaatggtggtttatgcgtagcttactttgatggacattatccaacaccgctttatgattatgaagaagaatacctcagaagtttagaagaaaaaacaagtttttatattcaaaaagtgaaataagctctgctaattatataaggagaaaacatgtctgaaaaaaatgcttatgcccagtctggtgttgatgtagaagcgggctacgaagttgtcgaacgtatcaagaaacacgttgctcgcacagaacgtgctggtgtcatgggagctctcggtggctttggtggtatgtttgacctgtcacaaacaggtgttaaagaacctgtcttgatttcagggactgacggtgtcggaactaaactcatgcttgctatcaagtacgacaagcacgacacaatcggtcaagactgtgttgccatgtgtgtcaacgatattattgcagcaggtgctgagcccctttacttccttgactatgtcgcgactggtaaaaacgaacctgccaaattggaacaggttgtcgctggtgttgctgaaggttgtgttcaagctagcgcagctcttatcggtggtgaaacggctgagatgcctggtatgtatggcgaagatgattatgaccttgcaggctttgctgttggtgtggctgaaaaatctcaaatcatcgacggttcaaaggtaaaagaaggggatattcttcttggacttgcttcaagtggtatccattcaaatggttattcattggtacgtcgtgtctttgctgactacactggtgatgaggtgcttccagagcttgaaggcaaacaactcaaggatgtccttcttgagccaactcgtatctatgttaaagcagctctgccattgatcaaggaagaactagttaacggtatcgcccacatcacgggtggtggttttatcgagaatgttcctcgtatgtttgcggatgatttggctgcggaaatcgatgaggataaggtgcctgtacttccgattttcaaggcgcttgaaaaatatggtgacatcaagcacgaagaaatgtttgaaatcttcaacatgggtgtcggtcttatgctggatgttaaccctgaaaatgttgaccgtgtcaaagaacttttggacgaaccagtctatgaaatcggtcgtatcatcaagaaagcagacgatagtgtggtgattaaataagtcactaaattttataagaaaggagtgtttagttagtttgcctaactgaacacgggattaaatttctaggaaaaaagataaaacgacttagacgcaagcgtcgttgttcgttttcctatttttctacgaaatttttcggcaagccgaatcatccctttgtatcgaatatgaaaatcgctgtttttgcttctggtaatggttccaactttcaggtcatagcagagcagtttcaagttagttttgtcttttcagatcatcgtgatgcctatgttttagagcgtgctcagaacttagccattccaagcttcgcttttgaactcaaagagtttgagaataaggcggcttacgagcaagccgtcgttgatttgttggacaaacacgagattgacttggtctgtctggcgggctacatgaagattgtcggagaaaccttgctctcagcctatgaagggcgtatcatcaatattcacccaacctatctgcctgaatttccaggtgctcacggtatcaaggatgcttgggaggcaggtgttgaccagtctggtgtgaccatccattgggtggactctggtgtggataccggtcaggtcatccaacaagtgcacgtgccacgcctagcagatgatagtctagaaagctttgaaacccgcatccacgaaaccgaataccaactctacccagctgtcttagatagcttgggcataaagagaaaatagtaaaatttgttataataagctaatgaaactagtgaaaaatttagagatagtagagtctatttttggtgattgggacgagaccataatctggtcgtgtgtccaaggtattatgggagaagtttttgtagatagtttagaccaaccaaaatcttctttggcaaaattgggaaggaaatcatcttttggttttctagcaggtcagcctactttatttctactagaagtttgctctggggaggatattatccttgttcctcagcataaaggatggtcagatttgattgaatcaacttatggtcagaatgctcattcttttaagcgttatgcgacgaaaaaagatactttgtttgagcgaagtaggttagagaagtttgttactcagttgccaaatggttttgaattacgtgctattgatgagaaagtttacaactcttgcttagaaaaggaatggtcacaggatttagtagcaaattacgctacttatcagtactataaaaaacaaggtataggttatgttgtatattatcaggggaatatcattgcaggagcttcatcttattcaacctataaaaatgggattgagatagaagtagatacgcatccagattttcgtcggcgtggtttagcaacaatagttgcagctcagttaatactaacttgtttagataagggaatttatcctagctgggatgctcatacaaggacttcattgaatttatctgaaaaactcggttatgaattttctcatgaatacatagcctatgaaatagattgaagtaagaaaaggagaactcatgactaaacgtgctttaatctcagtttctgacaaatcaggaattattgactttgcaaaagaattgaaaaacttgggttgggatattatctcaactggtgggactaaggttgcccttgatgatgctggtgttgagaccattgccatcgacgatgtgactggattcccagaaatgatggacggtcgtgttaagaccctccacccaaacattcacggtgggcttctggctcgtcgcgacgctgacagccaccttcaggctgctaaggacaacaatattgagttgattgacctcgtggttgtcaacctctatcccttcaaggagaccatccttcgcccagacgtgacctacgatttggcggtggaaaatatcgacatcggcggtccatcaatgcttcgctcagctgctaaaaaccacgctagcgtaaccgttgtggttgattcagctgactatgccactgttttgggagaattggctgacgctagtcagacgacatttaaaactcgtcaacgcttggcagctaaggccttccgtcatacggcagcctacgacgctttgattgctgagtacttcacagctcaagtgggagaggctaagcctgaaaaattgaccatcacttatgaccttaaacaggctatgcgttacggagaaaatccacagcaagacgctgatttctaccaaaaagccttaccaacagactactcaatcgcttcagctaaacagctcaatggaaaagaattgtccttcaataatatccgtgatgctgatgcagcaatccgtattatccgcgatttcaaagacagtccaacggttgttgccctcaaacacatgaacccatgtggtatcggacaggctgatgatattgagacagcttgggattacgcttatgaagctgatccagtttcaatctttggtggaattgttgtccttaaccgtgaagttgacgcagcgacagctgagaagatgcaccctatcttcttggaaatcatcatcgcaccatcatactcagaagaagcgctagctattctcacaaataaaaagaaaaacttgcgtatccttgagttgccgtttgatgcccaagctgccagcgaagtggaagctgagtacactggcgtagttggtggacttttggtgcaaaaccaagacgttgtggctgaaaatccatctgactggcaagtggtgacagaccgccagccaacagaacaagaggcgactgcccttgagtttgcctggaaggctatcaagtatgttaagtctaacgggattattattactaacgatcacatgacgcttggactcggtgcaggtcaaaccaaccgtgtcggctcagtcaagattgctatcgagcaggctaaggaccaccttgacggtgccgttctagcatcagatgccttcttcccatttgcggacaacattgaagaaatcgctgccgcagggatcaaagcaatcatccaaccaggtggttcagttcgtgaccaagaatctattgacgccgcaaacaaacatggcttgaccatgatcttcacaggcgtgagacattttagacattaaaaaatagtagtttaggttttcttaagttaactcaggtatactacgtatatcctaaaaacttttctttttattaaacctcctaagtactcatcaaggtgagtactttttttgatattttgatttaaattttcgaataagttaattgcaagtgtttgagcacttcattatattaattctatttggaggtttttcttgaataaatggttagttaaggcaagttccttagttgttttaggtggtatggttttatctgcgggttcccgagttttagcggatacttatgtccgtccaattgataatggtagaattacaacaggtttcaatggttatcctggacattgtggggtggattatgctgttccgactggaacgattattagggcagtggcagatggtactgtgaaatttgcaggagctggagccaacttttcttggatgacagacttagcaggaaattgtgtcatgattcaacatgcggatggaatgcatagtggttacgctcatatgtcacgtgtggtggctaggactggggaaaaagtcaaacaaggagatatcatcggttacgtaggagcaactggtatggcgacgggacctcaccttcattttgaatttttaccagctaaccctaattttcaaaatggtttccatggacgtatcaatccaacgtcactaattgctaatgttgcgacctttagtggaaaaacgcaagcatcagctccaagcattaagccattacaatcagctcctgtacagaatcaatctagtaaattaaaagtgtatcgagtagatgaattacaaaaggttaatggtgtttggttagtcaaaaataacaccctaacgccgactgggtttgattggaacgataatggtataccagcatcagaaattgatgaggttgatgctaatggtaatttgacagctgaccaggttcttcaaaaaggtggttactttatctttaatcctaaaactcttaagactgtagaaaaacccatccaaggaacagctggtttaacttgggctaagacacgctttgctaatggtagttcagtttggcttcgcgttgacaacagtcaagaactgctttacaaatagtttgaggtattgattcattgttttaaatgacagttgtgttactaactaagtacaatttctttaaaccgtctgaaaataattttatagtccagtaaagtgtgatattatagtctcggactaataaaaaggaaataggaattgaagcaatgaaaatgaataaaaaggtactattgacatcgacaatggcagcttcgctattatcagtcgcaagtgttcaagcacaagaaacagatacgacgtggacagcacgtactgtttcagaggtaaaggctgatttggtaaagcaagacaataaatcatcatatactgtgaaatatggtgatacactaagcgttatttcagaagcaatgtcaattgatatgaatgtcttagcaaaaataaataacattgcagatatcaatcttatttatcctgagacaacactgacagtaacttacgatcagaagagtcatactgccacttcaatgaaaatagaaacaccagcaacaaatgctgctggtcaaacaacagctactgtggatttgaaaaccaatcaagtttctgttgcagaccaaaaagtttctctcaatacaatttcggaaggtatgacaccagaagcagcaacaacgattgtttcgccaatgaagacatattcttctgcgccagctttgaaatcaaaagaagtattagcacaagagcaagctgttagtcaagcagcagctaatgaacaggtatcaccagctcctgtgaagtcgattacttcagaagttccagcagctaaagaggaagttaaaccaactcagacgtcagtcagtcagtcaacaacagtatcaccagcttctgttgccgctgaaacaccagctccagtagctaaagtagcaccggtaagaactgtagcagcccctagagtggcaagtgttaaagtagtcactcctaaagtagaaactggtgcatcaccagagcatgtatcagctccagcagttcctgtgactacgacttcaccagctacagacagtaagttacaagcgactgaagttaagagcgttccggtagcacaaaaagctccaacagcaacaccggtagcacaaccagcttcaacaacaaatgcagtagctgcacatcctgaaaatgcagggctccaacctcatgttgcagcttataaagaaaaagtagcgtcaacttatggagttaatgaattcagtacataccgtgcgggagatccaggtgatcatggtaaaggtttagcagttgactttattgtaggtactaatcaagcacttggtaataaagttgcacagtactctacacaaaatatggcagcaaataacatttcatatgttatctggcaacaaaagttttactcaaatacaaacagtatttatggacctgctaatacttggaatgcaatgccagatcgtggtggcgttactgccaaccactatgaccacgttcacgtatcatttaacaaataatataaaaaaggaagctatttggcttcttttttatatgccttgaatagactttcaaggttcttatataatttttattaaattgaggagattaagctataagtctgaaactactttcacgttaaccgtgactaaatcaaaacgttaaaactaaaatctaagtccgtaaagattattgaaaacgctttaaaaatagatataataaggtttgtagatatctaaaattaaaaaagataaggaagtgagaatatgccacatctaagtaaagaagcttttaaaaagcaaataaaaaatggcattattgtgtcatgtcaagctttgcccggggagcctctttatactgaaagtggaggtgttatgcctcttttagctttggcagctcaagaagcaggagcggttggtataagagccaatagtgtccgcgacattaaggaaattcaagaggttactaatttacctatcatcggcattattaaacgtgaatatcctccacaagaaccatttatcactgctacgatgacagaggtggatcaattagctagtttagatattgcagtaatagccttagattgtacacttagagagcgtcatgatggtttgagtgtagttgagtttattcaaaagataaaaaggaaatatcctgaacagttgttaatggctgatataagtacttttgaagaaggcaaaaatgcttttgaagcaggagttgattttgtgggtacaactctatctggatacacagattacagccgccaagaagaaggaccggatatagaactccttaataagctctgtcaagccggtatagatgtgattgcggaaggtaaaattcatactcctaagcaggctaatgaaattaatcatataggtgttgcaggaattgtagttggtggtgctatcactagaccaaaagaaatagcggagcgtttcatctcaggacttagttaaaagtgttactcaaaaatcaaaatcaaaataaaaaaggggaatagttatgagtatcaaaaaaagtgtgattggtttttgcctcggagctgcagcattatcaatgtttgcttgtgtagacagtagtcaatctgttatggctgccgagaaggataaagtcgaaattacgtggtgggcttttccaacctttactcaagaaaaggctaaggatggagtaggtacttatgagaaaaaagtcatcaaggcttttgaaaagaaaaatcctaatataaaagtaaaactagagacaattgatttcacatctggacctgaaaaaatcactacagcgattgaagcagggacagcacctgatgtgctttttgatgcaccagggcgaattattcaatatggtaaaaatggtaaattagcagatttgaatgatttatttacagaccaatttattaaggatgtcaataataagaatatcattcaagcttctaagtctggcgataaagcctacatgtatccaataagttctgccccattttatatggcgttcaataaaaaaatgcttaaagatgcaggagttttgaaactcgtaaaagaaggttggactactagtgattttgaaaaagtactaaaagcactaaaaaataaaggctatacaccaggttcattctttgcaaacgggcaaggaggagatcaaggaccacgtgcattttttgctaatctttatagtgctccaataacagataaagaagtaacaaaatataccactgacactaaaaattctgtaaaatcaatgaaaaaaatagttgaatggattaagaaaggctacttgatgaatgggtctcagtatgatggctcagctgacattcaaaactttgccaatggacaaactgctttcactatcctatgggctccagctcaacccaaaactcaagcaaaattattagagtcaagtaaagtggattaccttgaagtgccattcccatcagaagatggaaaaccagatttagaataccttgttaatggttttgcggtctttaataataaagatgaaaacaaagtaaaagcctctaagaaatttatcacttttattgctgacgataaaaaatggggaccaaaagatgttatacgtacaggtgctttcccagttagaacatcatttggagatctttataaaggtgataaacgtatgatgaagatttcaaaatggactcaatattattcaccatattacaacactatcgatggattttctgaaatgagaaccttatggttcccaatggttcaatctgtatccaatggtgacgaaaaaccagcagatgctttgaaagactttactcaaaaagcaaatgataccattaaaaaagcagctaaataattaaggagactccttttctatggtcaatcacatattgggatagaagaggagtttttagtcaagttaagatgtaaaggagagtaccgtatgcgtactaataagttaaagatgagggaaacgatgatagcttatgcttttctagcacctattctcttatttttcttaatttttgtttttgcaccgatggttatgggctttgtcactagtttttttaattattctatgacacagttcacttttattgggttagctaattacaatcgtatgtttcatgattctattttcatgaaatccttgataaatacagtaatcattgtgattggctctgtgccagtagtggttttcttctcactttttgttgctgccaatacttatgaaaaaaatgttttttcacgctctttctaccgttgtgtcttcttcttgccagtagtaactggtagtgttgcagttacagttgtttggaaatggatttatgaccctatgtccggaattttaaattacatcttgaaatcaggtcatgtcattgaacagaatattagctggcttggggataagcactgggcattgcttgctattattattattttgctaacgacctcagttggtcaacctattattctatatattgcggcgatgggaaatattgataattctctttgcgaagctgcgcgtgttgatggagccaatgaaatgcaagttttttggcaaattaaatggccgagtctcttaccaactacactctatattgcagttataacaacaattaattcatttcaatgttttgccttaatccagctcctaacatctggtggaccaaattattcaacaagcactttgatgtattatctttatgaaaaagcctttaaactatcagaatatggctatgctaatactatgggagtattcctagcagtaatgattgctttaataagttttgctcaatttaagatcttaggaaatgatgtggaatattaggaggaaaacatgaaaaagaaaacattcagtgcttataactttttaacggctcttatcctttgtcttttgacagtgctttttatctttccattttattggattatgacaggagcttttaaatctcaacctgatactattatcatccccccacaatggtggcccaaagcaccgaccttagaaaattttaaagctttaactgtacaaaacccagctttgagatggctttggaatagtgtctttatctcaattatgacaatgttcctagtttgctgtacatcgtcaatggcaggctatgttttagctaagaaacgattttacggtcaaaaaatattgttctccctttttattgctgctatggctttacctaaacaagttgttttagtgccattagttagaattatcaattttatggggatacatgataccttatgggcggttattttacctcttgttggttggccttttggggtcttcttgatgaaacagttttctgaaaatattccaacagaattactggaatcagctaaaattgatggttgtggagagattcgaacatttattaatgtagcatttccaattgtcaaacctggatttgctgccctagctattttcacatttatcaatacttggaatgactattttatgcaattagttatgctaacttctagaaataatctgaccatttctcttggggtagctactatgcaggctgaaatggcaacaaactatggcttaattatggcaggtgcagccttagctgctgttcctattgtgacagtattcttagttttccaaaaatcctttactcaggggattacaatgggagctgttaaaggataggtaggatttattatgatttacgatcatttattgaatttaacgcattataaagatattaatcctaatttagatttagcgattgattatctactaagtcatgatttaaggaatttagatataggcacctatcatattagcccagaagtgatactcatggtccaatcaaatcaacttagtgagtcatttgatcatatttttgaataccataaaaaataccttgatatacattatgtcattgaaggacatgaagttatcaaattgggaaaaggtgataaggtagaggtggaggaatacttaggcgatataggatttatcaagtgctcagaagagacttcttttgatttgagagataattatatagccttctttttcccagaagaagctcatcagccaaatggtatgggaagtctaggtaattatgtcaaaaaaggggtattgaaagtgttaatggcgtaagaaatacagggagtatattgtgaaaaaagcaaatcaattaatagcagcgatttttgatgttaacaacccctttatgcaaggttgcaatgttgtttttgatctggcattactaaaccttctctttatgataacttgcctaccattggtaactattggtgctgctaaaattagtttgtatcgaacgttgtggcaaaaattagaaggtgatcagacaaatcttttaatattgtatataaaacacctaaaaaaagagtggttccaaggtatgcttttaggtttggttgaactaagtattttggttgtgatcatatttgatttaacaattcttcattatcaaataggtttcattgtgtctttcttgaagataacttgttacgcctttttgttattgactgtgatgacgagcatatacctatttcctatggctgcccgctacgaaatgtctcttttagataccgtgaaaaagagctttataatggcatgtttaaacttgaaatggactggtgtattgatgtttttattaatcatgacttggtttattatggtgcagtctagtctcttatttatgcttacagtgtcagctatatttatttttgcttataccgcctttgcttactttaaaattattattttacaaaaacaatttgcctatttcagcaaacaacaaggagattatcaatgaaagatttacaaaaatatcaaggaattattcctgcattttatgcttgctatgatgataagggtgatatttgtcccgaacgagtaaaagccctgaccaattattttattgataaaggtgttcaaggactttatgttaatggttcatccggagaatgtatttaccaaagtgtagcagatcgtaaacttgtactggaaaatgttatgtccgttgctaagggtaaactaacagtaatagcgcatgtggcatgtaataatactaaggatagcgtagagttggctatgcatgctgaagctataggtgttgatgctattgcagcaattccaccaatttattttcgattaccagagtatgccatagcagattattggaatactattagtcaagcagcaccacaaactgattttattatttacaatattcctcaattggcaggggttgctttgacatcggatttatatcgaaaaatgttacaaaatccgcaagtaattggtgttaaaaattcttccatgccagttcaagacattcagaattttgtggctattggaggagaaaatcatattgtttttaatggtccagatgaacaatttttgggtggtcgtctcatgggagccgctgcaggtattggtggtacctatggcgtaatgccagaattatacttgactttaaatcagttaattgttgataaagatttagaaaaagcgcgtgaacttcaatttacaattaacgatattatcacaaagctttgttcgggtcatggtaatatgtatgctgtgatcaaagctgtattggaaatcaatgagcaactaactataggttccgttcggttacctttagcatctgtaacagaagaagataaacctattattaaagaggcagcagaaatgattagacatgctaaaaaacagttttgttaaagtgaggtagataattatgaccagaacagtagcaattgatattggcggtacaatgattaagcatggcattgtggataatttaggttgtattgttgaggcaagtgagcttgccacagaagcctacaaaggtggtccaggcattttacaaaaagtttgtcaaattatcgataactatctagcagaagggagcattgatggaattgctatctcatctgctggcatggtagatccagatgaaggatgtatattttactctggtcctcaaattccaaactatgctgggacacaatttaagaaagttttagaagacacttatcaagtacgcacagaaattgaaaatgatgttaattgtgcaggattagctgaagctgtctcaggtagtgccaaagatagttcaatagcgctttgtcttactattggaacaggtattggtggttgtctgattattgataaaacagtttttcatggctttagtaattctgcttgtgaagttggctatatgcacctttcagatggtgattttcaagatttagcctctacaactgcactgattgctgatgttgccaaagcgcatggagatgaaattagccgatgggatggacgtcgtatttttcaggaggctaaaaaaggcaatgaaaaatgtattgcaagtatagaccgtatgataaactaccttggccaaggaatcgctaatatggtttatgtggtaaatcctgaaaaagttgttttaggtggtggaatcatggctcaaaaagattatttacaagataaacttagtgaatctttgaaacgaaatcttgtgacaagtcttgctgaaaaaacagcaatagtctttgcacaacacgaaaaccaagctggtatgctaggagcttactaccattttaaaaacagggggtgacgggtatatgattgaaacaatgtcgctagatgacatgagagaatacctaggtcaagaccaaattcccgaggattttgatgacttctggaaaaaacaaacaatgaaatatcaagggaatattgagtatcgtctagacaaaaaagatttcaatattacttttgcacaagcttatgatcttcattttaaaggcagcaataactctattgtctatgccaaatgtttattccctaaaacaaataaaccctatcctgtagttttttattttcatggttaccaaaaccaaagtcctgactggagtgaccaacttaattatgtagcagcaggttacggcgttgtttcaatggatgttcgaggtcaagctggacagtctcaagacaaggggcattttgatggcattacagttaagggccagattgtgcgaggaatgatctcaggaccaaatcatcttttttataaagacatttatcttgatgttttccaattgattgatatcattgctacattagagagtgttgatagtaatcaactttatagttatggctggtctcaaggtggagcacttgctttgatagctgcagctcttaatcccaaaatcgtcaagaccgttgctgtttacccatttttgtcagactttagacgagtattagatttagggggtgtcagtgagccctatgatgaactcttccgctattttaaatatagtgatccttttcataaaacagagaataatgtgttaaaaactttggcttatattgatgttaaaaattttgcacataggatttcttgccccgttgttttactaacagccttaaaagatgatatttgtcctccatcaactcaatttgccatttttaatcgtctgacatcaactaaaaagcatcttttattaccagattatggacatgatccaatgacagtgcaagtaaaagaccatatttttgatcaactgacaggaagtcaatttacaaagcaaaaaatcgagtagattatttctactcgattttcatttagcgttgaataatggtttctctaaaaattcgctctttttctattttattaatatctaaaaattgtgcatagataatatctaccatgattaacattgggatctgaggcgaaattctattgccgtagtctaaatgcctagcagaagccacctgaataatcttgtcaaaagcatagtcaattgtgtgaggttgttttgtaaatagaacggttttagctccgtgacaacttgcgatttttaaggcaccaataacagagttggtgttcccagaaagtgagaaggcaatgacgaggcatctatcattaacaatactattagtccatgagaaactatctgtatcatccagagcctcacaaatcactcccagcctcataaggcgtattttaaattctttagctactagcgatgagctccctttgccataaaaataaacacgatcagcttgctcaatcatatgtgatacttctagaagctgttcttcatcaataatatcagcagatttagaaatcatctcttgataattcataaatactttcttagtgttgtcattttgaagaccgtataattgttgactgatggtctcatggctttttaaatattcaaaaacaaattcacgatagcctttaaacccacattttttagcaaaacgcgttaaggctgcttgtgaaatgtgtagttgcttagtgacaatggtagaagcaagagcgtcttttgaaatgggctgccccataaaataacaagcaatttcacgttctaaatcagtcattaaatcaagagcagactcaatttggtcataaatagtcataatacacggtcctctcctctttaagaaagcgcttaatatattcagtataacataaagttagtgagggaccaaactaagttctaagaaacagcaatgataagttttaaatagcaatatgaaggatcaataacataatatatgttaagtatatattatgatataaatttttcaaaaaagctgtaataaaaaaaataaaagcgaacaaatgtgttataattttataaatgatacgtttttattgaaaatttctttttatattatttaataggagttattctgatatgaaattgcttgttgttggttctggtggtcgtgagcatgcgattgctaagaagttgttagcgtctaaggatgtggatcaggtttttgtggcacctggtaatgatggtatgaccttggatggtctagacttggtaaatatcggaatttccgaacattctagactgattgactttgttaaggagaatgagattgcttggacccttattggtcctgatgatgcgctagcagctggtatcgttgatggttttaatagtgctggactcagagcatttggtccaaccaaggcagccgcggagctagagtggtcaaaagactttgccaaggaaatcatggtcaaatacaatgttccaacagcagcctatggcacattttcagattttgaaaaagctaaagcctacatcgaagagcagggcgcaccaatcgtggtcaaggctgacggattggcgttaggcaagggcgtggtcgtggctgaaaccgttgagcaggcggtagaggcggcgcaagagatgcttttggacaacaagtttggcgactcgggtgcgcgcgtggttatcgaggaattcttggatggtgaagagttctcccttttcgccttcgctaatggcgataagttctacatcatgccgacagctcaggatcacaagcgtgcctatgatggtgacaaggggctaaataccggtggtatgggtgcctatgcgccagttccccacctgcctcagagcgtggtggatacagcagttgagactatcgttaagcctgtccttgaaggcatgattgccgaagggcgtccttatctaggtgtcctctatgctgggcttatcctgacggctgatggccctaaggttatcgagttcaactcacgttttggtgaccctgaaactcagattatcctccctcgcctgacttccgatttcgctcagaacatcgacgacatcatgatgggcatcgagccttacatcacttggcagaaggacggcgtgactctgggcgttgtcgttgcctcagaaggctatccgctcgattacgagaaaggtgtgccactgcctgaaaagaccgacggcgacatcatcacctactatgcgggagctaagtttgcggaaaatagcaaagcactgctctcaaacggaggacgtgtctacatgcttgtcaccacagaagacagcgtcaaagcagggcaggacaaaatctatacccaactcgcccaacaagacacaacaggcctcttctaccgaaacgacatcggaagcaaagctattaaggaataagactactcattcaaatattagcgtcagcaaagcgaccgaaggtcgctccaaaaagaaagaagaaaggaactgaacacgggactaattttctagtgaaaaagataaatcttcctagatgctaaagcatcttcgtcagatttctgcgtcgtaggcgtctgctgctaaagcacctagtcgccctgacgtgggtacgtcttcgaaatcaaagatttcggacttaccgcatatttttctacgaaaattttcgacaagtcgaaacgtccctttgtatcttaatattatgcaaccaattatttctattatcatgggttccaaatccgactggacaaccatgcaaaaaacggctgaagttctagataactttggcattgcttacgagaagaaagtcgtctctgcccaccgtacgccagacctcatgttcaagcatgctgaggaggcgcgtggtcgtggtatcaagattatcatcgctggagcaggtggagcagcccacttgccgggtatggtagcagctaaaacaaccctgcctgttatcggtgtgcctgtcaaatcacgtgccctctcaggtttggattcgctctactctattgtgcagatgcctggtggtgtgcctgtggcgaccatggctatcggagaagcaggagcgactaacgctgccctgacagccctccgtatcctctctatcgaggatcaaaatctggctgatgcgctagctcatttccatgaggaacaaggaaaaatcgcagaggagtcaagcaatgaactcatttaagaccattgggattattggtggtggtcagctggggcagatgatggcgattgcggctatctacatgggccacaaggtcattacgctggatccagctagcgactgccctgcctcccgcgttagcgaggtgattgtggcaccttacgatgatgttgaggctttgggaacattagctgcgcgttgcgatgttttgacctatgagtttgagaatgtcgatgccgatggtctggatgccgttgtgtcagctggtcagctaccgcaggggactgatctgctccgcatttctcaaaaccgtatctttgaaaaagactttctggcaaataaggctggcgtgactgtcgctccctataaggtggtgacatctagccttgacctagaggggcttgacttgaccaagacctatgtcctcaagacagcgacaggtggttatgacggtcatgggcaaaaggttatccgctcagcagaagacctgccagaggcgcagcaattagccaactcagctcagtgtgtcttggaagagtttgtcaacttcgaccttgaaatatcagtcatcgtgtctggaaatggtcaggatgtgacggtctttcccgttcaggaaaatatccaccgcaacaatatcctgtcaaaaaccatcgtaccagctcgcatctcagaccaactagctgacaaggctaaggaaatggctgtgcagattgccaagaaactccagctatcaggaaccctctgtgtggaaatgtttgcgaccgcagatgacatcatcgtcaatgaaattgccccacgtccccacaactcagggcactactctatcgaagcctgcgacttttcacagtttgacacccacatcttgggcgtactgggcgcaccgcttccgccaatcaaactccatgctccagccgttatgttcaatgtcctaggacaacatgtccagcaggcaattgaccatgttgcccaaaaccctagcgcccacctccacatgtatggtaaactagaagcaaaacataaccgcaaaatgggacacgtgacggtgtttagcgatgtacctgatgaggtggaagagtttgaagaaaggatggatttctaaggaggtttatggaattttaggggggagaatgattttgaagggagtgttgtcagatgaatagaataataaacagggatattttacctagaatttcaaagatttctaaaaataataaagagaaagatttactatctatagcttatattacttggctaatctttataatatttgctttgggagtagttacagttaatgatttaaaaccgatgtttaatcaattaatagtaaacctcttaaatatttattattatatggaagccttcatattgggtatggacagctatttacaatataaccttccatacagttttgatttttggagtatttttgtagaggctataaatttatttgtaaaagtatttttaattgcttttattccttctgttattagaaaagtattgaaaaaagaaagttttttcaatgaagttgttattttactaggagcgattgttactataattgtaagtttccatttatatttagagatattgatagtagtgggactaatacttttattaattgcttttgtttcaataggtaagaatcgtgtttataattttgttcaaaatttaaactactttgaagaagtgatttggaattattttgaagaaaatccggttaaaataaaagaaaaatcattgattattaaatttttacttactatttcttttgtttttgtaattgattttgcaatggttagattgttgaattttaatataaaattttctacaatattagcttgttctgctattttattagcatggttataccaaaataagtctgttacagaacccttcctattaaaaaagttagttatctattttatttttttcattgccactttaattggtaatttaaaaaatgagttgtcaatcttagaaacaccattactttttattagtatattttttactatggatagaattattgctctatctaaagaaatgcgtgatttgattatatctaagagtattttattttattatgatcatgaaaatataaagccatcaatattacttagtgagataaaagaaattaagtatcttgaaaatgtagatattggagaacttgaacttgttaggcaaatggtaattaggttgcgtctagagttagaggaagaatttttgattttatcagatatatatatgaaaaatggctatgaaaaatatatacaatttgttcaaggaaatgtttattttatcaacttagaattggataaaattcccaactacactaacttgaaattaatactagaatcaatatttgatcataataatcaaaagatatttatacctaaactttatgaggaatacatatacatcttaatttctttaggagaagttgaaaaagctaaagaaatattaaaagaagtgtcggattatttaactgaagaatctttgaattattttgaaaaagaatatgataaagctaagggtagtaattagaattttttaaaggagtaaaacaaaatgatcgaacgttattcacgccctgagatggcggcaatttggacagaggaaaataaataccgtgcttggttggaggtcgagattttggctgacgaggcatgggctgagttgggtgagattcctaaggaggatgtggctaagattcgtgagaaggcggattttgacattgaccgcattcttgagattgagcaggacacgcgtcacgatgtggtggctttcactcgtgcggtttctgagacgcttggtgaggagcgcaagtgggtgcactacggtttgacgtcgactgacgtggtggacactgcctacggttacctctacaagcaggctaacgatattatccgtcgtgaccttgagaatttcacaaatattgtggctgataaggctaaggagcacaagttcaccatcatgatgggtcgtacccacggtgttcacgctgagccaacgactttcggtcttaagttggcgacctggtacagcgagatgaaacgtaatattgagcgttttgaacatgctgccgcaggtgtggaagctggtaagatttcaggtgccgttggtaactttgctaacattcctccatttgtggaacaatatgtttgtgacaaattgggcatccgtccgcaagagatttcaacacaggttcttccacgtgacctccacgcagaatattttgcagtgcttgcaagcattgcaacttctatcgaacgtatggcgacagagattcgtggtctgcaaaaatcagaacaacgtgaagttgaagaattctttgccaaaggtcagaaaggtagctctgctatgcctcacaaacgcaacccaatcggttcagagaacatgactgggctagcgcgcgtgattcgtggtcacatggtgacggcttatgagaacgtggcactttggcacgagcgtgatatttcgcactcatctgctgagcgtatcatcacacctgacacaacgatcttgattgactacatgctcaaccgttttggcaatatcgttaagaacttgactgtcttcccggaaaatatgatgcgcaatatggaatcaacttttggtttgatttatagtcaacgtgttatgctcaaattgattgaaaaaggaatgacacgagaagaagcttatgacttagttcaacctaagacagcttattcctgggacaatcaagtggatttcaaaccacttttagaagaagacaccaaagttacctcttgtcttacacaggaagaaattgatgaactatttaatccgatttattacacaaaacgtgttgatgatatttttgaaagactaggattagaaaaataagaaaattccattactggttaacgtttttttaaccagtaatggaatttttattgatttaaaaggaattaatattaaaaaacatacttaaaatgagtttattatgataatatataataagaagaaaaatttaggagttagtttttaaaggaaaatgttaaaacattttggtagtaaagtaagaaatttgagagtaactagaaatattactcgcgaagatttttgtggtgatgaaactgagttatctgtaagacaattagctaggattgaaagtggacagtcaattccaaacttgactaaagctcactacatagctaaacaattgaatgtaaaattggatattttaacaggaggagagagcttagaattacctaaacggtataaagagttgaagtatttgattttaagaattccaacttatgcagatgctgaacgattaaaattaagagaatgtcagtttgatcatattttcgaagaattctatgataatcttccagaagacgagtgcttagcaattgacagtttacaagctaaatttgaagtctatcaaacaggagacattaattttggtgtggaggttttatgcgaatgctttgataaagtaaaatataaagaaaaatatactcttaatgatttgattatcatagatttgtttttaacttgtgcagttgtatctaaatttaacaatagagcatttactaaagaagtatttcaaactatatgtaaaactttgataagtcagaaccacaaacttacagcagaagatttgttttggtttaatcatgtactcctgaattgtgtatttgttggactttgtttaaatagtgaagagtgtcttgcagaaatgttagaagttagccgacaaacgatggtgtcaacacatgattttcataaaatgcctttatattttatgtaccaatggaaatacttcattacaattgacaatgatataaagtctgcagaaaatgcttaccaacaatcaattatgttttcaaaaatgattgatgacaagcatctaattaaaaaattagaattggagtggcaagaagatataacaggacattgatgtcctgtgactctgaggtctaaaaatttataataaacgtacaaaatattatttaggagtttattatagtgattaaaaaatgttttttaatagtattacttgttctattatcaaatttaggttcatttgatttgtttttaggaatgggttggtggaatatgggctaagtaagctgttctgtgatttcttgaggttggattaactataagatcagtttattcttcctttaaataagggagatactaatacaccaacttagttcttaacttttcctatacaaatgttataataatatcatgacaagatttttagatagtgatgcaatgggtgacgaagaattggtagaacgtacacttcgtccgcagtatttaagagagtatattggacaagataaggttaaagatcagctaaaaatatttattgaagctgctaaattgcgtgatgagtcattggatcatgtgttattatttggccctcctggtttagggaaaacaaccatggcatttgtaattgctaatgagttgggtgtcaatctcaaacaaacatcaggtcccgcaattgaaaaatcaggggatttagtagccattttaaatgatttagaaccaggtgatgttctttttattgatgaaattcatcgtatgccgatggcggttgaagaggtactttatagtgcaatggaagacttctatattgacattatgatcggtgcaggagaaactagtagaagtgttcatctagatttgccgccctttaccttaattggtgcaacgacacgtgcaggtatgttatctaatcccttacgtgctcgctttggtattacagggcatatggagtattatgaagaaaatgatttgacagaaattattgagcgtacagcagacatttttgaaatgaaaattacttatgaagctgcttctgaattagcgcgtcgcagtcgtggaacgccacgtatcgctaaccgtttattgaaacgtgttcgagattatgctcaaatcatgggagatggtttgatagatgacaatattacagataaagcattaacgatgttagatgttgatcacgaggggcttgattacgtcgatcaaaaaatcttaagaaccatgattgaaatgtataatggaggtcctgttggtttaggaactctatccgttaatattgctgaagaacgagatactgttgaagacatgtacgaaccttatttaattcaaaaaggttttattatgcgtacccgtaccggtcgtgtagctacggttaaggcatatgaacatttaggttatcagcgatttgataaataaaacataagtcattttaaggctagagtatctagtcttaattttttaattttcatgcaatgttaagtattagatatgttgtagttattctttgagcagttaaacgtattataagtaccttttttctgttataatagaccaaaaggagtttgctatgaagaaagtctgttttgtttgtcttggaaatatctgccgtagcccgatggctgagtttgttatggcgaatttagataaggaggatagcctcttggttgagagtcgtgcgacttcaacatgggagcatggaaatcctatacataggggaacgcaagcgattttgcagcgttatcaaattccttacattaacgataaagggtcacaacctatttctaaagacgatttagcatattttgattatatcatcggtatggatgagcaaaatgtcaaggatttaaaagctctatcacaaggaacctatgatgataagattagtcttttttgtgatggtggtgttcctgatccatggtatactggtgattttgaggaaacctatcgtctagtcaatgatggctgtaaacagtggttaacgctaataaataatagtagagattaagtagaaatgaagaattttaaaataacacgaactcatctagaaatattatctttgataattattgttgtttttggtttatcagtatttaccttaacgacttctagtcaaggagtctttagctatgatggcggcaagataaaatatgtgggctctattgttaatcaccatatgactggtaaaggtaaattaacctatgagaatggggattactataagggcgattttgtaaatggagtctttgaagggaaaggaacatttgtttcagttcatggctggtcttatacaggtgactttaaaaaaggtcaacctgatggacaaggtcgcctcaatgctaaaaataagaaagtctataaggggacatttaaacaggggatttatcaaaaatgagaataaaatggttttctttggtacgtataacaggactactacttgttttactttaccatttctttaagaatagttttccaggaggatttgttggcgttgacatcttctttacattttctggttttctgattacggccttattgattgatgaattttctaaaacgaaaaaaattgattttgttagtttttgtcgtagacgtttttaccgtattttcccaccattagtattgatggttttggtgacaataccttttgtatttctggttaaaagcgattttagagcaagtattggctctcaaattatgactgctttaggttttaccagcaacttttacgaaatcttgactggtggtaactacgaaagtcaatttatccctcacttatttgtgcatacctggagtctttctattgaagtccatttttatgttttatggggcttaacggtatggctcttatcgaaaagatcaaaagatcaaaagcaattgagggggactttgttccttatttccatgggaatttttggagtcagcttccttaccatgtttgttagagcctttttcgttgataatttttcaacgatatatttctctacattatcacatatatttccgttctttttaggagcgatggtggctacaatatctggtattcgagagattaccggacgattcaagaaaaatatcaaaaatctgactttgaagcataatttaatcatgatgggtagtgcttttgctggtctaatgattttaacttttgcacttgattttgataatcggctaacatatctttttggttttgtattgtctagcatttttgctagtgtaatgatttacaatgcacgtattttacacgagcatacaccagatatttcagaaccttttgtgattacttatcttgctgatatcagttacggtatgtacctttttcattggccattttatattatttttagtcgtttatccccaaactggatagctgttattttgacagtagtattatcagcagtcttctcaacattatcattttatatcattgaaccttttattttaggtagaaaacctaaattccttgattatgaatttgacttgttgccttacaaaaagtggttatttagtatcggaggggtactaactcttattactgtagtgacaatgttgacagctccaagtataggtagttttgagacagaattattgcagaattcgttacaacaagctagaacaaatactaaccgaacacatacactagccgcaggggatgcaggtgctcttagtgatgtgacagtaatcggagattcagttgccttaaggtcaagtgctgcttttaataaattgttaccagaagtacaattagatgctgcggtgagtcgtaattttagtaaatcatttgatatttttgaaaaccgtattcaaaataaagccttgtccaaaattgttgttttggcagttggtgtgaattcattagataactacaagacagacttgagccaatttattaaatctttgcctaagggacaccgtttgattatagtaacaccttataatgctaaaaatatgagtcaagttacgacagtgcgtgattatgaactctcgctaatgaaaaaatataattacataacggttgctgactggtataaggttgcgacagaacatccagaaatctggggaaatacagatggtgtgcattatagtgatagcgatactacaggggctgatttatatgttagtaacgtcaaaaaagctattcaaaaatcagctcaacgagctgcaaaataaacaagtccgagtcatgtactcggctttttttgtgaaaacgaataatagatatctccgtttatggtgataaaaatgaaatcgataggctttaatctgaaaattagtaatgaaaaaacaaatataattaaagcgctttcaagaaatatttccgaaagattgaaaaaaagttcacaaaaaagttgtgaaactatttacaaagtttttaaatatgctataataatctcgtaaacaaatttgtgaaacatttaacaaatcaaaaggagtctcaaatgactgaaaaaactaaagcagtagaaactacagatgttgctcttgcaattgatacattggttcaaaatggtttaaaagcacttgatgagatgcgtcaacttaatcaagaacaagttgattatattgtagctaaagcttctgttgcagccttggatgcccatggagaacttgctcttcatgcagtagaagaaactggtcgtggtgtctttgaagataaagcgacaaaaaatttatttgcatgtgaacacgtcgttaacaacatgcgtcatacaaagacagtgggagttattgaagaagacgatgtcacaggcttgacattaattgctgaaccagtgggagttgtctgtggtatcacgccaacaaccaacccaacttcaactgctattttcaagtcattaatctctcttaaaacacgtaatccaattatttttgccttccacccatcagcacaagaatcatcagcacatgcagcacgtattgttcgtgatgctgctattgctgctggagctcctgaaaattgtgtccaatggattgaacaaccatcaattgatgcaactaatgctttgatgaaccatgatggtattgccactatccttgcgacaggtggtaatgcgatggttaaagctgcctactcatgtgggaaacctgcccttggtgtaggtgctgggaatgttccagcttatgttgaaaaatcagctaatatccgacaagccgctcacgatattgttatgtctaaatcatttgataacggtatggtatgtgcatcagaacaggctgttattattgataaagaaatttataaagaatttgttgaagaatttaaatcttatcatacctatttcgttaataagaaagaaaaagctcttcttgaagaattctgttttggtgcaaaagcaaatagcaaaaactgtgctggtgcaaaattaaatccaaatattgttggaaaatcagcagtttggattgctgaacaagctggatttactgttccagaaggaacaaatattcttgccgcagaatgtactgaagttagtgaaaaagaacctttgacacgtgaaaaactatcacctgttattgcagtattgaaagctgaatctacagaagatggtgttgaaaaagctcgtcaaatggttgagtttaatggtctagggcactcagctgctattcatacaaaagatgcagacttagctcgtgaatttggaactagaattcgtgctatccgtgttatttggaattctccttctacttttggtggtattggggatgtttacaatgctttcttgccatcattgactcttggttgtggttcgtatggacgtaactcagttggtgataacgttagtgctataaatctcttgaatatcaaaaaagtaggaagacgtagaaataatatgcaatggtttaaagtcccttcaaaaacatacttcgaacgtgattctattcaatatttgcaaaaatgtcgcgatgttgaacgtgtcatgattgttacagatcacgccatggttgagcttggtttcttggatcgtatcattgaacaacttgatcttcgtcgcaataaagttgtttatcagatttttgctgaagtagaaccagatccagacattacaacagtaatgaaaggaacagatttgatgcgtaccttcaaaccagacactattattgcattaggtggtggttctcctatggatgctgcgaaagttatgtggctcttctatgaacaaccagaagttgatttccatgacctcgttcaaaaattcatggatatccgtaaacgtgcgttcaaattcccagaacttggtaagaaaacaaaatttgttgctattccaacaacttctggaacaggttctgaagtgacaccatttgccgttatctctgacaaagcaaataatcgtaaatatccaatcgctgattattcattaacaccaactgtagctatcgttgatccggcccttgttatgactgttcctggttttattgcggctgatacgggtatggatgtattgacacatgcaacagaggcttatgtttcacagatggcaaatgattatacagacggacttgctcttcaagcaattaaaattgtgtttgactacttagaacgctcagtaaaagatgctgattttgaagcacgtgaaaagatgcacaatgcgtcaactatggcaggtatggctttcgccaatgcattcttaggtatttctcactcaatggcgcataaaattggcgcacaattccataccgtacacggacgtacaaatgcaattcttttgccgtatgttatccgctataatggaactcgtccagctaaaacagcaacatggcctaagtacaattactatcgtgctgacgaaaagtatcaagatatcgctaaattactcggcttaccagcagcaacaccagaagaagctgtcgaatcatatgcaaaagctgtgtatgaccttggaacacgtttaggtattaagatgaatttccgcgaccaaggcattgatgaaaaagaatggaaagaaaaatctcgtgaactagctttcttagcatatgaagatcaatgttcaccagcaaatccacgccttccgatggtagatcacatgcaagaaatcatcgaagatgcttattatggttatgaggaacgtccaggacgtcgtaagtaacagcagtcgaagaatctcactctattgagtgggatttttagtttcaaaaagattaaccggttaagaatattttcaaaaaattttctgaaaatcacttgacatagtttgtgaagaataatacaatataaaatgtaaacgattacaaaataagatatatttatttctaggaggttttatcatgaaagcggttgttgttaatcaagctagtacaggtgttgaagttgttgagcatgatcttccaaaagttggtcatggtgaagcacttgtaaaagtagaatactgtggtgtatgccatactgatttacacgttgcacatggagatttcggccaggtaccaggacgcattttgggtcacgaaggcattggtatagtagaagaaattggagaaggcgtaacgtctttgagggttggtgatcgtgtctctattgcatggttctttgaagggtgcggtcattgcgaatactgtactacaggacgtgagacactttgtcgtagtgttaaaaatgctggatacagtgttgatggtggtatgagtgaatacgctattgttaccgcggactatgcggttaaggttcctgagggattagacccagctcaagcatcatcaatcacttgtgctggagtaacaacatacaaggctatcaaagaagctggagctgctcctggtcagtggattgcagtgtatggtgcaggtggtcttggaaacttagcagtccaatatgcaaaaaaagtattcaatgctcatgttgtagctgttgatattaacgcagataaacttcaattagctaaagaggttggagcagatttgacagttaatggcaaagaaataaaagatgttgcggcatatattcaagaaaagacaggcggttgtcatggagtggttgtgactgctgtttctaaagttgcgtttaatcaggcgattgacagcgttcgtgctggaggtacagtggtagctgtcggtcttccatcagaatatatggaattgagtattgtaaaaacagtacttgatgggattcgtgtggttggttccttagttggaactcgtaaagacttagaagaagccttcgcatttggagcagaaggcttggtagtaccggtggttgaaaaagtgcctgtggatacagctcctcaagtattcgatgaaatggaaagaggattgattcaaggacgtaaagttcttgactttacaaagtgataatgatgttacgaaccccctttattttaataaagggggttaattatataacgaacaatggacatgttattaaattgtgttacaataactaaaagatatttatataaagagggattcttatggcaatagtatatcaatcaacacgtgatgctagtaataaagtgacagctagtcaagcgattctaaagggattagctgacgatggaggactctttacccccatcacatttccaaaagttgatttagatttcactaaacttaaggatgcttcctaccaagaagtggctaaactcgttttgtcagctttttttgatgattttactgaacaagaattggattactgtattagtcaagcttatgatactaaatttgatacaactgaaatagccccgatagtaaagattggagaccggtatcaccttgaattatttcacggtcctacaattgcatttaaagatatggctttatccattcttccttatttgctaacaacagcagccaaaaaacaaggggttgataataaaatcgttattttaacagcaacatcaggtgacactggcaaggcagcgatggcaggttttgcagatgttccaggaactgagattattgtcttttatcctaaaaatggtgttagttatatccaagaattgcagatgataacacaagccggacaaaatactcatgttgttgcgattgaaggaaattttgatgatgcacagacttcagttaaagaaatgttcaataattcccttcttcgattaaaattatcacagcagcatatgcagttatcatcagccaattcaatgaacatcggtcgccttgttcctcaaattgtttactatatatatgcatatgctcaattagttaagtcaaaggaaatctcaattggtcaaccaattaattttagtgtacctacaggaaattttggtaatattttagcagcatattatgctagtcaaattggattacctgttaccaaactcatttgtgcctcaaatgataataacgttctaacagatttttttaagacacaaacctacgataaaaatcgagaatttaaagtgacatcaagtccctctatggatattttggtctcctctaatctagaacgattaatctttcaccttttaggcgatgatgcagaaacgactaaaaaattaatggaagatttagtgactactggggagtatgccttagaggctaggcaagcaaatattttagagagctttgtagcgggatttgcgacagaacaatttgttgaattagacatcaaacatttatttgaccagtatcagtatatagaggatccgcatacagctgtagcatcagctgtttatcaagcttatcagacagaaactaaagatcaaactccagcagtaattgtgtcaacagcaagtccttataagttcccgtgtgttgttacaaaggctattacaaataaagaagagatacaggatttcgctgctatttcaatcttaaacgatttgtcaggtgtttctttacctaaggcggttacagatctacaaaaggccgaagtaatccatagaacggtagtacctacctcaaatatgcgagaaacggttgaagagtgtctaggtttgaaacaataataaaaatacgattgttttaaaatatttagagcgagaaagaaacattttagaaattttcccatcactctctttttaatgatcctgggtaatagaaaggagatactgtgcgttatagtaaagagattattcagttagctataccagctatgattgaaaatatcttacaaatgctcatgggagtagttgataattatctagtggctcagttaggtgttgtagcagtatcaggtgtttcagttgctaataatataattactatttatcaagctatttttatagctttaggggcgagtatagcaagtctattggccaagtcgttagcaggtagtaagaaggatgatgcaatttcagtatgttctcaagccatttttctaacattactgataggggcagtattaggaattatctcgattgtttttggacaaactttctttaaacttttagggacaacaaaaagtgtcgcacaagttggtggtttatatttagcaattgtgggtggaggtgttgttactttaggaatgttaaccaccctaggctcatttttacgtgtgcaagggcaacctcgtttaccaatgtatgtcagtatttttgtcaatttcctcaatgcagtcttatcaggttttgctatttttgagtggcgctatggtttggtcggagtggcagtatcaactcttatcgcaagattaattggtatttgtatccttgcgaagtatcttcctattaaaaagataataaaaagaatgacttggaaaatcagtgcacaaatttggaatcttgccttaccatcagcaggagaacgtctgatgatgcgagctggagatgttgttatagttgctattgttgttcagttaggtacaaatgttgtagcgggaaatgctattggagaaaccttgacacaatttaattatatgccaggacttggcatcgcaactgctacaattatcctaactgcaaaatatgtaggacaaaaaaacagagaatctatagaagaaactattcaaagttcgtattatattggcttagttctaatgatccttatatcaagttttatgcttcttgcaggcaaaccattgacacagttatttacaaataatccttctgccattaaaggaagtttgattgttattttgctatctttcgtaggagtacctgctactattgggaccttggtttatacagcagcttggcaaggattaggaaatgctaaactcccattttacacaacgactataggcatgtggttaatcagagtagttcttggttatttattaggaatagtttttgaattaggtttgcttggggtttggatggctacgatagcagacaatatctttaggtggctgtttttgaaagttcactatcatcgatatattcaaaaaatgtaaccagaaatggttgcatttttttcgaaaataataaaataatgcttgcgtgtgctgtttttttttgatatcatatactggtgctgtgtatgaacagctttagctatgatgcaagaggttgcgacacgctaggttgcattgccacgcgactcgtgttggttttcttgaggagctagcctattatcgtaaatagacgagaggagaaaagatggcaaacaaaaaaatccgtatccgtttgaaagcgtacgaacaccgtacacttgatacagcggcagaaaaaatcgttgaaactgcaacacgtacaggtgctacagttgctggaccagttccgcttccaactgaacgcagtctttacacaattattcgtgcgactcacaaatataaagattctcgcgaacagtttgaaatgcgtacacacaaacgtttggtagacatcatcaacccaacacaaaaaactgttgatgctttgatgaaacttgatcttccaagtggtgtcaacgtagaaatcaaactttaatttgatttctgagcacaaaaaacgctcgtaaaaaacttttttgagcacaaaaaacgctcataaaaaactttttgaaataaaataagaaaaggaaatattttctcatgacaaaaggaatcttagggaaaaaagtgggaatgactcaaatcttcactgaatcaggcgaattcatccctgttactgtcattgaagcaactccaaacgttgtgcttcaagttaaaactgttgaaacagacggttacgaagcagttcaggttggttttgatgacaaacgtgaagtattgagtaacaaacctgccaaaggccatgttgcaaaagcaaacacagctcctaagcgcttcattcgtgaattcaaaaacattgaaggcttagaagttggtgcagaattatctgtagaacaatttgaagctggtgatgttgttgacgtcacagggacatcaaaaggtaaaggtttccaaggtgttatcaaacgccatggtcaatcacgtggtcctatggctcacggttctcgttaccatcgtcgtccaggttctatgggacctgttgcgcctaaccgcgttttcaaaaacaaacgcttggcaggacgtatgggtggtaaccgtgtaacagttcaaaaccttgaaattgtacaagttatcccagagaaaaacgttgtcctcatcaaaggtaacgtaccaggtgctaagaaatctcttatcactatcaaatcagcagttaaagctgctaaataataagaaaggagaaaacagttaaaatggcaaacgttaaactatttgaccaaactggtaaagaagttagctcagttgagcttaacgaagctatcttcggtattgaaccaaacgaatcagttgtttttgatgttgtaatcagccaacgcgctagccttcgccaaggaactcacgcggttaaaaaccgttcagcagtatctggtggtggacgtaaaccatggcgtcaaaaaggaactggacgcgctcgtcaaggttctatccgctcaccacaatggcgtggtggtggtgttgtctttggaccaactccacgttcatacggctacaaacttccacaaaaagttcgtcgccttgcgttgaaatcagtttattcagcaaaagttgctgaagataaatttgtagctgtagaaaacctttcatttgcagctccaaaaactgctgaatttgcgtcagttctttcagcacttagcattgattcaaaagtacttgtaatccttgaagaaggtaacgaatttgctgcactttcagcgcgtaaccttccaaacgttacagttgctactgcaactactgcaagtgttcttgatatcgttaacgcagacaaacttcttgttactaaagaagcaatctctacaatcgagggggttcttgcataatgaatttgtatgacgtaatcaaaaaacctgttatcactgagaaatcaatggttgctcttgaagcagggaaatatacatttgaagttgacacacgtgcacacaaacttttgatcaaacaagctgttgaagctgcatttgacggagtaaaagttgcaagtgtaaacactgtgacagttaaacccaaagcaaaacgtgttggtcgttacacaggtttcacttcaaaaactaaaaaagctattatcactcttacagctgattcaaaagcaatcgagttgtttgctgctgaagctgaataatctaaggaggaaataacgtgggtattaaagtttataaaccaacgacaaatggccgtcgtaatatgacttctttggattttgcagaaatcactacaaacactcctgagaaatcattgcttgtttcactaaagaataaagcaggacgtaacaacaacggacgtattactgttcgtcaccaaggtggtggacacaaacgtcattaccgtttgattgacttcaaacgtaataaagatggtgttgaagcagttgttaaaacaattgaatacgatccaaatcgtactgcaaatattgctcttgtacactatactgatggtgttaaagcttacatccttgcgcctaaaggccttgaagtaggtcaacgcattatttctggtccagaagcagacatcaaagttggtaacgcacttccgcttgctaacattccagtcggtacagttatccataatattgaattgcaaccaggtaaaggtgctgaattgattcgtgccgctggtgcttctgctcaagtacttggtcaagaaggtaaatatgttcttgttcgccttcaatcaggtgaagtacgtatgatccttggtacttgccgtgcaacaattggtactgttggtaatgaacagcaatcacttgttaacattggtaaagcaggacgtaatcgttggaaaggtgttcgccctacagttcgtggttctgtaatgaaccctaacgatcacccacacggtggtggtgaaggtaaagcaccagttggtcgtaaagcaccatctactccatggggtaaacctgcgcttggacttaaaactcgtaataagaaagctaaatcagacaaacttattgttcgtcgtcgtaaccaaaaataataggttaatagcataatcttatacaaatccgccagctcggtagtacactatagtgtacaggccgttgtggtacattatttaaaggagaaaactacaaaatgggacgtagtcttaaaaaaggacctttcgtcgacgagcatttaatgaaaaaagttgaagctcaagcaaatgacgaaaagaaaaaagtaatcaaaacttggtcacgtcgttcaacgattttcccaagtttcatcggatacacaatcgcagtttatgatggacgtaaacatgttcctgtttatatccaagaggacatggtaggtcacaaacttggtgaatttgcaccaacacgtacttacaaaggtcacgcagctgacgacaagaaaacacgtcgttaataggaggaggacacaatggcagaaattacttcagctaaagcaatggctcgtacagtgcgtgtttcacctcgtaaaacacgtttagtacttgatcttatccgtggtaagaatgttgctgacgcaatcgcaatcttaaaattcactccaaacaaagcagctcgtgttattgagaaaactcttaactcagcaattgcaaatgcagaaaacaactttggtttggaaaaagcaaacttggtagtatctgaaacattcgctaacgaaggaccaacaatgaaacgtttccgtccacgtgcgaaaggttcagcttcaccaatcaacaaacgtacaactcacgtaactgtagttgtatcagaaaaataaggaggtaaaatcgtgggtcaaaaagtacatccaattggtatgcgtgtcggaatcatccgtgactgggatgcgaaatggtatgctgaaaaagaatacgcggattaccttcatgaagatcttgcaatccgtaaattcattaataaagaattagctgacgcatcagtttcaactattgaaattgaacgtgcagtaaacaaagttattgtttcacttcacactgctaaaccaggtatggttatcggtaaaggtggagcaaacgttgacgctcttcgtggtcaacttaacaaattaactggaaaacaagtacacatcaacatcattgaaatcaaacaacctgatttagatgctcaccttgttggtgaaaatattgctcgtcaattagagcaacgtgttgctttccgtcgtgctcaaaaacaagcaatccaacgtacaatgcgtgcaggagctaaaggtattaaaactcaagtttctggtcgtttgaacggtgctgatatcgctcgtgctgaaggttattcagaaggaactgttccgcttcacacgcttcgtgctgatatcgactatgcttgggaagaagctgacacaacttatggtaaacttggcgttaaagtttggatttaccgtggagaagttcttccagctcgtaaaaacactaaaggaggcaaataacaaatgttagtacctaaacgtgttaaacaccgtcgcgaattccgtggaaaaatgcgcggtgaggctaaaggtggtaaagaagtttcattcggtgaatacggacttcaagctacaactagccactggattacaaaccgtcaaatcgaagctgcccgtattgcgatgactcgttacatgaaacgtggtggtaaagtttggattaaaatcttcccacacaaatcatacactgcaaaagctatcggtgtacgtatgggttctggtaaaggggcacctgaaggttgggtagcaccagttaaacgtggtaaagtgatgtttgaaattgctggtgtttctgaagaagttgcacgtgaagcattacgtcttgctagccacaaattaccagttaaatgcaaattcgtaaaacgtgaagcagaataaggagaagacatgaaacttcaagaaattaaagattttgttaaagagcttcgtggattgtctcaagaagaacttgctaagaaagaaaacgaactcaaaaaagaattgtttgatcttcgtttccaagctgcagcaggtcaacttgaaaagactgctcgccttgacgaagttaagaaacaaattgcacgtgttaaaactgtgcaatcagaaatgaaataatagattgggaaaggagaaattctaaatggaacgtaatcaacgtaaaactctttacggacgcgtagtgtctgacaagatggacaaaacaatcacagttgtagttgaaactaaacgtaaccacccagtctatggtaaacgtatcaactattctaaaaaatataaagcacatgatgaaaacaacgttgctaaagaaggcgatatcgttcgtatcatggaaactcgcccactttcagctacaaaacgtttccgtcttgtggaagtagtggaaaaagctgttattatctaatcaaactaaaaggagaaaattgaaatgattcaacaagaaactcgcttgaaagttgctgataatagcggtgctcgtgagatcttgactatcaaagtacttggtggttcaggacgtaaattcgctaacatcggtgacgtaatcgttgcttctgtaaaacaagctactcctggtggagcagttaaaaaaggtgatgtggttaaagctgttatcgttcgtacaaaaactggtgcacgccgcccagacggttcatacatcaaatttgacgacaatgctgctgtaatcatccgtgacgataaaactcctcgcggaactcgtatctttggcccagttgcacgtgaattgcgtgaaggtggctacatgaagatcgtttcattggcaccagaagtactttaatctcagattaacaaacgtagtcccctaggatttcctagggtgcctttcgaggcgtaagaaaaataggagaaaaactcaaatgtttgtaaaaaaaggcgacaaagttcgcgttattgctggtaaggacaaaggcactgaagctgtagttcttaaagctcttccaaaagtaaacaaagttgttgttgaaggcgtagccctcatcaagaaacatcaaaaaccaaataacgaaaaccctcaaggcgctatcgttgaaaaagaagctccaatccatgtgtcaaacgttcaagttcttgataaaaatggtgtagcaggacgtgttggttacaaagttgttgacggcaaaaaagttcgttacaacaaaaaatcaggcgaagtgcttgattaatcacgaaggaaaggagaagcataatggcaaatcgcttaaaagaaaaatatactaatgaagttgttcctgcgttgacagaaaaatttaactattcatctgttatggctgtgccaaaagttgagaaaatcgttcttaacatgggtgttggtgatgctgtatcaaacgctaaaaatcttgagaaagctgctgctgagttagcacttatttcaggtcaaaaaccacttattactaaagctaagaaatcaatcgctggcttccgtcttcgtgaaggtgtagcgatcggtgcaaaagttaccctgcgcggtgaacgtatgtacgaattcttggataaattagtttctgtttcacttccacgtgtacgtgacttccatggtgttccaacgaaatcatttgatggacgtggaaactacactcttggagttaaagaacaattgatcttcccagaaatcaactttgatgacgttgataaagtacgtggtcttgatatcgttatcgttactactgctaacactgatgaagagtcacgtgaattgctaaaaggccttggaatgccttttgcaaagtaatctaggaggtaaataaattggctaaaaaatctatgattgctaagaacaaacgcccagcgaagttctctacgcaagcttacactcgttgtgaaaaatgcggacgtccacactcagtttaccgcaaattccaactttgccgtgtttgcttccgtgacttggcttataaaggtcaagtaccaggcgtaactaaagcatcttggtaataaattaatgatgctttgtgtttaaaaggtgtcgttgataatggcactgatttttaaacgcaaatatactaagacctagtcttacaacgtccgtaaggactcattaattagcaagtgattcaattcaaactgctaataagaggagaattaaaaaatggttatgactgacccaattgcagactttttaactcgtattcgtaatgctaaccaagcaaaacatgaagtgttagaagtacctgcatcaaacattaaaaaagggattgctgatatccttaaacgtgaaggttttgtaaaaaacgttgaagttattgaagatgacaaacaaggcatcatccgtgtgttccttaaatatggacaaaatggtgaacgtgttatcactaacttgaaacgtatttcaaaaccaggtcttcgtgtttatactaaacatgaagatatgcctaaagttcttaacggacttggtattgcaattgtatcaacttctgaaggtcttttgactgacaaagaagctcgccaaaaaaatattggtggagaagtacttgcatatatttggtaaaattttacctaaaatgctcattgagtcacagtataatcctgtgttctcatgagtccccgtgaaaactagttgctcaagcagcttgacaatttaacaggagaaaataaacatgtcacgtattggtaataaagtaattacattgcctgcaggtgttgaaatcattaacaaggataatgttgttactgtaaaaggacctaaaggccaactcactcgtgagtttaataaaaatattggaatcactgttgaagggactgaagtaacagttactcgtcctaacgactcaaaagaaatgaaaacaattcatggtacaactcgtgcgaacttgaacaacatggttgttggtgtttctgaaggtttcaaaaaagctcttgaaatgcgcggtgttggttaccgtgcacaacttcaaggatcaaaacttgttctttctgttggtaagtctcaccaagacgaagttgaagctccagaaggtgttacttttgaagtgccaactccaacaacaatcaacgtaatcggtatcaacaaagaaagcgttggacaaactgctgcttacgttcgtagcttacgttcaccagaaccatataaaggtaaaggtattcgttacgttggtgaattcgtacgccgtaaagaaggtaaaacaggtaaataataggattgatagattttgtagaatcttttctgcaaattctctatcttttcattttaatattgtcattttgacataacaatatatttaagaggtgaaaattgtgatttcgaaaccagataaaaataaaatccgccaaaaacgccaccgtcgtgttcgcggtaaactctctggaactgctgatcgcccacgtttgaacattttccgttctaatacaggcatctacgctcaagtaattgatgacgtagcgggtgtaacgctcgcaagtgcatcaactcttgataaagaagtttctaacggaacaaaaacagaacaagccgttgttgtcggtaaacttgttgctgaacgcgcagtagctaaaggtatttctgaagtggtgtttgaccgcggtggatatctctatcacggacgtgtaaaagctttggctgactcagctcgtgaaaacggattgaaattctaatagggaggacacttaataatggcatttaaagataatgcagtagaacttgaagagcgcgttgttgcgattaaccgcgttacaaaagttgttaaaggtggacgtcgtctacgttttgcagctcttgtagttgttggtgaccgtaatggtcgtgttggttttggtacaggtaaagctcaagaagtaccagaagctattcgcaaagctgttgaagctgctaagaaaaacatggttgaagttcctatggtcggtacaacaattcctcacgaagttcgttcagaatttggtggagcgaaagtattgttgaaaccagctgttgagggtgctggggttgccgctgggggtgctgttcgtgccgtcatcgaattagcaggtgttgcagatattacatctaaatcacttggttcaaacactccaatcaacattgttcgcgcaactgttgagggcttgaaacaattaaaacgtgcagaagaagttgctgctttacgtggcatttctgtttctgacttagcataagaaaggggattataatggctcaaattaaaattactttgactaagtctccaatcggtcgcaaaccagaacaacgtaaaacagttgttgcccttggacttggtaaattaaactcttcagttgttaaggaagataatgctgccatccgtggtatggttaacgctatctctcacttagtaactgttgaagaagcttaattaaatgctaaatcgcactgattgttattggtgcgatttaaacaaatcgtataggcgagtctttgcggggagtaccttttccctcgtaaaggcgttagcattttacaaataaggagaaaaaataatgaaacttcatgaattaaaacctgcagaaggatcacgtaaagtccgcaatcgtgtgggtcgcggtacatcttcaggtaatggtaaaacttctggacgtggtcaaaaaggacaaaaagcgcgtagtggtggtggagtacgccttggttttgaaggtggacaaactccattgttccgtcgtatgccaaaacgtgggttctcaaacatcaatgcaaaagaatatgctcttgtgaaccttgaccaattaaatgtctttgaagatggtactgaagtaactccagttgttcttaaagaagctggaatcgtgcgtgctgaaaaatcaggcgttaaaattcttggtaatggtgaattaactaagaaattgtctgttaaagcagctaaattttctaaatctgctgaagcagctatcactgctaaaggtggttcaatcgaagtcatctaattaatgagaggtaactcattatgtttttaaaattacttagagatgcactcaaagtaaagatggtaagaaataaaattttatttactatctttatccttcttgtatttcgtatcggaacgcatatcacagtaccgggcatcaatgttaagagtttagaacaaatgggtgaacttccatttctaaatatgcttaacttagttagtggtaatgcaatgagaaacttttcggtattctctatgggagttagcccttacattactgcgtctattgttgttcagttacttcaaatggatattcttccgaagtttgttgaatggggaaaacaaggagaggtaggtcgtcgtaagcttaaccaagctacacgttatatttctttgttccttgcattcgtacaatcaattggtattactgctggttttaacactctatcaagtgttgctttagttaaaactccgaatgtacaaacatatttgcttattggtgcaatccttacaacaggtagtatggtggttacttggctaggtgaacaaattactgataagggattcggaaatggagtgtctatgattatctttgcgggtatcatttcttccattccaagtgcaattacaactatctacgaagatttctttgtaaatgtacgctcttcagcaattacaaattcttacatctttgtcgggatccttatcgtagcagtattagcaattgtattttttacaacatttattcaacaagctgaatacaaaattccaatccaatatacaaaacttgttcaaggagctcctacaagttcatatcttcctctaaaagtaaatccagctggtgttattcccgttatctttgctagctcgattacaacaattccaagtacgattattcctttctttcaaaatggcaaagaaattccttggcttactaaactccaagaattacttaattatcaaaccccagtcggtatgattatctatgctatcttgattattctgttctctttcttctatacttttgtacaagtaaaccctgaaaagacagcagagaatcttcaaaaaaattcgtcctacattccaagtattcgaccaggacgagaaacagaagaatatatgtcatcgctattgaaaaaattagcaacaattggttcagtatttctagcatttatttccttgttaccaattattgctcaacaagcgttgcatttgtcatcaagtattgcgttaggtgggacaagcttactcattttgattgcaacgggtattgaaggtatgaaacaactcgagggctatcttttgaagagacgctatgttggattcatgaatacaacagaatagaatataggttgactctgtcaaccttctattttgttttttaataagtccgacatgctgtgttggatttatttaaaaacaaaataaggagactataatgaatcttttaattatgggtttgcctggtgctggtaaaggtactcaagcagctaagatcgttgaagaatttggtgttgctcacatctcaacaggggatatgttccgcgccgcaatggctaatcaaaccgaaatgggacgtttagctaaaagttatattgataaaggtgaattggttcctgatgaagtaacaaacgggattgtaaaagagcgcttagctgaggatgatatcgcagaaaaaggttttttacttgatggatatccacgtactattgaacaagcacacgccttagatgctacgcttgaagaactaggactacgcttagatggtgttattaatattaaagtggatccatcatgtcttatagagcgtttgagtggtcgtattatcaatcgtaaaactggtgaaactttccacaaagtgttcaacccaccagtagattataaagaagaagattactatcaacgtgaagatgataagcctgaaactgtcaaacgtcgcttggacgttaatattgctcaaggagaacctattcttgaacactatcgtaagcttggtcttgttacagatattgaaggtaatcaagaaataacagaagtttttgcagatgttgaaaaagcgttgctagaactcaaataaattatgctaatctacttgcataagtagattagtaatgatatactaagttagtctgacttataattgttacctctttatagaggacatcaaatcgaaatttagggggtacttttgcgtggcaaaagaagatgtgattgaaattgaaggtaaagttgttgaaactatgcctaacgcaatgtttactgttgagttggaaaatggacaccaaattttggcaactgtatcaggaaaaatccgtaaaaactacatccgtattttggtaggtgatcgtgttactgttgaaatgagcccatacgatttaacacgtggacgcatcacataccgctttaaatagtcgaaataattggagggattaaaacatgaaggtaagaccatcggttaaaccaatttgcgaatactgtaaagttattcgtcgtaacggtcgtgttatggtaatttgtccgacaaacccaaaacacaaacaacgtcaaggataatatagaaaggagataaaatggctcgtattgctggagttgatattccaaatgacaaacgtgtagtaatttcacttacttatgtatacggaattggtctttctacatctaaaaaaatcttagcagctgcaggtatttctgaagatatccgcgttaaagatttgacaccagatcaagaggacgctatccgtcgtgaagttgatgcaatcaaagttgaaggtgacctacgtcgtgaggtaaacttgaatattaaacgtttgatggaaatcggttcataccgtggaatccgtcaccgtcgtggacttcctgtccgtggacaaaatactaaaaataacgctcgcactcgtaaaggtaaagctgttgcgattgcaggtaagaaaaaataaaataggaggtaaaacaattggctaaaccaacacgcaaacgtcgtgtgaaaaagaacatcgaatctggtgttgctcatattcacgctacattcaataacactattgttatgattacagatgtgcatggtaacgctcttgcatggtcatcagctggtgctcttggatttaaaggttctcgtaaatctactccatttgctgctcaaatggctgctgaagctgctgctaaatctgcacaagaacacggtcttaaaactgttgaagttactgtaaaaggtcctggttcaggtcgtgaatctgctatccgtgcccttgctgcagctggtcttgaagtaactgcaattcgtgatgtgactcctgtaccacataatggtgctcgtcctccaaaacgtcgtcgtgtataatcatagcattttatagtacacaacttttcgtttaagagggagtaactaaatgattgagtttgaaaaaccaataataacaaaaattgatgaaaataaagattacggcagatttgtcatcgaaccactagaacgtggctacggtacaactctaggaaactctcttcgtcgtgtgcttctgtcttcacttccaggtgcagcagtcacatcaatcaaaattgatggagtattacacgaatttgatactatcccaggtgtacgtgaagatgtgatgcaaatcatccttaatgtaaaaggacttgctgtgaaatcttacgtcgaagacgaaaagattatcgaactagacgttgaaggtcctgcagaaattactgccggagatattttaacagatagtgatatcgaaattgtaaaccctgaccattatcttttcacaattgctgaaggtcacagtttgaaagcaacaatgacagttgctaaaaaccgaggttatgttccagcagaaggaaataaaaaagatgatgcaccagtgggaacattggctgtagattcaatctatacaccagtgaaaaaagttaattatcaagttgaacctgctcgtgtaggtagtaacgatggctttgataaattaactattgaaatcatgacaaatggcacaatcattcctgaggatgctcttggtctttcagctcgcgtcttaattgaacacttaaacttgtttactgatttaacagaggttgctaaagcaactgaagtaatgaaggaaacagagaaagtgaacgatgagaaagtgcttgaccggacaattgaggaacttgatttgtcagtgcgctcatataactgtttaaaacgtgctggaattaatacagtatttgatttaacagaaaaaactgagcctgaaatgatgaaagtccgaaacttaggacgtaagagtcttgaagaagttaaaatcaaacttgccgatctaggtcttggattaaaaaacgataaataaaataggaggacataatggcttaccgtaaactaggacgcactagctcacaacgtaaggcaatgcttcgtgatttgacaaccgatcttcttatcaacgaatcaattgtaactactgaagcacgtgctaaagaaatccgtaaaacagttgaaaaaatgattactctaggtaaacgtggtgatttacatgctcgtcgtcaagctgctgcttatgtacgtaatgaaattgcatcagaaaactatgatgaagcttctgataaatatacatcaacaacagctcttcaaaaactttttgacgacatcgcacctcgttatgctgaacgtaacggaggatacactcgtattcttaaaacagaaccacgccgtggcgatgctgccccaatggcaattattgaattagtataatttttatcaattttgttgagtgttatgatgatggaatcaatcgattcttagtctagctctggtctaccgctgagaattattctcagcgggaacactcatcatatattgttaaataggtaacgcttgtttacgaaatgcaaacaattttgtttatatttcgtaagcaggcgttttatgcattattatatttattggatattttcgatgagcaaagaatttaatcgctagactacatttctcaatagtggttatataatttctcttaattgaatatagaggaatagttatgtctatactaaatttataaaatacaaaaatagtattgacaggaagtagaaatatttagtataatgaataagttgtctcgagagagcagtttctattagcgcgtagttaacaacttaaaaaaagtagttgacaaagcagaataagtttgctagaatatagaagttgtctcaagagaggcaaagacctttgaaaactgaacaagacgaacgaatgtgcagggtggatttacattgtaaatccgtcaatgacaaaaaacaataaatctgtcagcgagacagaaaagagcaaagctcaaacttttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggataaggaaacctgccatttgcgtcttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattgtagaaagtaacaagaaaataaaccgaaaacgctgtgaatatttaatgagttttctagttttaaagaaactaggttaataaggttaagttaataagggcgcacggtggatgccttggcactagaagccgaagaaggacgtgactaacgacgaaatgctttggggagctgtaagtaagcgctgatccagagatgtccgaatgggggaacccactagttaatgactagtatccatatctgttaaggatatgagaaggaagacgcagtgaactgaaacatctaagtagctgcaggaagagaaagcaaaagcgattgccttagtagcggcgagcgaaacggcaggagggcaaaccgaagtgtttacacttcggggttgtaggactgcgatataggattaatcattatagaagaattacctgggaaggtaagccaaagagagtaacagcctcgtatttaaaatgatagattaaccttagcagtatcctgagtacggcgagacacgcgaaatctcgtcggaatctgggaggaccatctcccaaccctaaatactctctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcgtcatagtatcatgttgtagacccgaaaccatgtgacctacccatgagcaggttgaaggtgaggtaaaactcactggaggaccgaaccagggcacgttgaaaagtgcttggatgacttgtgggtagcggagaaattccaaacgaacttggagatagctggttctctccgaaatagctttagggctagcgtcgatgttaagtctcttggaggtagagcactgtttgggtgaggggtccatcccggattaccaatctcagataaactccgaatgccaacgagatataatcggcagtcagactgcgagtgctaagatccgtagtcgaaagggaaacagcccagaccaccagctaaggtcccaaaatatatgttaagtggaaaaggatgtggggttgcacagacaactaggatgttagcttagaagcagctattcattcaaagagtgcgtaatagctcactagtcgagtgaccctgcgccgaaaatgtaccggggctaaaacatattaccgaagctgtggatgacacaaaagtgtcatggtaggagagcgttctatgtgtgaagaaggtgtaccgtgaggagcgctggaacgcatagaagtgagaatgccggtatgagtagcgcaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatatagtgatggagggacgcagtaggctaactaaaccagacgattggaagtgtctggtcaaacagtgaggtgtgatatgagtcaaatgcttatatctttaacattgagctgtgacgaggagcgaagtttagtagcgaagttagtgatgtcacactgccaagaaaagcttctagcgatacatatactctacccgtaccgcaaaccgacacaggtagtcgaggcgagtagcctcaggtgagcgagagaactctcgttaaggaactcggcaaaatggccccgtaacttcgggagaaggggcgctgattttagatcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctatgataacgggacgccagtttcgtttgaggcgttgttgggatactacccttgtgttatggctactctaacccagataggcaatccctatcggagacagtgtctgacgggcagtttgactggggcggtcgcctcctaaaaggtaacggaggcgcccaaaggttccctcagactggttggaaatcagtcgtagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataagcgctgaaagcatctaagtgcgaagcccacctcaagatgagatttcccatgattttatatcagtaagagccctgagagatgatcaggtagataggttaggagtgtaattgtggtgacacatttagcggactaatactaatagctcgaggacttatccaaaaagagatattgacaacgttacggtttcttgttagactatagatattcaattttgagtgaataaggctcaatagttaagtgataattgcctaggagatacacctgttctcatgccgaacacagaagttaagccctagaacgccggaagtagttgggggttgccccctgtgagataaggtagtcgcttagcaaagggagtttagctcagctgggagagcatctgccttacaagcagagggtcagcggttcgatcccgttaactcccataggtcccgtagtgtagcggttatcacgtcgccctgtcacggcgaagatcgcgggttcgattcccgtcgggaccgtagactcgttagctcagttggtagagcaattgacttttaatcaatgggtcactggttcgagcccagtacgggtcatttagaaatgcgggtgtggcggaattggcagacgcaccagatttaggatctggcgcttaacggcgtgggggttcaagtcccttcacccgcattagtagattgccggcttagctcagttggtagagcatctgatttgtaatcagagggtcgcgtgttcaagtcatgtagccggcattaactttataattttagaagttattttgggcgcgtagctcaggtggttagagcgcacgcctgataagcgtgaggtcggtggttcgagtccactcgtgcccatcaagaatatggtccgttggtcaaggggttaagacaccgccttttcacggcggtaacacgggttcgaatcccgtacggactattttttgttatatggaggattacccaagtccggctgaagggaacggtcttgaaaaccgtcaggcgtgtaaaagcgtgcgtgggttcgaatcccacatcctcctttaaagatatcgcgggatggagcagctaggtagctcgtcgggctcataacccgaaggtcgtaggttcaaatcctgctcccgcaataggctcggtagctcagttggtagagcaatggattgaagctccatgtgtcggcggttcgattccgtctcgcgccatttataccttaggagagatagcgaagaggctaaacgcggcggactgtaaatccgctccttcgggttcgggggttcgaatccctctctctccatagtaaacgggcatagtttaaaggtagaactaaggtctccaaaaccttcagtgtgggttcgattcctactgcccgtgttttttctaatatggcgggtgtggtgaagtggttaacacatcagattgtggctctgacattcgtgggttcgattcccatcactcgccttttcatggggtatagccaagcggtaaggcaagggactttgactccctcatgcgttggttcgaatccagctaccccagttttaagatagccggcgtggcggaattggcagacgcgctggactcaaaatccagtgtcctcacggacgtgccggttcgaccccggccgccggtatatttataaagacaaggtttagaagccttgtcttttttgtattgtgctggtaattttgagaaaaagttactgaaaattacttatatttgtttttcattattgcaatcgttatagaaggtttaaaacaagcagaaataataaggaaatttttcaagagttagtggagactcaacatttaaatgaaattcaaagaggactcctaaatgtcataggttctgaagtaataaaagtgtttgtgaatgatagataggtagtataaaataataagatttttcagtgtatatgttacgactaaaaaattaaactcgtgaaaatttgttatactaatattagttttaacatactggtaaataataattatttttattagatacttgacatgggaagtttattttctaagaaaagagagcatgttgaaaaaatatgtaaaatggttaattcccatatctattattgggatgttactagcaggctgtcaaatgaatagtgaatctaaaagtcagtcaaacgaagtaaaaaatagcaaacagtcagcagtaaagaaaggtaaaaaagtaataaaaaaagaacaagtagcttatctcaaaaagcatgaaaaagaattaactgaatatgtcaaaatccagatattagtgaaattaagtatgattggaatagtgtgcgcatagtggaagctagtagtggaacccctcaaggcggagagcaactattattaattttgggttatgcaaatggcagtgaattaaccaattttactctaaatttcacattgggtgataatcaaatgcctaatattgactcagttggctcagataatttatcaactattgaagattaataataacaataagaaaggtatataatgggatgatggaatcttaaggaatttgaagatatattttgaagtatggcagaaagtgctaatacaggtcgatcgaattcttttgttttagaagaattaactgaatttcaaagagaaaagttaaaaaatggggagtcagttaagtttaatttttctaaagatgttaagaaagaaaataaggttatcgaaggagggcacccccaagtcatagggtaatctacctgcaaactggataagtccttaaatacaattgatgaaaaagtagaggttcgcgttcctgatgtcaatggcggttatcactctgagcattgtgttactaattcctatcagaaaggttactgaaagatgatgaagcagtaactctataatcactaaaagctcatcattgcttagtgtttaagttaacttctaaagctcaaaccttgttaaatcaaggtctgtttgcttttaaaagtgacatgttatttttctaaaaatgagattattgggattcctcattctaagttactttgtttatatgtacctttacttaaggtttattttcattatttttaatttaatattttggagtatgtatgctccattatagtattttcgaagacatctttaaaaggactgtagaagttaaaatattttaacctagtatctaacgtcatatattggtacatagttttaagtatccttttgataaccttgtacatatgaaataggctagatatttttagtgaactaaatgtaagtttattgcttgtattaggcgggataacaatattgttgtttttattctttctgagtaatggtttattaatcatgtaattattctggtatcaaatgatacttttaatattccagtttgtcaataaatcatcaatgtaattcttttcatcaaaagcgatccctttatctagttgatttaatatgttaacttgatgattgttcttcttgcttaatatatgggataataattatcttaaattgacacttggagcattcaatcacgtgatgtaataactaaaaattgtttaaaatttaaggatgtatttcttgttgatcttactatctgatctaataatagtatataataagattaaaatttaaacattgtctggagatgtagcaaaggagataaaatgactaaaatttatcatatgattttatgtaattctgatataatgaagattttagctataataaaatctcttccactgaatgattgttggctgtgtgctggcacattgagaaactttgtatggaataaactttctggaataaatgagacattgacatcagatattgatgttgtattttttgataaaaatatttcttatgaagaaacggtggtattagaacaacaattaaaggataactatccacagtacgattgggaacttaaaaatgaattttacatgaacactcattctcctaataccccaaagtatactagctctaaagatgctatttcaaaatttcctgaaaagtgtactgcagtgggagcaaggttagatgatagaaatcaactcgaactttacctcccttatggtgaagaggaaatattaaatttcattgttagtcctacgccatattttgaagaggatctattacgttataatgtttatttgaagcgagtggataagaagaaatggaataatatttggcctcgtttaacaatcataaaaaaatgataacgttactggagttggcttaacagcttttaaatttttagactgacaaatagtatagacctttaataaggtcgtttatcgataatcatagtgtactgtgttataatcgttatagcataaaaacacgttgcagttggtagtctgcaagcgttcagtgaacgtcagtaaccttccctccaggtcgtccattgcaatttaatatttaaaggagggggctgtatgaaaatgacagtctattttgatggtaatttttggttgggtttgattgagtacgatgatgatggtgattacaaagtttttcggtatttttttggaaaagaacctaaagatgatgatgtttttaattttataaatcataaacttaatgatttgataaaaaaatatgagtttgttaaaacggatatttctctaaagcgtacgaatgaacacaaaaaaagtcctaaaagaatgcaaagagaaattaatagagaaaaacgtaagccagtagtatctacaaaagcgcaattggcgatgaaaactattcatatgagtataaaaaacgaacgtcaattaagtcagaaatgtaagaaaaatgagttaagaaaacatcggtaccaattaaaacaagaaaaacgttaccaaaagaaaaaaggacattgattgtgtcatcatataaaaagcttgagagtgtcatctcaagctttttatatgttaactaatatgagtcactaaatagtctgataatgctcaattaatgtgttttgggaaaaaatcatttccttaaaggacaccattgtcatgttgttatcaccttactttttttatacttagtatatgtttaagaaaggaataagttgttttgagagattttgaggagttgtttgataaagtaaagccaatcgtaatgaagctgagaagaaattattttgttcaactttgggaatatgatgattggattcaagaaggacgtattgtactttttaggttgcttgaagagcatccgtatttattggataatgaaagcaaactattcatttactttaaaacaaaattttcaaattatttaaacgatgtattaagacaccaagattgtcaaaagcgacaatttaataaaatgccttatgaagaaataagtgaagttagtcactatgttaagagtaaaggactagttttagatgactatattgcttatcgtgatactttaacaaaagtggaagaaactttgtcagatattgataaagaaaaatttgaaaaactgattagtggtgaacgttttgcggggaagaaacaattcatacgagatattcaaccctttttcaatgcttttaaagcggattaatcgattttatttctgcagtagatagctgcagaatttttttatagggaaagttcgctgatatattcctgtgaaagcctttgttttttgttataatataataaaatgcttgtgaggtgtcagtatgagtaaagttcgtttatatatcgctcgtcatggtaaaacaatgtttaatacaattggtcgcgctcaggggtggagtgatactcctttaactacttttggagaactcgggattaaagagcttggtttgggactaaaggcttcaaatattagttttaaagaggctttttctagtgatagtggacgtactttacaaactatggaaattattctcagggaagtgcaacaagaaaatattccctatacgagagataaacgaatccgcgagtggtgctttggtagtttggatggaggatatgatggcgacctttttaatggcgttctgcctcgagtttcaaacggagatatgagccatttgacacacgaagaaattgctaatttgatttgtcaagttgatacggctggctgggcagaaccgtgggcaatattgagtaaccgtattctgtcaggcttcactgctatagctaaaaaaatagaggatattgggggaggtaatgcgattgttgtcagtcatgggatgactattgcgacttttttatggttaatcgaccatagtacccctcgtagtttaggcttagataatggtagtgtctcagtcgttgattttgaagatggaacattttctattcaatctattggggatatgtcctatcgagaaaaaggaagagaaattttagaaaaaacattgcaatgaaaaaaaataaaattatccgattcagtttagttggtgttctacttgcgatactatgctttagtctttttgctttattgaagcctaacagtcaacaatcatcatctcaaaagttgaggaatgaggatataaaaaagatatcctctcaaaaaagaaataagaaattacaattaccagctgtatcatcaaaagattggaacttgattttggtcaatcgtgaccataaacatgaagaattaagtccagatgtggttcctgttgaaaatatttatttggataaacgtattacgaagcaagctactcagtttttagaggctgctagagcaattgattcacgagaacatttaatttcgggttatcgtagtgttgcctatcaggagaagttgttcaattcttatgttactcaagagatgactagtaaccctaatttgacgaggggacaagcagaaaagttggtaaaaacttactctcagcctgcaggtgctagtgaacaccagactggattagcgatggatatgagtactgtagattctttgaatgagagcgatcctagagtagtcagtcagttgaaaaagatagctccacaatatggttttgtcttacggtttccggatggtaaaacagcagaaacaggggtaggttatgaagattggcattaccgctatgttggggtagagtctgcaaaatatatggccaaacatcatttaacattagaagaatacataactttattaaaggagaataaccaatgaggaaacgtttttccttgctaaattttattgttgttacttttattttctttttctttattctttttccgcttttaaaccataagggaaaagtagatgctaattctaggcagagtgttacctacaccaaagaagaatttatacaaaaaattgtgccagatgcgcaagatctaggaaagtcgtacggtattcgtccttcatttattattgcacaggcggctttggattctgatttcggagagaaaatattagctaataagtatcataatctgtttggtttgcttgcagaaccaggaacgccctcaattaccttaaatgatagtagtacaggaaaaaaacaggaaaagcaatttactcattataaatcttggaagtattcaatgtatgattaccttgctcatataaaatctggagcgacaggcaaaaaagattcatatactataatggtgtctgttaaaaatccaaaaactttagtgcaaaaattacaagatagtggttttgataatgacaaaaagtacgctaaaaaaatgacggaaatcattgatttgtatgatttaacaagatatgataagtgatattagcactctttgaataagagtgctaatttttgatgttttttccttgactatcttttaaaaaggagtataataaaatcatagttagcagtcgatgtgtaagagtgctaatttcagaaagaccgagaggggtgatgtttttgtgattacacaacgtcaaaatgatattttgaatttaatcgttgagttatttacacaaactcatgaaccagtagggtctaaagctttacagagaacgattgattctagtagcgccactattcgtaatgatatggcaaaactagagaagttggggttattggaaaaagcacacacttctagtggacggatgccgagtccagctggttttaagtattttgtagagcactcccttagactagatagtattgatgagcaagatatttatcatgttataaaagcttttgactttgaagcattcaaattagaagacatgcttcaaaaagctagtcatattttatcggagatgacgggctatacatccgttattttagatgtggagccagctcgtcaacgtttgacagggtttgatgttgttcagcttagcaaccatgatgctctagcagtcatgactttagatgaatctaagccagtgacagtgcagtttgctattccaagaaactttttgacacgtgacttgatagcatttaaagctatcgtagaggagcgcttgctggatggtagtgtcatggatattcattataagttgaggacagaaattcctcagatcgttcagaagtattttgtaactacggataatgttttacaactatttgattatgttttttcagagctgtttctggaaacggtatttgtagctggcaaggtaaattctttaacgtattcagatctatcaacgtatcagtttttggataatgagcagcaagtagcgatttctttgaggcaaagtctgaaagagggtgagatggcttctgtccaagtggcagatagtcaagaagccgcacttgcagatgtgtcagttttaactcacaaatttttgattccttaccgtggatttggactcctgagtttgattggtcctattgatatggattatcgtaggtctgttagtttggtaaacattatcggaaaggtattggctgctaaattaggtgattattatcgatacctaaattctaaccattatgaagttcactgataatggcagtattcaataagttatttaaaaggaggcactcagtgtcagaagaaattaaaaaagacgatttacaggaagaagtggaagccactgaaactgaagagacagttgaggaagttattgaagaaattcctgaaaaatcagagttagaactcgcaaacgagcgtgctgatgagtttgaaaataaatacttgcgagctcatgcagaaatgcagaatatacaacgtcgctctagtgaagaacgtcaacaacttcaacgctatcgttctcaggatctggcaaaagcaatcttaccatcgcttgacaatctagaacgtgccttggctgttgaagggttgacagatgatgttaaaaaaggtttagaaatgactcgtgatagccttattcaagcactaaaggaagaaggcgtagaagaagtagaagtcgactcatttgaccacaactttcatatggcagttcagactctcccagccgatgatgaacatccagccgatagcattgcagaagtctttcaaaagggatataaattgcacgagcgtctgctaagaccagcgatggtagttgtctataactaaggtaaatgagttttcgtttttgtccgtaatgacagtaaactagatagcaagttagaagctattcagcttgctgattaaactatagtgattgcttagaattggaagtaaaataattcgagtgcttactaagataaattgaaataaaaagtaataaagtattataaaataagaggtattaacatgtctaaaattattggtattgacttaggtacaacaaactcagcagtagcagttcttgaagggactgaatcaaaaatcattgctaacccagaaggcaatcgtacaactccttcagtagtatcattcaaaaatggtgaaattatcgtgggtgatgctgcaaaacgtcaagcggtaacaaatccagatactgttatctctatcaaatcaaagatgggaacttctgaaaaagtttctgcaaatggtaaagaatatactcctcaagaaatttcagcaatgattcttcaataccttaaaggttatgctgaagactatcttggagaaaaagtagaaaaagcagttattactgttccagcttacttcaacgatgcacaacgtcaggcaactaaagacgctggtaaaattgcaggtcttgaagtagaacgtatcgttaacgaaccaacagcagccgcacttgcttatggtatggacaagactgacaaggatgaaaaaatcttagtttttgaccttggtggtggtacatttgacgtatcaatccttgaattaggtgatggtgtcttcgacgttcttgcaacagcaggtgataacaaacttggtggtgacgactttgaccagaaaattattgatttcttggtagaagaattcaagaaagaaaatggtattgatctttctcaagacaaaatggctcttcaacgcttgaaagatgctgctgaaaaagctaaaaaagacctttcaggtgtaactcaaactcaaatttcattaccgttcatcactgctggttctgctggtcctcttcacttggagatgagcttatcacgtgctaaatttgacgatctcactcgtgaccttgttgaacgtacgaaaactccagttcgtcaagctctttcagatgcaggcttgtcattgtcagaaattgatgaagttatcctcgttggtggatcaacacgtatcccagcagttgttgaagctgtaaaagctgaaactggtaaagaaccaaataaatctgttaaccctgatgaagtggttgctatgggtgctgctatccaaggtggtgttatcactggggatgtgaaagacgttgtacttcttgacgtaacaccattgtcacttggtatcgaaacaatgggtggtgtcttcactaaattgatcgaccgcaacacaacaatcccaacatctaaatcacaagtcttctcaacagcagcagacaaccaaccagccgttgatatccatgttcttcaaggtgaacgcccaatggcagcagataacaaaacactcggtcgcttccaattgactgatatcccagctgcacctcgtggaatcccacaaattgaagtaacatttgatatcgataaaaatggtattgtatctgttaaagctaaagatctcggtactcaaaaagaacaacacattgttatccaatctaattcaggattaactgatgaagaaattgataaaatgatgaaagatgctgaagcaaatgctgaagcagatgcaaaacgtaaagaagaagttgatcttaaaaatgaagttgaccaagccatctttgcaacagaaaaaactattaaagaaactgaaggcaaaggctttgatacagaacgtgatgcagcgcaatcagcacttgatgagttgaaaaaagctcaagaatcaggtaaccttgacgacatgaaagctaaacttgaagctcttaacgaaaaagcacaagctcttgcagttaaactttacgaacaagcggctgcagcacaacaagcagctcaaggggctgaaggtgcacaatcagctgattcatcaagcaagggtgatgatgttgtagatggcgaattcactgagaaataattattaatattgttcagattcatttgaatataagcatgaaaactatactagcatagtaaagttcttcgtgataggggttgctcaataatctagataagtttcagattacataagctaatttcgctatcactaaataaaaacatattaataataaataggcggggcgcctcgctccgtctgttttattaagtgtcatatatatgttaactatttagagctgtaactgggcaagaataattgttaatctcttcaagtgtagtatatgaacaaaatataaaggattagataatgaacaatacagaattttatgatcgtcttggcgtttcaaaagatgcttctcaggacgaaataaaaaaagcttaccgtaggatgtctaagaaataccatccagatattaataaggagacgggagcagaggaaaaatataaagaggttcaagaagcttatgaaaccttgagtgatacacaaaaacgtgctgcctatgatcaatatggcgctgctggggcaaatggcggttttggtggcttcgatggtggcggttttggtggcttcgatggtggtggctttggtggttttgaagacatcttctcaagcttttttggtggaggagggatgcgcaatcctaatgcaccacgtcaaggagatgacctacaatatcgtgttaatttaagttttgaagaagctatctttggagctgaaaaagaagtatcttataatcgggagtcatcatgtcatacttgttcaggaagtggagctaagccaggtactagccctgtgacttgtcaaaagtgtcatggttcgggtgtgattaatgttgatacacaaacacctctaggaacaatgcgtcgccaagtgacttgtgatgtttgtcagggtagtggtcaagaaatcaaagagaaatgtccaacatgtcatggaactggtcatgagaagaagacgcataaagtatcagttaaaatacctgcaggagttgaaactgggcaacaaattcgtttaacaggacaaggtgaagctggcttcaatggtggtccttatggtgatctctttgttattattaacgttctcccaagccaacagtttgagcgtaatggatcaacaatttattatactttgaatattagctttgtccaagctgctttgggtgatacaattgatatacctactgtccatggagcggtagaaatgtcaattcctgctggtactcagacaggaaaaacgtttcgtcttcgcggaaaaggtgcccctaaacttcgagggggtggacaaggtgatcagcatgttactgttaacatcgtaactcctactaaattgaatgatgctcaaaaagaggcattgcacgcttttgcagaggcaagtggagataagatggtacatccgaagaagaaaggtttctttgataaagtcaaagatgctttagatgttgattaaaaaataaaagtctagaatcgaaagtattctagacttttttgtattgctagagggattgcttgaacctaaattttacagtacaatgaatctaatattgtagggggacaatttttatggtaaccaaagttgaagagattcgctcatatttgatagcttctatacaaaatggtaagttggctccaggagatcgcctaccatctataagacagttagctaatcaattttcctgtaacaaagatacagtccaacgagttttgatggaattgcgttttgataattatatctatgcaaagcctaggtcaggctattacgtctttgattctcatcaagaggaagttgaagaaggggttagtttaccaaactctgagattgcaaatatagcttatgatgattttagattgtgtttgaatgagacccttattggtagggaagattaccttttcaattattactatcgtcaagaaggtcttcttgatttaagtaaagcagtggctaaattaatggaagaaacaggggtctatgttccccttgatgatattgttattacggctggtactcaacaggcattatttattttgacacaggttacctttccaaatcgaaaatctcgagttttaatagaagaaccgacctatcctcgtatgattgaactaatcaaaacacaaaatttaccctatgaaactatttctcgaggtactcatggaattgattttcagcgtttagaggagattttccagacacaatcaattaagtttttttatgttatacctcgcatgcataatcctttgggaacatcctataatccggtagagatgaaaagattaatagagatggcagagaagtatgatgtttatattgtggaagatgactatatgtctgattttgcaagtcagtcaccattacattattatgatactcacgggcgtgttatttatctaaaatctttttcaaaggctattttccctgctttaagattagctgcgatttgtttaccacaagctttaaaatcaacatttatggcttacaagaagttgatggattatgatactaatctgattttacaaaaagcattagcgctttatattgaaaatggcctttatgctaagaatagtcaatatttgaaatatcgttatcagaaagaccttgcaaattcaaaatctattttagctgatcaccctaatctaccctcatatagtttacatcacgatagtgtattatttgattgttcgaaactcgataactttaaaatattacggcaatacggcgatactttggaaaattatttttgtcaaaaatcgcatcaatctctcttacaagtaaaaaatgattcctgcttaaagcagttcttgggatcgttgtagtataattgtagggggacagtttaaaatagataatatagttttcataaatgaaaggtggtaaaataaacccatgacaaggtataaggcacagatttcttatgatggttcagctttttcaggcttccaaagacaaccaaattgtaggacagttcaagaagaaattgagagaactcttaagcgcctaaatagcgggaacgatgtgataatccatggtgctggtcgcacagatgttggtgttcatgcttatggacaagttatccattttgatttaccacaggcgcgtgatgtagaaaaattacgctttggtttagatacacagtgtccagacgatattgatattgtcaaagtagagcaagtgtctgatgattttcattgtcgatatgataaacacattaaaacttatgagtttttagtggatatcggtaggccgaaaaatcctatgatgagaaactatgcaacacattacccttatcctgtcattattgagcttatgcaagaagctattaaagatttagtaggtacccatgactttacaggctttactgcttcaggtacgagtgtagaaaataaagtacgtactatttttgatgcgaaaattcagtttgaagcgtctaaaaatcttttaatttttacctttacaggaaatggttttttgtataaacaggtgcgtaatatggttggtaccctgctaaaaattggtaatggacgcatgcctattagccaaatcaaaacaattttacaggctaaaaatcgggatttagcaggtccaactgcggcaggaaatggtttatatttgaaggagattatttatgaagacgaggaatgttttagcaatttcaggaaatgatattttctctggcggcggcttgcatgcagatttagcaacttacgttgttaataaattacatggttttgtggcagtaacatgcttaacagcaatgtcagataaagggtttgaagtcattcctatagaggcatctatactaaagcagcaactagaaagtttaaaagatgtagagtttgggtctattaaactaggattgcttcccaatgtagaaacagcacaagttgttttggaatttgtaaaatcaaaacaagaatgtccagtagtcttagacccagtcttagtttgtaaagaaaatcatgatttagaagttagccaattacgtgagcagctaattgcgtttttcccatatgctgatgtgattactcctaatttagtagaggctcaattattgacgggtctttcgattgaaaacttagatcaaatgaaaattgctgctgagaaactttacgatatgggagctaaacatgttgttatcaaagggggcaaccgtttaaatgctgaagaggctacagacctttactatgatggtgaacgttttgaaacctatgtttttcctgtagtagatgccaataatacaggtgctggatgtacatttgcgtcaagtattgccagccaattagctatgggtaaaaatgtagaagatgcagtcaaaatgtctaaaggtttcgtctatcaagctattaaagcatcggataagtacggagttgtccaacatttttaggagattttaatgaggaaagagaaaactagtcaattggttcaattggcaattgtaacagctatatctattgtattggggatgtttataagtattccgacaccaacaggttttttgacattactagatgctggaatattctttgctgccttttactttggcaaaaaagaaggggctgtggtaggtgccttagctggttttttaattgatttattgaaaggttatcccaattggatgttctttagtttattgattcatgggacgcaagggtatttagcgggtttaccaggtagaagacgtcttttaggtcttattagtgcaactcttgttatggtattaggttatgctatagctagtggattgatgtatggttggggagctgttctaccagatattcctggcaatattatgcaaaatatggttggtatggttgttggttttgctcttaataagtctctagaaagagtgaagaaatgatactagattataataagttaaagcaggaaactaaagctattgtagttgatattattgaacgtagcgctcttaaaaaaggtcaaatttttgtactaggtctatcatctagtgaggtttctggtggtttaattggaaaaaattctagttctgaaattggtgaaattatcgttgaagttatcctcaaagagttacattcacgcggcatctatttagcagttcaaggttgtgaacatgttaatagggcgttggttgttgaagcagaattggctgaacgtcaacagttggaagtcgttaatgttgttcctaatctacatgctggcggtagtggtcaggttgcagcttttaagttgatgacatcaccagttgaggttgaagaaattgtggcacatgctggaattgatattggagatacttctattggaatgcatatcaagagagtacaagttcccttgattccaattagtcgtgagttgggaggagcacacgttacagcactagctagtcgtcctaaattaattggcggtgctagagcaggatatacgagcgatccaatccgtaaattttaaaataaacctctgctctgcagaggtttattatttatctcaacgagagtggttattggagaaattgtacgttggtaagtcaataccttcttcaagaatagctttttgataaagtttgtaaaattcagcatagatgtcaaactgagcaccgttttgcgtgaagatattaatacgataaacaaattgaccattagcattggttgtaggaccaaaaacagtaggctctccaacgatagcagggtgttttgaaacatactcttcattgatttttgttacaatatcagaaatctgatcaaggtttgtatgaacaaataaaggaatatcaatttgagcacgcatattgctacgagacttattgctgacaattgtaatattacgattaggaatgaagtgcaaggttccatcgaaatcatgaatttgtgtggtgcgtatcccaacattagtaacagtgcctgatacagtaccaacattaataatatcaccaacatcaaattggttttctagcagaataaaaaagccattgacaacatctgataagaagccttgagcaccaagtccaatagcaaccccagcaataccagccccagctaataaactagaaattggaacgcccaatatacttaaaatccaatagaatagaaagaaataaagggtatagtttaaaacattgtgagaaagtttagctaatgttttttgacgagctactttttgtctagaaaaggcgagtgagcgattaacagtcttttcgaaaagataattgatgacttgcctaacgataacgaatgcaatgattaataataagattgatattagtttggtgaagaaagtaaataaaacttcctctacattaagatggtctataaatttttctaaagtaatcatagtaatagtctagtaaaaaaaaagccatagagcaagtattttaaaagcttatcgttaagcagtttaaagcttcttttttgcataaaaactttgtaaaacgttttaaattatggtaaactaaactgtatctaaataattttaaggagaaatgacttaatgtctacatcatttgaaaataaagctacaaaccgtggtattatcacatttacaattagtcaagatgagatcaagccagctcttgatcaagcattcaacaaagtaaaaaaagatttgaacgttccaggattccgtaaaggacatatgcctcgtacagttttcaaccaaaaatttggtgaagaagcactctacgaaaatgcattgaatttagtgttgccaaaggcttacgaagcagctgttgcagaacttggtttagacgttgttgctcaaccaaaaattgatgttgtatcaatggaaaaaggtcaagattggaagttgacagctgaagttgttacaaaaccagaagttaaacttggagattacaaagacctttcagtagaagttgatgcttcaaaagaagtttcagatgaagaagttgatgctaaagttgaacgtgagcgtaacaaccttgcagaattgactgttaaagatggtgaagcagcacaaggtgatacagttgttattgactttgtaggttcagttgatggtgttgaatttgatggtggtaaaggagataacttctcacttgaacttggttcaggtcaatttatcccaggatttgaagaacaattagtaggttctaaagctggtcaaactgtagacgttaatgtaacattcccagaagattatcaagcagaagatcttgctggtaaagatgctaaatttgttacaacaattcacgaagtaaaaactaaagaagttccagcacttgatgatgaacttgcaaaagatattgatgatgaagttgaaacacttgatgagttgaaagcgaaatatcgcaaagagctagaatcagcaaaagaaattgcatttgatgatgcagttgaaggtgcagcaatcgaattagctgttgccaatgcagaaattgttgaattaccagaagaaatggtccatgatgaagtacatcgtgctatgaatgagttcatgggtaatatgcaacgtcaaggaatttcaccagaaatgtacttccaattaacaggtacaactgaagaagaccttcataagcaataccaagcagatgctgacaaacgcgttaaaactaaccttgttatcgaagcaattgcagctgcagaaggctttgaagcaacagatgaagaaatcgaaaaagaaatcacagatcttgcttcagaatacaatatggaagctgaccaagtacgcggtctactttcagcagatatgcttaaacatgatattgcaatgaaaaaagcggttgacgttatcactagctcagctactgtaaaataattgcttattaaattttgaaaagattgggcttcccagtctttttatttgtgattattcttttgacgaatagctaaaaatagcgtaaaatagtaaatagcgaaaatttgaaaatatgacttatctattttctatctataaagaatattgctaaacaaaatgatagtcttacacaattaaggagaataactttggaattagaagtatttgctgggcaagaaaaaagtgaactttcgatgattgaagttgctcgcgctattttagagcaacgtggtcgtgataacgaaatgtacttcagcgatttggtaaatgatattcaaacctaccttggaaaatctgactcagcaatccgtgagtcattgccatttttctattcagatttgaatacagacggaagttttattccacttggcgaaaacaaatggggacttcgttcatggtatgctatcgatgaaattgacgaggaaatcatcactcttgaagaagatgaagatggcgctccaaaacgtaagaagaaacgtgtcaatgctttcatggatggtgatgaagatgctattgattacaatgatgatgatccagaagatgaagatttcacagaagaaacaccaagtttagaatatgatgaagaaaaccctgacgatgaaaaatcagaggtagaatcgtatgattctgagattaatgaaatcattcctgatgaagatttagatgaggatgtagaaatcaacgaagaagacgatgaagaggaagaagaggaagaagaggtttagacggggattttgtatttgacaaatagtcagatatagtttaaactattattcgggcacctcttatgaggtcagataaagctccctagtgatagggggctattttgtttttgggaaagatacagaatggttccagatagttttctgagtaggcccttgatcagatagtttctactagttttgactagagaagctggtattatttatcaatcatgtgttttgggttttacccgtaaactaactgttagattaacatttaatttaaggagtttttaatgacaaagtatatttttgttacaggtggtgtggtctcttctattggtaaggggattgttgcagcaagtcttgggcgcttactaaaaaaccgtgggctaaaggtgacaattcaaaaatttgatccatatattaatattgatccagggacaatgagcccttatcaacatggagaagtttatgttacagatgatggtgcagaaactgaccttgaccttggacactacgagcgttttattgatattaacttaaacaaatattcaaatgttacaacgggtaagatttatagtgaagttcttaaaaaagaacgccgtggagaataccttggtgcaactgttcaagttatcccacacgttacagatgctttgaaagaaaaaatcaaacgtgctgcgacaactacagattcagatgttattattactgaagttggcggtactgttggagatattgagagccttccgtttttagaagcacttcgtcaaatgaaggcagatgttggttctgataatgttatgtacattcatacaacgttattaccatacctaaaggctgccggcgaaatgaaaacaaaaccgactcaacattctgttaaagagttacgtggcctaggtatccaacctaatatgcttgttatccgtacagagcaaccagcaggtcaaagtattaagaataaattggcacaattttgtgatgttgcaccagaggctgttatagagtcccttgacgttgaccatatttatcaaattccacttaacatgcaagctcaaaatatggatcaaattgtttgtgatcacttgaagcttgagacacctgctgctgatatgacagaatggtcagcaatggttgataaagtaatgaaccttgagaaaaaagttaaaattgcattggttggtaaatatgttgaattacctgatgcctacctttcagttgtggaagcccttaagcactcagggtacgtcaacgatgttgctattgatctaaaatgggtaaatgctgctgaagtgacagaagataatattaaagaacttgtcggagatgcagatggtatcatcgttcctggtggatttggccaaagaggtagtgagggtaaaattgaagcaattcgctatgcacgtgaaaatgatgttccaatgcttggtgtttgtctcggaatgcagctaacttgtgtcgaatttgcgcgtaatgttttaaaccttcatggagctaattcagcagagcttgaccctaaaacaccgttcccaatcattgatatcatgcgtgatcaaatcgatattgaagatatgggtggtacacttcgccttggtctatatccatgtaaattgaaatcaggttcaagagctgcggcagcttataataatcaagaagttgtccaacgtcgtcaccgtcaccgttatgaatttaatacaaaattccgtgagcaatttgaggctgctggatttgtcttctcaggggtatcaccggataatcgtttgatggaagttgttgagttaccagagaaaaaattctttgttgcagcacaataccatccagaattacaatcacgtcctaaccatgctgaagagctttacacagcttttgtaaccgcagcagttgaaaatatgaaataactttatcgcctcccagtattaggaggcgattttatttttttagatagtttcactatcaaagtatcattagctcttttctttttctaaaaataaggtataataggttgcatgaaaaagattcgattatcaaagtttattaaaatgattgttgttattttgtttttaattagtgtagcagctagtttttattttttccacgttgcccaagttcgagatgataaatcctttatttcaaatggtcaacgtaagcctggaaactctttatatgcttatgataaatcctttgataagctattaaagcaaaaaatagaaatgacaaaccaaaatataaagcaagttgcttggtatgttcctgctgttaagaaaactcataagacagctgttgtcgttcatggttttgcgaatagcaaagagaatatgaaggcatatggttggctgtttcataagttaggatacaatgttcttatgcctgacaatattgcacatggtgaaagtcatgggcagttgataggctatggctggaacgaccgcgagaacattatcaaatggacagaaatgatagttgataagaatccatcaagccaaattactttatttggtgtttcaatgggtggagcaacagtcatgatggctagtggtgaaaaattacctagtcaggttgttaatatcattgaagattgcggttattctagtgtttgggatgaattaaaatttcaggctaaagagatgtatggtttaccagccttcccactcttatatgaagtttcaacaatttctaaaatcagagcaggtttttcgtatggacaagcaagtagtgtcgaacaattgaaaaagaataatttaccagccctctttattcatggtgataaggataattttgttccaacaagtatggtttatgacaactataaagctacagcaggtaagaaagagctttatattgtaaaaggggcaaaacatgcgaaatcttttgaaacagagccagaaaaatatgagaaacgtatctctagttttttgaaaaaatatgaaaaataatattgacaacaatatgataagttgatataatttattatgttgttaagcggggatggcggaattggcagacgcgcaagactaaggatcttgtgaccgcttttggtcgtgagggttcaagtccctctctccgcagactagtcgagttcatttggaactcgactttttgcatatttaagataaagatggagtatcacatgtcaaaagtacgtggctttgaattagttagccaatttagcaataaagagttattaccaaaacgagaaacagctcacgcagctggctatgatttaaaagtagctaaaaaaacggttattgaacctggtgaaattacattggtcccgaccggtattaaagcatacatgcaaccaggggaggtcctgtacctttatgatcgttcatcgaatccacgtaaaaaagggattgtcctaataaattcagttggtgttattgatggtgactactataataaccaagtcaatgaaggacatatttttgcacagatgcaaaatattactgatcaggctgttattttagaagaaggggaacggattgttcaggctgtttttgccccattcttattggcagatgacgatcaggctacaggaatgcgtacaggtggttttggtagtactggaaaataaaattattttacgaataatgttagaaaaggctagacttacttcttagccttttttgatgagagtaaacttatattttctctaacttggtgtgatataatgagtgtactagttatttggtaccaagctatcatattaatttagaagttataaaggaggcctgagtggctaagaaaaaatcagtcttcacctgtcaagagtgtggttaccaatcacctaagtatttgggacgttgtccaaattgctcagcctggtcttcatttgtagaagaggttgaagttcaagaagttaaaaatgcacgagttagtttgaacggtgaaaagtcccgaccgacgaagttaaaagatgtttcctcaattaactattctagaactaagactgatatggatgaatttaaccgtgttctaggaggcggtgttgtaccaggaagtttggttctgattggaggagaccctgggataggtaaatctactttattactacaagtatcaactcagctagctaataaaggtacagtattatatgtctcaggtgaggaatctgcagaacagattaagttacgaagtgagcgtctaggcgatatcgataatgaattttacctttatgccgagactaatatgcaaagtattcggtcggagattgagaagattaaaccagattttcttattattgattctatacaaactattatgagtcccgaagtatcaagtgtccaaggctctgttagccaagttcgcgaagtgaccgctgaattgatgcagttagctaaaactaataatattgctacttttattgtaggtcatgtgactaaggagggaacattagcaggccctcgaatgctagaacatatggtggatacggttctttattttgaaggggagcgtcatcacacgttccgtattttacgggcagtcaaaaaccgttttggttcgaccaatgaaataggtatctttgaaatgcagtcgggtggtctagttgaagttttgaatccaagtcaagtttttcttgaagaacgtttagacggtgcaacaggatctgctattgttgttactatggaaggaacaaggcctattttagcagaggttcaagctttagtgactccgactgtttttggaaatgctaagcgtacaacaacaggtcttgactttaatcgtgtcagtcttattatggcagttctagaaaaacgttgtggtttattgcttcaaaatcaagatgcctatttaaaatcagcgggtggtgttaaattggatgaaccagcaattgatttagctgttgctgtagctattgcttccagttacaaagaaaaacccacaaatccacaagaatcatttattggagaaattggactcactggtgagattcgtcgcgtgacacgtattgagcaacgtattaatgaggctagtaaattgggctttactaaaatttacgcaccaaagaattctctagctgggattgaaatacctaaaggcattgatgttattggtgtgacaactgttagtcaggtcttaaaagcagtgttttcaacataatgattagattcggttcagccgaatcttttttggtggcgagaaacatttcgtgaaaaataatgggcaaaatgataatataaaagggttggtatttagtaaatatcgaatgatgttacactaacaaaggagatctctatgaccacttattttgataactttttaaaaaccaatcaagcctatgctgacttacatggaacagctcatctacctatcaagccaaagacaaaggttgctattgtaacctgtatggattctcgtttacacgttgctcaagctctagggctagctttaggagatgctcatattttacgtaatgctggtggacgagttacagacgatgttctacgttctttagttatttcgcaacaacaattaggaacacgagaaatcgttgttctacaccatacagattgtggagcacagacgtttactaacgaagcttttgctgctcaattacagagagatttgggtgttgatatgcatggacatgattttcttccttttaatgatattgaagaaagcgttcgtgaagatgtggcaaaattacatgcttctccattaatcccagatgatgttgttatttctggtgctatttatgatgtagatactggtcgtatggtggaagttaaatagaaaaaatcctgtccttagcgatgggtttttttattttagaaaactagatttaaaggcaacagttaggcttatcatgccttatgctggaattcagacagaggaaacatcttttgctatactgaaactatactataaaagcggaggaaatttaaaatgaaaaaatatgatgtcattgttcttggttttggtaaagcaggtaaaacattagcagcaaaattagcaacacaaggtaaaagcgttgcaatggtcgaagaagacgataaaatgtacgggggaacatgtatcaacattggatgtattccgacaaaaacgcttttagtatcagctagcaaaaatcatgattttcaagaagctatgactactagaaatgaagttacaagtcgtttacgtgctaaaaattttgctatgttggataataaagacactgtggatgtttataatgctaaagcccgctttatatcaaataaagtggtcgaattaacaggaggagctgacaaacaagaacttacagctgatgttattattatcaatactggtgctaagtcagtacaattaccaatcccaggattagctgattctcaacatgtttatgattcaacggcaatccaagaattggctcatcttcctaaacggttaggtatcattggaggcggtaatattgggcttgaatttgcgactttatattccgaattagggagcaaagtgacagttattgatagtcaatcccgtatctttgcgcgtgaggaagaggaattatcagagatggctcaagattatttagaagagatggggatatcttttaaattatcagccgatatcaaatctgtgcaaaatgaagatgaagacgttgttattagctttgaggatgaaaaattaagctttgatgcagtattatatgcaacaggacgtaagccaaatacagaaggtttagcacttgaaaatacagatattaaattgacagaacgtggagctattgctgttgatgaatattgccaaacttctgttgagaatatttttgcagttggtgatgttaatggcggccctcaattcacatatatttctttagatgactcacgtattgtcttaaattatttgaattgtgataaggattattctctaaaaaatcgaggagcagtaccgacttcaacctttacaaatcctcctttagcaacggtaggtctagatgaaaagaccgctaaggaaaaaggatatcaagttaaatctaatagccttcttgtttctgccatgccacgtgcacatgttaataatgaccttagaggtatttttaaagttgtggtagatactgagacaaatcttattttgggagctcgcttatttggtgcagaatcccatgaattaattaatatcatcacaatggcaatggataataaaatcccatatacttatttccaaaaacaaattttcactcacccaacaatggtagagaattttaatgatttgtttaacttttaagaatatttttaaaaagtaaggcaattttgctttactttttttatcgaaaattagtgtggctattattactgattatcatttttagtgatttagtggtataatagagttgattggcaatcatctgtaagagtttgaatgatgttttgcccccttgactaattcagttaaactgaaaaagtttactatcagaaaatataggagtagaattttggctaataagattcgtgtgcgttatgcaccaagtccaacaggattgttacacatcggaaatgcgcgtactgcgctctttaactacctttatgctcgccatcatggtggggattttgttattcgtattgaagatactgaccgaaaacgccacgtcgaagatggtgaacgctctcaattggagaacttacgttggctaggtatggactgggatgaaagtcctgaaacacatgaaaattatcgtcaatcagaacgccttgagctctaccaacgttatattgatcagttgttagcagaaggtaaagcctacaagtcctatgtgactgaggaagaattagcagcagagcgtgaacgccaagaattggcaggcgaaacacctcgctatatcaacgaatttatcggaatgtcagaaactgaaaaagaagcttacattgcagagcgtgaagcagcaggcatcattccgacagtacgccttgctgttaatgaatctgggatttataaatggactgatatggtaaaaggtgacattgagtttgaaggctctaatatcggcggagactgggttattcagaagaaagatggttatccaacttacaatttcgcagtagtcattgatgatcatgacatgcaaatttcgcatgttatccgtggcgatgaccatattgcaaatacgccaaaacaattaatggtttatgaagcactcggttgggaagcgccacaatttggtcacatgacattgattataaactcagagactggtaagaaattatcaaaacgcgacaccaatactcttcaatttatcgaagactatcgtaaaaaaggttatatgtcggaagctgtctttaatttcattgcccttcttggctggaatcctggtggagaagaagaaatcttctcacgcgagcaattaattaatctatttgatgaaaatcgtcttagcaaatcaccagcagcattcgatcagaagaaaatggattggatgagtaatgattacctaaaaaatgctgattttgagagtgtttttgcactttgcaaaccattcttagaagaagctggtcgacttacagacaaagctgaaaaattagttgagctttatcaacctcaattaaaatcagctgatgagattgtaccattaacagaccttttctttgcagattttccagaactaacagaagccgaaaaagaagtaatggcagctgaaacagtcccaacagtcttatctgcttttaaggaaaagttagtatcgctttctgacgaagaattcactagagatactattttccctcaaattaaggctgttcaaaaagaaacaggtattaaaggtaagaacctatttatgcctattcgtattgcggtttctggtgaaatgcatggaccagagttaccagatactatttatttattaggtaaagaaaaatcagttcaacatatcgataatatgttagcaaaattataatataaaaagtcgtgaattttcacgactttttgtgtacttttaccaattgtatttttcaacattgtctttggtaacaaggtaaattggagaaattgtttctttctctacttttttgcctttataataatcaattgctgcttgaattgctatttctcccatcttagctggttgttgtgcaatagtggctgaaatatctccttttttaatggcatcatgggcatctggctgaccatcaattcctacgataagaacattttgcaagccagcagatttgacagcctgtgcagccccaagtgccatttcatcattttgtgcgaaaataatttggacatctttatgtccttgaatcatattttgtgtagtattcaaagctttggcgcggtcaaaattggcagattggcttgaaaggatgtcaagtttagattttgcaactgaatgaaatcctttaccacggtctacagtagcagaggcacctggtactccagataattcaaaggcttttgcttttttgcctagttttttaacggcataatccgcagccatcttaccagcagcaacgttatctgaagcgacagtagttaatactttgcctccctcactaccacggtccattagaataacaggaatattagcgttgtttgcagacttaatagctgttacaatagcttttgagtcaacgggattaatcaaaatagcatctacgttttgactaataaagttttggacatcatctgcttgacgtgcggcgtcatcttgagcatcagctaccttaatgcttatttttttattgctagcatatttgtcaataccgtctttcatcgcaacaaagtagggattgttagttgttgaaatagatacacctagtttcaaatctttagcagattttttggttacattttttgtagaattcccagaagaatttccaagtccagttttaccacatgcacctagaatgaggacaatagacatcaataaggctagaaagccaagtttttttccaaatttcatttgaaactcctttagataaaatataatgaacttatagaaattagagtaaagactattttgctactttaaagcgatcaagtaaaacagccattaaaataacgatacctttcacaacttgttgccaaaatgcagagacaccaatgatgtttaatccattgttcaggacaccaataataagagcaccaatcaatgttccaatgatacgtcctttcccaccagataaagacgttccacctaagacaacggcggcaatagcatccatctcataacttgctccagctgttggttgtgctgagctaaggcgtgatgtgataattaacccagaaatggaagccatgatacctgagatagtgtagatgataattttaactttgtttaacttaatacccgagatatacgctgctttttcattacctcctaaagcgtaaacagatttcccgaaggctgttttatgtaacaaaatatacaaaataataaaagtaagaaacatgagaatgactgggaatgggataccaacaatatagccttgtcccaaaaattggaatagaaaactatcggataagccagcggtaattgggttgccgtttgaataaactagcgttgctcctctaaagatagtcattgttgccagtgtaacgataaatggtgctaattttccgtaagaaatgaagagtccgtttagcattcccaagatgccacctaaggcaacagataaaacgatagcaataccaacgggtactccgtggccgattaatccagctgttaatgcactagatagggctaatatggacccgactgataaatcaataccgccagtcaaaataacgaaggtcatcccgaaagcgataaaaccatttgcagttacttgtaataataaattgagtagattattggttgtgaggaaattaggattaatgagtgtgataataaccattaaaccagctaacgcaatcagggttgttaactctgatatatatttcatcatatttttcactttacttacctcctgtggctagttgcataactttttcttggtcagcttcttttcgactgagttctccactgattcgaccttcgtgcattaccatgatgcggtcactaacacctagaatttcaggtaagtctgatgataccatgacaattggaacacctctgtctgctagttcattcattaattggtaaatctctcgtttagcaccgacatcaacaccacgcgttggctcatcaagaattaagactttaggagcaataccaatccatttagcgagaacgaccttttgttggttacctccagaaagatttccaacctctaaatctggtctccctgatttaatgtagagacgattaatcaattgttgcacaaatgttgtgcttgttttttcatcaaagaaaccatgtttgctaaaatctttagtgctagggagagtcatattgtccttgatattgaagtctaggatgagaccttcatcttttctattttcggtcaaaaaaccaatgccctgcttgatagcttggcttggggtagtaatagtgatttcttggtcatcaattttcaccttaccagacttctttttatcaattccaaagatagttcgcataacttcagtacgcccagctcccattaatccagaaaatccaagaatctcgcctttacggacataaaaggaaacgtcctcgaaattatctccacagaggttactaacttcaaaagcaacaggcccaatttcagaatgtttttcaggatagtaatcttccaattttcggccaaccatttttttaaccaattcgtcagaatttgtgagtgatgtttcttttgtatctacaatgacaccatctctcatgacggttacgaagtcagtgattttaaaaatttcctccattcgatgggagatatagacaacgcccactccttcttgtttcaaacctcggataactcggaaaagattttcagtttcacgatctgttaaagcagcagtcggttcatccattaccaaaatagagagttggtttaggagacttttggcgatttcaatcatttgttgttgtccaacagacaagttaccaatcgggatgtctaggggaatagtcacacctaatcttttaaaagtttcaagtgctttttgtctcattaatttttgattgagtaagccaaaagttgtcttgatttcacgtccaagaaagagattttccaagacagtcatttccggccaagtattcatctcttggtgaataaaactaataccaaattcctctgcttcttgagggtttgaaaaagttcgttcctcgccatcaatataaatagttcctgtacttgctggaaaaagtcctgttagaatgttcattaaggttgatttacccgcaccattttcacccataagcgcgtgtatttgaccagattgtaattccaaatcaatcttttctagaactttattagtaccgaaggatttggagatattcctcatgtcaattttcatggactaaactcctttctagatgataacaccagattgtagaataatatttgaatacggtgtattttcacctgtacgaataactgctttgacatcttgggtcatttgttttaaatgattgtgactgacgtactctatgctaacagagttatcaagtttagctaataaccttgataattgatccggatttgcttccttgatttcttctgctaaaatgactttttcaactaagatattctctaaatagatatcaagtacctcttggaaactaggtattccagaggtcaaagacaaatcaatctttggaatgccatttggaacaggtagacccagatctccaatacaaactcgatcagtatgcccaaggtcgtctgctaatttagcgagatgactatttaatataccagtctttttcataatgttggttgtcctccatttctttaattgtaggcatgccaccctgtgcaccaaatttttgcacggataagtgagcagctagagttgcaaaacgtaaggccttagcaatcttaaattttttcgagatagcataaccgaatgcaccgttaaaagtatcacctgcaccagttgtatcaacagctttagtttctaaagcaggaattaaatgactttcttttccatcagagtagatggctccttttgtgccgagtgttacgattagtttttcaggatatgtggctaatatatcctctagtttttggtttgggaacagctcttgacattcgtgttcatttggtgtgaaataatcgaccttatcgagcatctcaatatcagtctctctagatggtgcaggattatagagtaatttaatactatgttctttacaaaaattagcaattttcatatttgcttgatgaggaatttcattttgtaatacaactaaatcagcttctttaattattgaccactcctgagaccattttttagtatcaacttttccgttggctccaggacagtaaatgattcgattatcattattataaagagtgatttgggcaacacctgaagaagatggtatcgttcccacaaaatccgtagtaacatgatttttgtttaaattatccaaaagaatgggaccaaaagaatcctcgccaatggcaccaagaatagtaatattatctcgctcttggctaagacgcccaatagcgacagcctgattagcacctttacctcctggaaccattgaaaaacgttggccaaatacggtttctccctctttggcgatacgattggtttccataactaagtccatggaaatactaccgataatgacaatgttactcatctattttcctccttagggtttcacgttcgacataatgaacgggtaatttaatacgcttattggtaataggtaattgattagtaattttgaaaattaattcagctgctttttgtcccataatatatgatgattggtgaatagttgacaacgaagggtagataaattggctcattaaaatatcatcataaccaataatttgtacatcttcagggattcgcttccctcgattaagaatctcgtgtaggtaggcaatagcatgtatatcagatggagcgataatgctatcaatgtctggatggtggtcaagtaaagttttcgcttcaatttgaatctctgcaaaatcaaaactggcactatcttcgatagcaaaacaagcccctttgtttaataggtaattttggcttccttgaaacctttgattaaggttatcagctttatctagcggaccacgaatgagtaatatattggtagcacctgctgtccaaatagcttgagctgctaattttcctccctctttattatcagagaaaacgccgtactgtgtttcttgattaacgcggtcaacaactacaactggaatatctatttcaggatgatttttggtgaaatcgtgtgttgtaataatccctgcagcattactttgtaatagcacatttaagtactcttcttctaaatggctcttgttatttgtgttgccaagcatgacacgataaccctgttcttttagaaattcttcaactcctctagcaagtcttggaaagaaagggtttgaaatatcgggaagtagtaatccaacaagttgattttttttggttttcagagattgtgcaaggaaatttggaacataatggagttcgcggatagcttgctcgattttttgacttgctttttgactaacgtaaccattttgggatatataccttgagacagtagatgttgatacgccagctttctcggcgacttgtctaatcgtactcatagaaactcctttcttatattgtggaaacggtttcacaattagaattgtaatcgcttactaaaaaattgtcaagctattttttaaataatttaatgataaaatatcattatttttagaggtcatattcaagtcataaagctgtgatactatgttcacatcaaaagatcaaaggagaaaaaccatgtcacatgcttggaaagaattaaccttttataagaaaaaatacctcctgattgaattgctaatcattgttatgatgttcatggtagtttttttatcaggtttagcaaacggtttaggtagagctgttagtgctgctattgaaaataacccagctcaaacctatattttgaatgaaggtgctgaacaagtgattacatcatctgtattgacaactaaagatcagacagatttaaacagtttgaatttaaaagatagtaccactttaaatattcaacgttcgagtttaactcgacaaggacacgaaaagaaaattgatatttcttattttgctattgataaagattcttttatggcacctacactttctgagggaaaacaactgacaagttacaaaaaagctattattttaaatgatagtttaaaagctgaagggataaagttaggtgataaagtgattgataagtcatcatctatatcactaacagtcgttggatttgtccataatagtatgtatggtcacggacctgtggcatttattgataaagacatttataccgaaattaataaaaagattaatcctcaataccagttcttacctcaggcattagttatgaaaaatgataaaagtatatctcatttaccaactcaattagaagctgttagtaaaaaagatgtcattcaacatattcctggttatagtgccgaacaatccactttgaatatgattttatgggtccttgtcgtagcttcagctggtattttaggtgtctttttctacatcatcacacttcaaaaacgtcatgaatttagcgtcatgaaagctattgggacaaaaatgtcagagattgccctatttcaattgagtcaagtcattatattggcactgtttggtatcattgttggagatggattggcggttgctctctcttatgtattaccagctcaaatgccatttgttattaattggcaaaatattattctagtatcgtttgtatttttagtcattgcaatgattagtagtgctttgtcaattgtaaaagttgctaaaatcgacccagtcgaagttattaatgggggaggagaataatgtcagcaatcttagaattaaaacacatctcaaagcactatccagatggagatgagcttttatcaatattagataatttagatttatcagtttctgcaggtgagtttgtagctatactgggaccctcaggttcaggtaaaagcacacttttatccattgcagggttacttcttggcgcagatcaaggtagtttgtatgtcaatcatgagaacgttacggatttgtctcaaagacaaagaacacaattgcgccgtgaagcactaggttttatatttcaaagtcatcaactgcttccttatttaacaatccaagaacagttgcaacaagaggctcgatttgcaaaacactatgataagaaaacaagcttggaagaaattaataaattattatcagatttaggaatagagcagtgtgcacataaataccctaaccaattatcgggaggacaaaagcaacgcgcagcaattgctagagcatttattaatcatcctaaggttatcttggcagatgagccaacagctagccttgatgaagaacgtgggcgtcaagttacagaacttattcgtcaggaagttaaatcacataatactgcagctattatggtgacacacgatgagcgcgttctagatttagtagataccgtttatcgtttaaaggacgggaaattagttaaagaaaacttctaacttgtgttacaataagctagaggtgatttaatgattaaaatattagttgtagaggataacattgttcaacaaaaaatcattaccacaaaattaacacaagagggctaccaatttatcactgcttcaaatggacaagaagctctaaattgtctagatacagaagaagtacaattgattataactgatatcatgatgcccatgatggatggttatcaattaattcaagaactcaggtcagctgcttataatgttccaatcattgttatgacagcaaaatcacaaatggaagatatgacaaaagggtttggccttggtgcagatgattatatggttaagcctgtgcagttacaagaattagctttacgtattaaggcactcttgaggagagctaatattgtagctcaacatcagctaattattgggaatacttgtcttaatgaagatgaattaagcttgaaatattttgagcaagaaattatatttcctcagaaagaatttagggttcttttccacttacttagctatcctaataggattttcacacgtttagaactattggatagtatttggggaatggatactgatttagatgagcgggtggtagatgcttgcatcaataaaattagacgaaaagtagaacacttaccagattttaagattgagacggtgagaggggtagggtatcgtgcaaaaaatgactaagctaaggcgatttcggtttccgttaagattttatttcacattaatgtttgtgttaacgatgcttttctcagtcctagcttctcttttactagttgcagcaatagtttttactttttttcaaggagtcttaactactcatgtattacaagttagtgctctcgctgttgtttttttaagccttgtgatagctagtattagtatgtggtacggttcttatcatttaacaaaaccaattttagatattagccatattgtgtccaatgttgcagacggtgactttgaagggcatatttatcgaaacagtaatcgtcgtaaatcctatgagtattataatgaattggatgagctatctgaaagtattaatcagatgattgtttctttatctcatatggatcatatgcgaaaagactttatcactaatgtttctcatgagctaaagactccgattgctgcagtagctaatattgtagaactattacaagatccagaattagatgaagaaacacaaagtgagttattaggtcttgttaaaacagagagcctaaggttaacaagattatgtgatacgatgttgcaaatgtcgcgcgtggataatcaggagactattggggagctatcctctgttcgtgtagatgaacaaattcgtcaagcaatgattagtttaacagaacgttggcaagctaaaaggataaattttcaactggattcaaaaccatatactgtttactcaaactctgacttgctgatgcaagtttggataaaccttttagataatgcaataaaatattccgaggatattgtagacttaagtgtacgaatggaagaaactaataatcattatctgagagttattatttctgataaaggtaggggaatttctcaatatgatgttcagcatatatttgataaattttaccaagcggatcagtcgcataatcaacaaggaaatggattaggactagcaatagttaaacgtataattgttctttgtaagggacgtattagtgtctccagtcagttggaaattggaacagaattttgtgtagaactacctttatcataattatttaaaacaataactgccaattggcagttattgttttatttgtttagaaataaatatactaaaaatagacaaaaactataaaaatatttgacaataaatatagcaagtgtataatattacaaaacataggaatttggaaggggattttttatgggaaaagaaaaattaattttagcttattctggtggtttagatacctctgttgctatagcttggttaaaaaaagattatgacgttattgctgtctgtatggatgttggcgaaggtaaagatcttgattttattcacgataaggctttaacaataggtgccatagaatcttatattttagatgttaaagatgagttcgctgagcattttgttttaccagctttacaggcacatgcgatgtatgaacaaaaatacccgcttgtttcagcgcttagtcgtccaattattgcccaaaaattagttgaaatggcacatcaaacaggtgcgaccacaattgcacatggctgtacaggtaaaggaaatgaccaagtgcgttttgaagttgcaattgcagcactagatcctgaattaaaagtaattgcccctgttcgtgagtggaagtggcatcgtgaagaggaaattacttttgcaaaagctaacggcgtacctattccagcagatttagataacccttattctatagaccaaaatttatggggacgtgccaatgaatgtggtgtgcttgagaatccttggaatcaagcgccagaagaagcttttggtattacaaaatcaccagaagaagctcctgattgtgcagaatatattgatattacgttccaaaatgggaagcctatagctataaacaatcaagaaatgacactagcagatttgattttatcgctaaatgaaattgcaggaaaacatggtattggacgcattgatcatgttgaaaatcgtttagtcggtatcaaatcacgtgaaatttatgaatgtcctgcggcaatggtactgttagctgctcataaagaaattgaagatttaacactagttcgtgaagtgtctcattttaaacctatccttgaaaatgaactatcaaatcttatttataatgctttatggtttagtccagctacaaaagctatcattgcctatgtcaaagaaacacaaaaagtggttaatggtactacaaaagttaagttatataaaggttctgcccaagtcgttgctcgccactcatctaattcattatatgatgagaatttagcaacctatacagctgctgatagctttgatcaagatgcagcagttggttttatcaaactctggggacttccaacccaagttaatgcccaagtaaacaaaggataaataaaggaagataagaggatgacaaaaaatcataagttatggggtggtcgttttgaaagtagtcttgaaaaatgggttgaagagttcggtgcatcaatcagtttcgaccaaaaattagctccctatgatatgaaggcttctatggcccatgtcacaatgttaggcaaaacggatattattagtcaagaagaagcaggcttgataaaagatggtttaaaaatactgcaagataaatacagagcaggtcaattgacttttagcatatcaaatgaagacattcatatgaacatagagagcttattaaccgctgaaattggagaagtagcaggtaagcttcatactgcacgttcacgaaatgatcaagtggctacagatatgcacctttatttgaaagataaattgcaagaaatgatgaagaaattgcttcatttacgaacaaccttagttaatttagcagaaaatcatatctatactgttatgccagggtatacacatttacaacatgctcagccgatttcatttggacatcatctaatggcttactataatatgtttacgcgtgatacagagcgattagagtttaatatgaaacacaccaatctatcaccattaggagctgctgctctagcagggacaacgtttcctattgaccgccatatgacaactcgtttattagattttgaaaaaccatatagtaattcgcttgatgctgtctcagatcgtgactttatcatagaatttttatccaatgctagcattttaatgatgcatttatcacgtttttgtgaagaaatcattaattggtgcagttatgaatatcaattcatcacattatcagatactttctctacaggatcatctattatgcctcaaaagaaaaatcctgatatggcagaattaattcgagggaagacaggccgtgtttatggaaatttatttagtttactaactgttatgaaatcattgccgttagcttataacaaagatttacaagaagataaagaagggatgtttgatagcgtagaaacagtcagcatagctattgaaatcatggctaatatgcttgagacaatgactgtgaatgagcacataatgatgacctcaacggagactgatttttcaaatgcaacagaattagcagattatttagcaagtaagggggtacctttcagaaaagcacatgaaattgtaggtaaattggttttagaatgcagtaaaaatggttcttatttacaggatatacctttaaaatattatcaagaaatttcagagttgatagaaaacgatatctatgagatattaactgcaaagacagcagttaaacgaagaaattcattaggaggaacggggtttgaccaggttaaaaaacagatcctattggcacgtaaagaattgaaagcggaatgactgctttctgaaaaaaccctcgtttaactctgttaagtttctcacgtattttcagtaaaaaactagcattttttatagaattgtgctagaattaacgtgtaagtgggcaacgcccaaaaaataaataggaggcctgaataatggcaatcgtttcagcagaaaaattcgtccaagcagctcgtgataacggctatgcagtaggtggatttaacacaaacaaccttgagtggactcaagctatcttgcgcgcagcagaagctaaaaaagctccagtacttatccaaacttcaatgggtgcggctaaatacatgggtggttacaaactttgtaaacaacttattgaaactttggttgaatcaatgggtattactgtaccagttgctatccaccttgaccacggtcattacgatgatgcccttgagtgtattgaagtaggttacacttcaattatgtttgatggttcacaccttccagttgaagaaaaccttgaaaaagcacgcgaagttgttgctaaagcacatgctaaaggtatttcagtagaagctgaagttggtactatcggtggtgaagaagatggtattgtcggtaaaggtgaattagcaccaatcgaagacgctaaagctatggttgaaactggtattgacttcttggctgcaggtatcggtaacattcatggaccatacccagcaaactgggaaggacttgaccttgatcacttgaagaaattgactgaagctgttcctggtttcccaatcgtgttacacggtggttcaggtattcctgatgatcaaatccaagaagctatcaaacttggtgttgctaaagttaacgttaacacagaatgtcaattagctttctgtcaagcaactcgtgactacgctgttgaattcaacgctaacgaagctgaatacatgaagaaaaaactctttgacccacgtaaattcttgaaacctggtttcgatgcaattacagaagcagttgaagaacgtattgacgtgtttggttcagcaaacaaagcataattaacataaacagataatagttaaaagctcacttatggtgagctttttttggattatatgactttttattaaatagatactctttaaagattgatatgcttaagataatttcgaataaatgccgctgaatctgtgagttgttgctcttcttttgggcttagtgaaagagaaattctttctacaattcctactctaccaataatagctggatatccaaggtaaaccccttcggactcatagaaggtagatacaggtagtaactcatgggaatcatttaacacagttaaaacgatgcggacagctgcggtagcgataccataactagtatattttttaccaaaaaagacagtgtgcccgccttttaaagaagcttcttttatctgttctaattcttctgcttttaatagtgatatagctggttgtccttttacagttacctgactccaagcgacaaattgggagttaccatgctctcctagattataaccaccgatactccttggatcaacttgtaggcgttgaccaagcactcttttcatccgagcagtatccaataaggttcctgttccgataacgcgtgatttaggaaattgagtatattcttgataaagctgggtaatggcatcaacaggattagtaacgacaataaggatccctctaaaaccagatgattttaacttttggctaacgtcgtagacttctttactggtaaatggtagttcagcaaagcgattagcttctttgttattctgtagtgaaatatcacctaaggctgaaatcacaacatcagcatctgacaacgcgtcatagtcgtttaatactagattagcgtgataagtagcatttgccagagcatcttgaaaatcaatcatatcagcattaaccttatcaacattagtatcaataaagacataatcatcaccaataccttgtgcaataagagcgtgtgcaacagttgatccaacgtgccccatgcctataattccaattttacgtgtcatatgaaacctcctttgattattgttgtctattataatattttgaaagaaaatgtaaactaaaaaatgaattagaaggaagtgtgtcttattataaaaaatatgtaagcgatttagataaaacaaatgaaaaagtaattttgaaaagaacttgctagaagaagtaagttgtgatagaatagtctagtatgtggtgctagcacatccgtaaatattgatcaatataggaggaactcgtaaaatggctaaagtatgttatttcacaggacgtaaaacagtttctggtaacaaccgttcacacgcgatgaaccaaacaaaacgtactgttaaaccaaaccttcaaaaagttactgttcttatcgacggtaaaccaaaaaaagtttgggtttcagctcgtgcgcttaaatctggtaaagtagaacgcgtttaataaactgagaaagccttagggctttttttagtgtttctaaggctgatttgatagttagatgcctctatttttttacaataatagtgagatatgatagaatagagtgataaaaactttttgaggtagtagatatgactgtaaaaatcaatacaagagatggtcaaattgaactctctgatgacgttattgcaactgtcgttggaggttcagcaacggaaatttttggcgttgttggtatggcaagtaaaagtgctatcaaagataactttcaagcacttttgcgtaaggaaaactacgcaaaaggtgttgttgtgaggtctagtgaagcgggcatcgtagtagatgtttatactgtcatgagttacggcgtcaaaattagtgaagtttcaaaaaatattcaagagcgagtgaaattcaatctcgaaaatcagcttggtttatctgctgatatggtgaatgtttatgtgcaaagtattaaggttgtaggagaagattagtgtcaaagattacgacaagtttattccaagaaatggtacaagctgccagtacacgtctgagtaaacaggcagagtatgtcaactcattaaatgtattcccagttccagatggtgatactggtacgaatatggggatgactatggaaaacggagccaaggaagtttcggacaaaccagcgacgactgttggagaagttggtcaaattctttctaaaggtgtattgatgggagcacgtggaaattcaggtgtaattacatcacaattattccgtggttttggtcaaagtatcaaggataaagaagaattaacgggtcaagatttggcacacgctttccagaatggtgttgaagtagcttataaagccgttatgaaaccagttgaaggaactatcttgacagtatcacgcggtgcagctaccgctgctctaaaaaaagctgaagaaactgatgatgcagttgaagttatgcgcgcaactctcaaaggtgctaagcgtgctcttgctaaaacaccggatatgctacctgttcttaaagaggttggtgttgttgattctggtggtcaaggactcgtctttatttacgaaggtttcctctcagcactgactggggaatatatcgcatcagaagattttaaagcaactcccgcaacaatgactgaaatggttaatgcagagcaccataaagctgtagtaggccacgtagccacagaagatattaaatatggctattgtacagaagtcatggttggtttaaagcaaggaccaacttacgttaaggaatttaactacgaagaatttcaaggttatcttagcaatctaggggattctttactagttgttaatgatgatgaaattgtcaaggttcatgttcatacagaagatccaggtcttgttatgcaagaaggtttgaaatatggatcgcttgtgaaggttaaagttgaaaacatgcgtaaccaacatgatgcccaaatgcaaaaggttgaagttgaagaaactgtcaaagaaactaaagaatatggtattattgctgttgtagctggtgacggtctagctgagatttttaaatcacaaggtgttgattatatcatctctggcggccagactatgaacccatctacagaagatattgtaaaagcgattgaaaaagtaaacgctagaaatgttattattttaccaaacaataagaacatcttcatggctgcacagtcagctgcagatgtcgttgatattccagcagcagtagtagagacacgtacagttccacaaggatttactagcttacttgcttttgatcctgctaagtctcttgaaactaatgtagctgatatgacaaatagcctctcagatgtcattagtggtagtgtgactttagctgttcgtgatacaacgatagatggccttgaaattcatgaaaacgacatccttgggatggttgatggtaaaattctagtatctacaccagatatggaaaaagcacttaaagacacttttgataaaatgattgatgaagatagtgaaatcgtgacaatctatgttggtgaagatggtaagcaagcattagctgagaccttgtcggaatatcttgaggaaacttatgaagatgttgaagttgagatccaccaaggagatcaacctgtatatccatacctcatgagcgttgaataattgataaaataaaaaattaggagagatacttctaattttttattttatcagagtttctattttagtatgataaagcatcagtattttgaaaattttgacaaattgtgttagaattgttttaaaacattcatacaaaggagatttatgatgtcattaattattcttacggttattttggttttagtgattgttctgttgataacttctttatacgttgttaaacaacagacagtagccatcattgaacgctttggtaaatatcaaaagactgctactagcggtattcatattcgtgtaccattgggtatcgataagattgcagcacgagtgcagttacgtcttttacagagtgaaattatcgttgagacaaaaacaaaagataatgtttttgtcactttaaatattgctacacaatatcgtgtcaatgaaaataacgttacagacgcttattacaaattaataaagccagaagctcagattaaatcttatatcgaagatgctttgcgttcatcagtacctaaacttacattagacgagctatttgaaaagaaagatgaaatagccttggaagttcaacatcaagtggcagaagaaatgtcaacatacggctacatcattgttaagactttaattactaaggttgagccagatgcagaagtaaaacaatccatgaacgaaatcaatgctgcacaacgtaaacgtgtagcagctcaagaattagcgaatgctgataagatcaaaattgtaactgctgcagaagcagaagcagaaaaagatcgtctacatggtgtgggtattgcgcaacaacgtaaagcaattgtagatgggttagctgattcgattcaagaattgaaagatgctaacgtgacattgacagaagaacaaatcatgtctatcttgttaacaaatcaatatttagatactttaaatacatttgctattaatggtaatcaaacgattttcttaccaaataacccagaaggtgttgaagatattcgtacacaagttttatctgctcttaaaacaagataatgaactttttatagaagcaaaataaccagagcatttgctctggttattttgtgtctgacttatttattataattggagagacggaaaaaagttattttttaccgtaacgtttgtactcatgaatgattttcagagcacgttttctagttttaatgttaggacttttaagtctgcgataggctgacgataggtctgttttttcagccatgattacctcctatagacaatttattaacgttaacagacaccagtataccacaaaaaaattaactggtaaagtactttgttgataaatttaaaaataaatagcaaagtaattaaatatcaatcaaaagtaataagttcaaagatatattaaacctttattaatgaggtttggatttgacaagtgatgttaagtgaaagatgaatgaggaaaatacccaacgagaaagtagctaatggctatcattgtgcatataaaaaaacgatcgatgagtgatcgtttttcagcaaactaaataattatttttaatgtaattgaatgaaaatttatacttgtgaaagtgtatcggttaagttaataaggtcagtttttatttatcgtaagcacttaggaagtgttttggagcatacccacgagagtagataaatccggcatcgcgtgaaggatagcttgattcagaaggcgcatacccacgagagtagataaacccggcatcgcgtgaaggatagcttgattcagaaggcgcatacccacgagagtagacaaatccggcatcacgtgaaggataagacactgtgtctgccttcgcaagacttgctaaagtagctaataatagagtgacagctgaagctgctgttaaaacactgattttaagtttcattataaaatcctttcaaagataataaactattcttgcacagtggttagttcattttgtgcatactatattatatcatcaaaagctcattcgaacaacatgtttttaattttaaacaaatatatgattaatcaaatatcgcttaaaattaaaaaatgagatttagtaacttatttaatagtatacaatccaataacgactgtctaatttaatctatagttgaagctagtcgtggatttcactaaagatgtagcaataaaaaatcccctccagttccattgcaatgatgacaatgacaaaacctgtaggggtataaatagtctatatttaaatgtgaataaattttattttaagaagcgttgtagaaattccttagttctttcttgtgttggattttcgaaaagttgtttaggagtaccctgctctgcaatgattcctttgtccatgaaaataacgcggtctgatacttctttagcaaattccatctcgtgtgtcacaattatcattgttaatccagatttagctagatcttgcattgttttaaggacctcaccaaccatttctggatccaaggctgaagttggttcatcaaaaagtatagcttctgggttaacagaaagtgctcgggcgattgcgacacgttgcttttgcccacctgataattgttttggtttagctttccaatattgctcagtcatgccaacagcatttaagttttctttagcaatcttttcagcttcttggcgttcacgttttagaacagtagtctgtgcgacaatagcattctctaagatatttaaattttcaaagaggttaaaagattgaaagaccatcccaagtttttcacgataattatttaaatcatagcctttttcaagaacattgtgaccgtgatataagatttctcctccacttggttcttctaagaggttaatagaacgtaggaaagttgattttcctgatccagaagaaccaatgatagaaataacttcgcctttgttgaccgaaagcgaaatatcttttaacacttcattgcttccgtaagattttttcaaatgtttaatttctaaaatagcttgtgtcataccaacctcctagacttgtaattgattcgcaccggttgtgtaattatctgaatcaaaacgtttttcaatgtaacgtaagatacgtgttacggtgaaggttaagatgaagtaaataatcgcaataatggtgaatgtttggaaatattggtaggtttgtgttgcaacagtattaccagagaagtagagttcgacaacagagataacgttcagtacagaggtatctttgatattgataacaaactcattaccagtagctgggagtatgttacgtacaacttgtggtagaacaatttttcgcatggtttgtccgtgggtgaaaccaagtgcagttgcggcttcaaattgtcctttatcaacagagaaaataccaccacgtacaatttcgctcatataagcaccagtattgattgaaacaataaatatagctgctagtgtacggtccagcgaaactccaaaagcttgtgctgttccgtagtagataaccatcgattgtacaatcataggtgtcccgcggaagacctcaatatagatgttaagtaaccaacctaataatttttgtaaggcagcctttaacttattgtcagattttggtgctgtacggaaaacaccgatgagaaggccgataaataatccgacgattgttcctaccatagaaattaggagggttgtagctgttcctctgaggaattgagaaccattgttttttaaaatagttgccatctgttcaaagaagtttggtttcccatttttttcttttttaacggatggctgttctttaatcatcttatccatcaaggcgatttgtttatctctagaaatgctttcgagaacttgattaacttgattaatacgattgtcacctttacgcatcccaacagaaatatttgtatcggcatcagatgttttaaacccttggtgcagttcaatcatttttaatttaggattagcagtttgagcggaagttgcatctggacgttctgaaacataggcgtctacaacaccagattctacagcttgtcttaattgattgaagtcccccatggcaacttcttttttgacaccattgatttgatcaatgaggttgtataagtagactccttgttgggcagttactttagcatttttgaaatcactaatatttttagcattagtatattttccttcagcattaacaactagagtaggttctgaaatgtagtaaggctttgaaaaattaatttcttttttacgttcttcggtaggactcattcctgcaataatcatatcgagttttccagaagttagtgctggaacaaggccttcccattttgttttgacaacaacaacttttttatttaactttttagctaactttttagcgacttgtacatcataaccattagcatattgatcagttccttcaataggaactgcaccatttgtgttatcattttgtgtccagttgaaaggagcataggctgcctccataccgacacgtagatattcatctgcttgtatacttgtcatacctccaaaggtgataagcaaagcagtgaataaacttagtaatatttttttcattcaacagcctccgataagttacttcctcctattttaccgaaaaacaaggtcgatttcaatatcattatcttattgaaagcgattaattgtatttttatgttaaaatggtatacaaacaaaggaaggaggatgataatgaagaaatgttttttggctatttgtttagctcttagtttttttatggtttcagttcaagcagatgaggtggactataacattcctcattatgagggtaatctaactattcacaatgataatagtgctgattttacagagaaggttacttaccaatttgattcgtcctataatggacagtatgtcacattaggtacggcgggtaagttacctgacaattttgatattaataataagccacaggttgaagtttcaattaatggtaaagtaaggaaagttagttaccagatagaagatttggaggatggctaccgtttgaaagtgtttaatggtggtgaagcaggtgatactgttaaagtcaatgttcagtggaaactaaaaaatgttctatttatgcataaggatgttggtgaacttaactggattcctattagcgactgggataaaacgttagagaaagtagatttttggatatcaactgacaaaaaggttgctctttctcgtctttgggggcacttgggttatcttaaaactcctcctaaaataagacaaaataataatcgttaccatttgacagcttttaatgtaaacaaacgattagaatttcatggttattgggatagatcttattttaatctacctacaaacagtaaaaataattacaagaaaaaaattgaatatcaagagaagatgatagagcgtcatggttttatcctaagtttcttgttaaggatattattaccttcattctttattattgtgacactattcatctcaattagggtgttcctgtttagaaaaaaagttaataaatacgggcaattccctaaggaacatcatttatatgaagcacctgaggacctttcaccactagagttaactcaaagcatttatagtatgagttttaaaaattttcaagatgaggagaagaaaactcaccttatcagtcaagaacaactcattcagtcaattctattagacttgattgatagaaaagtattgaattatgatgataacttgttatctctagctaacttagatagagcttctgatgcagaaatagattttatagagtttgcttttgcggattctacgagtttgaagccagatcaactcttttctaattaccaatttagttataaagaaacactacgtgaactgaaaaagcagcacaaggcttcagatctgcaaactcaaatgagacgccgaggaagtaatgccttatcaagaattacgcgtctcacaaggttgatttctaaagacaatataaactctcttagaagaaagggaatttcatccccttatcgtaaaatgtcttcagaagagtctaaagaattatctaggttgaaaagattcagttacctatcacctcttatttcttttgttgttataatttatacgctttttttaaattattttacctatttctgtatctatctcttattgtttggtgttatcctgttgttgaataaaatcatttttatgatgacaagaaaaataagtaacggttatattgtaactgaagatggagcaagtcgtgtctaccaatggactagttttaggaacatgctaagggatatcaaatcgtttgatcgttcagagttagaaagtatcgtattatggaatcgaatattggtttacgctactttattcggctacgctgaccgtgttgagaaagcactcagagtgaaccaaatagatattccagaaagatttgcaaacattgatagtcatcaatttgcgatttcagtcaatcaatctagtaatcatttttcaacgataactgaagatgttagtcacgcttctaattttagtgttaattcaggcggttcttcaggtggtttctcaggcggcggaggcggcggaggtggtggtgccttctaattttccaaaagtatggtataataaagaaaaatttatggagttattatgttaataattgaattactcaaagccctatttttaggagtcgttgagggagtgacagaatggttacctgtttctagtactggccatttaatcttggttcaagagtttatgaagttgaaccaaagcaaatcctttgttgaaatgtttaatattgttatacaacttggggcaattatggcagttattgtcatttattttaaacgccttaacccatttcagccaggtaaatctgctagagaaattcgtttaacttggcaattatggttaaaagtagtgatagcttgtattccatctattttaattgctttaccatttgataattggtttgaagctcattttaatttcatgatcccgattgcaatagccctaatcttttatggttttgtcttcatatgggttgaaaaacgtaatgcacacctcaaaccacaggtaaccgaattggcaagtatgtcttacaagacagctttcttgattggatgcttccaggttctcagtattgttccgggaaccagtcgttctggagctactattttaggagcaattattattggaactagtcgttcggtcgctgctgactttactttcttccttgccatcccaactatgtttggttatagtggacttaaggcggttaaatactttttagatggtaacgtcttgagtttagaccaatctttaatacttttagtagcaagtctgacagctttcgtagttagtttatatgttattcgtttcttgacagactatgtcaaacgacacgatttcaccatctttggtaagtatcgtatagtcttaggaagtttactcatcctctactggttagttgttcatttattctaaaatataacataaaaagctgagtattcctcagctttttagcgtgttaggctgtgaaaaattgctaaaaaatagctttttcggtataataagaaaactgaatactcgtatgaggtgatgatatggaaatgaaacaaatcagtgaaacaacactgaaaattacaattagtatggaagatttagaagatcgtggtatggagctgaaagatttcctaatccctcaggagaagactgaggaatttttctattctgtcatggatgaattagacttgccagaaaactttaaaaatagtggtatgttaagttttcgagtaacacctaaaaaagatcgcattgatgtttttgttacaaagtctgaattaagtaaagatttaaatttagaagaattagcagatttgggtgacatttcaaaaatgtctccagaagacttttttaaaacattggaacaatcgatgttggaaaaaggggatacggatgcccatgccaaattagcagaaattgaaaatatgatggataaagcaactcaagaagtagttgaggaaaatgtttctgaagaacaacctgaaaaggaagtagaaacgattggatatgttcactatgtctttgattttgataatattgaagctgtagttcgattttcacaaacgattgattttccaatagaagcttctgaactctataaaaatggtaaaggctatcatatgacaattttgctagacttggaaaaccaaccaagctactttgctaatttgatgtatgctcgaatgcttgaacatgctaatgtgggcacaaaaacacgagcttacttgaaagagcatagtattcaattgattcatgatgatgctatttcaaaattacaaatgattgagatgggataaaatgataccttttacaattgagtatatttttgtattgattggagcatttttattatcaatcattctaactcctattattcgagttatatctttgaaggtaggagcggttgataaaccgaacgctcgaagaatcaacaaagtaccaatgccaagtagtggtggtttagcaatatttctctcctttgttgtaacaacattatttttcatgccaatggcggccagtagacactttatagaagtctcttattttcactacattttgcctgtaattattggcggtctcgtagttacaacaacaggattcatagatgacatctttgaattaagacctcgttataaaatgttgggaattattattgcagctattatcatatggaaatttacacattttagatttgatagttttaagattccaataggtggtccactcttggagtttggtcctattttaactttctttttgacagttttatggattatttcaatcactaatgctatcaatctgattgatggtctagatggtctagttagtggtgtttcaattatcagtctagcaacgatggcagtggtttcttatttctttttacctaaaatagatttttttctcacgctaactattgttattttaatcgcctcaatagttggttttttcccttataattatcatccagccattatctacctaggtgatgctggtgccttgtttataggatttatgattggtgtattatcgcttcaaggtttaaaaaactccacagctgttgcagtgataacacctgtcattattttaggagttcctattttggatacagctgttgctattgtgaggcgtaaattatcagggaaaaagatttctgaagctgataagatgcacctgcatcaccgattgctatctatgggatttacacatagaggagcagttttagttgtttatggtattgcaattatcttttcgcttatcgctttgcttttaaatgtttctagtcgtattgggggaatttttcttctattggcgctactattagcgatggaaatttttatagaaggtttaaatatttggggtgagaatcggacaccactatttaatctcttaaagttcattggcaacagtgattacagacaaagtgttattgctaaatatagcgataagcatcaaaaataaaagcctgaaaaggcttttttagttttaatcatttagatagcagtcacacctcatttttgctataattatttagaatataatatcgggtgagtgccctataatatcttctttaaaccatagagaaatatcacatattctctgttaaccaagaaaaggagtgtacaatgtctgtacttgaaatcaaaaatcttcatgtttctattgaagataaagaaattttaaaaggtcttaatttaacgttgaaaacaggagaaattgctgctatcatgggtccaaatggtactgggaagtcgacactttcagcagctattatgggaaatcctaattatgaagttacagcaggtgaaattctttttgatggtgaagatattttagagctagaagtggatgaacgtgctcgtttgggtctatttcttgccatgcaatacccttcagaggttccagggattactaatgctgaatttatccgagcagctatgaatgcgggaaaggctgatgatgataaaatttccatccgccaatttatcactaagttagatgaaaagatggaactacttggcatgaaagaagaaatggcggaacgttatcttaacgaaggtttttcaggtggtgagaagaagcgcaatgaaattttacaactcctaatgttagagcctaagtttgccctcttggatgagattgactctggccttgatattgatgctcttaaagtggtatcaaagggagtcaatgaaatgcgtggtgaaggttttggtgctatgattattacacactatcaacgccttttgaattacattacaccagataaagtacacgttatgatggacgggaaggtagtattgtcaggaggaccagaattagcggttcgccttgagaaagaaggttatgctcaaatcgctgaagagcttggtttagagtataaagaagaagtctaatttgtcacttcaactagaagagaaaaggagttacaaatgtctaaagaagctatattaaattttttacaagccaaaggtgagcctacttggttacaagaattacgactaaaggcttttgaaaaaatagaagaactagaattaccagtaattgaacgtgtaaaatttcatagatggaatttaggtgatggaaccattttagagaatgactatacagctaacgttccagatttcacagagttaggaaacaatcccaagttggttcaaattgggacccaaaccgtccttgaacaagttcctatggaattaatagagaaaggcgttgtctttacagatttctattcggccttggaagaaattccagaagtcatagagcgctactttgggaaagcacgtccttttgaagaagatagacttgctgcctatcacacagcttacttcaacagtggtgcagtgctttatattccagataatgttgaaattactcaaccaatcgaaggtcttttttatcaagatagtcagtctaaagtaccatttaataagcatatccttcttattgttggaaagaatgcaaaagttagttacttagagcgatttgagtcaattggtgatgggacagaacgaacaagtgctaatatttctgtagaagtaattgcccaagcaggtagccaaattaaatttgcttcaattgatcgcctcggagaaaatgtgacaacgtttataagtcgtcgtggtcgtcacagtagcgatgcaacaatagattgggcccttggggtgatgaatgaaggcaatgttgttgctgactttgattctgatttaattggtgatggaagtcacgctaatttaaaagtagttgctgcctcgtcagggcgtcaagttcaaggaattgatacgcgtgttacaaactacggctgtaattcagtaggacatattttacagcatggggttattttagagcgtgggactcttacttttaatggtatcggacatattataaaaggtgcaaagggagcagacgcccaacaagaaagccgagttctcatgttatcagacaaagcacgttcagatgctaatcctatccttttgattgatgaaaatgatgttacagctggtcacgcagcctcaattggtcaggttgacccagaggatttatattatttgatgagccgaggcttgaaccaaaaaacagcagagcaattagttattcgtggatttttaggaacagtcattgctgaaataccagtaaaagaagttcgcgatgaaatgattgccgttattgatacaaaactagaaaaacgttaatatgacattactagatagttataaactaaagcaagatttcccaattttaaatcaattagttaatgatgagccgcttatctatttagataatgcagcaacgacacaaaaaccgaatcaagttttagaagctttgcgagactactaccaaaacgacaatgcaaatgtccatcgtggtgttcatactttagcagaacgagcgactgctcagtacgagaatgctcgtgaaaaagcaaggcagtttttaaatgctaaattaagtaaagaaattttattcacacgtggcaccacaacaggattaaattgggtagctaagtttgccgaaagtattttagaacgaggtgatgaggtacttatttccattatggagcatcattctaatattatcccatggcaacaagcttgcgagagaactggcgctaaattggtttatgcctatctaaaagatggttctttagatttagaagatttctataataaattatcctctaaaactaaatttgttagtttggcacatatctcaaatgtacttggctgtgttacaccagtaaaagcaatagcagaacgtgtacatcaagttggggcatacatggttgttgatggagctcaatcagcgccacatatggcgattgatgttcaagaccttgattgtgatttcttcgccttatctggccataagatgcttggtcctactggtattggtgttctttatgggaaagaaagcattttagataagatgccacctgtcgaatttggtggtgaaatgattgattttgtctatgagcaaagtgcaacatggaaggaattgccctggaagtttgaagctggaacgcctaatattgctggagcgatcgcttttggagaagctttagattatttaacggatgttggtatggatgagattcatcaatatgaacaaagtttagtttcttatgtgttgcctaaattacaggctatcgatggtttaactatttacggacctagtgatgctgaatctcatgtaggcgttattgccttcaatttagaaggtttacacccacatgatgtggcaactgcaatggattacgaaggagtggctgttcgtgcaggtcatcattgtgcacaaccccttattaatcatcttggtatccattcggcggttcgagcaagtttctatttctataataccaaagaggattgcgacaaattggtagacgctatccaaaaaactaaggagtttttcaatggcactctctaaattagataatctctacatggcagtggtagctgatcattcaaaacaccctcatcatcatggatttttagaaggcgttgaacaagtgcagttaaataatcctacatgtggagatgttatttccttatctgttaaatttgatggaaatattatttcagatattgcatttgctggtaatggttgtacaatttctacggcttcatcaagcatgatgacagatgcagttattgggaaaacaaaagaagaagcattgcagcttgctgatgtattctccaaaatggttcaaggcgatcaaaatccaaaacaagagaaacttggggatgcagagtttctagctggggtatcaaaatttccacaacgtatcaaatgtgctacgctttcgtggaatgctttaagaaaggctattgagagagataatcaggcagaactctgacaaccatagttgaaggaattacatttaaacaacttttactgacataaggtagtctagtagaagaatgtcttaaatttaaatattaaagaaaggataagtatgtccgaaataaatgaaaaagtagaaccacagccaatagatcttggggaatataaatttggatttcatgacgatgtaaagccaatttattctacgggaaaaggtctaaatgaggctgttattcgtgagttatctgcagctaagggtgaacctgagtggatgttggactttcgtctaaaatccttggaaacgtttaataaaatgccaatgcagacctggggagcagatttatcagatattgattttgatgatattatttattatcaaaaagcatctgataaacctgcgcgtgattgggatgatgttccagaaaaaatcaaagaaacttttgaaagaattgggattccagaagctgaaagagcttatcttgcaggagcatcagcacaatatgaatcagaagtggtttatcataatatgaaagaagaatatgataagctgggtattgtttttacggatactgactctgcacttaaagagtacccagagctattcaaaaaatattttgctaaacttgtccctccaacagataataaattagctgctctgaactctgctgtatggtcaggtggaacatttatttatgtccctaaaggtgttaaggtggatattccacttcaaacttacttccgtattaataatgaaaatactggacaatttgaacgtactctcattattgtcgatgagggagcaagtgttcactatgttgaaggttgtaccgccccaacttattcttcaaatagtttacatgcagctatagttgaaatttttgcacttgatggagcttatatgcgctatacgactattcaaaattggtccgataatgtctataatttagtgacaaaacgtgctaccgctaaaaaagatgcaacagttgagtggatagatggaaatctaggtgctaaaacaacaatgaaatacccatcggtttaccttgatggtgaaggagcacgtggcacgatgttgtctattgcttttgcaaacaaaggacaacaccaagatacgggtgcaaagatgattcataatgctccccatactagttcatccattgtctctaaatcaattgctaagggtggaggaaaagttgattatcgaggtcaagtgacatttaataaagattccaaaaaatcagtgtcacatatagaatgtgacaccatattgatggatgatatttcaaaatcagataccataccgtttaatgagattcataattcacaggttgctttagagcatgaagcaaaggtgtctaagatttctgaagagcaactgtactacttgatgagtcgaggtttatctgaagctgaggcaacagaaatgattgttatggggtttgttgagccctttacgaaagaattaccaatggaatatgcggtagagttaaaccgcttaatttcctatgaaatggaaggttcagttggttaattgaagatttcaagagataataaaaagcccctatgttattgatgaagggggcttttatattagcacagttattatctagagcgctttataagtaatactatcccagctaaaagacaaaggatagcgatggtgcccagaacaattaaaatagatacaaaatgtgattgaataaattgatctgtttttgtccaccactgttcttttgtttgaggctgttcttgaatagatttggttttggttttagtaacttcttttttaggtttaacggcttttaatacaggagttttagaagaaatatttttagcgtctttaaaacctttttctacaagagcgttgacaaacggatgacgatagtactctccgtcttggtctgaccaatcaccaactcctaaaaccacagttatcaagcgagtattctggcgtttagctgtaactaaggcattaaaagcagcgctagggctagaaccagtttttaagccatctactccttctaatccaaatttagcgccgggggtagagtagttataagttgtaaatgtttcttcataaggagttccgaccatggccttgacttcaggatattttgtatagttcagtatatcagggtattttttaaggaaatgataggttaaaattgatagatcacgtgcagtcgtaacgttagtagcattgttatcgtattcttttggggagtaaagtccattaaaagcactcgctaccgccccactggggttataaaagtgagtttttgtcataccgagtttcttggcggtttcattgattcgtttaatgaaggcgtcaggattgttttgtgataagtggttagcaatcataatagttgctacattagatgacgggacagctgtcatagtaatcagttcacgaataggataagcaaccccagcatgaatattattattactaatttcataaatcttacttatggcttggtctgtttctgttgcagtcactgtggtgttgaggcttgtttttcctttagctaagtcttcaaatagtaaatataaagtaaacattttagacatgctagcgggatcacgttctaaatcagcgttatcttcccacaaaatatgacctttattgtcaataacgatagacgctttaggtttattaatatctttaacatcatatccggcttctcgggtaatttgcataatatctttatgttcttcagcttgcacagagtttacacaagtcagggataataaaatgcagaggaaagatacgattaatttaggcataggtaactcctgaaaactttttattaatattataacaaaaaatcactaataaaaaagacatttcattagtgatttttaattttatatattctcctaaacctagctaaagaaactgctgtgcagcaactccttgtgtcaaagggagattactattaaagtttttcgttaacgtagcgcacaaaatgattccaccacactttgaggaagaaactgcgctcaatactatcttttgccactaaatgaacgctaggttcctttatgagatagccttttccaaccttattaaggtcaacgtaataagctttccctaggttctctttttttgtaataggagcagtaagctcttttttaaagttaatttttaactgattttgtttagtgatatttttcttctgtactactttcaaatcgtttttagcaacagcgatgaccgattgttcttttccgtctctcacacttgcttctttacctttatatgcagctcctttagctaatacaaggttaggttcgtaggtgtttgtgatatagttcaagagagagttagttgctgtaaagcgagcatatttgtctttatcggccttatcagcatgcataataacagtgagtagtctcattccactttcagtagatgtagcaataaaagattggccagctaattccgttgtcccagttttcaaacctgtaatacctggtctaaagacaggcatatctggtagcatgtagttataagaatgcataatatctttatcaaatttagcaacggacttactagtaatcttaagaatggaaggatattcgttgaccaaatggtaggcaacaatagcaatatcacgtgcactcattttattttcgtcgttttgtgacgattttggataaatgtgattgcctaacatactattatttaagccagaagcattgactaggtggctatcatgaattccccacttttccaattgagcagtcattttatcaacaaatttactttcggttcctgaaatatgttcagccaaagcaatggctgcactgttagcactagaaatcatggcagcgtccacgagctgtttaacagtatagcgccttttttctaaaggaacattactagcatcagattcgcgtgttagttgataagggtagtcagatatatttactttggtattccacttgaggttaccgttatcaatttctttatagaccatataaacggtcattattttagtcaaggaagcaatagcagcgggtttgttagcatctttttcatacaagatttttcctgaatctaaatcaactgccaaggcatgtttagcggaagcattaaaagattcagcagagatggttggcataaaaaaaatgcaactaagtaatagaatagaagtaataatttttttcaaaataacacctttagaaattttttaaactttgtccatcctattatatcatatcactatatcatactaggaattattatttttgataattaaataaagaaaacgtttgttataaaaatgtaaaaaaatgtaaaaaaatgaaagttaaaaaattatctgaaaattttgcgtttttgtcttttcttaagaattttttgtggtataatgttagtcactagataaatgaattaggagaacaaagctatggcaaaacagaaaaataactggcgccgtgttggagttggtgtccttacacttgcttcagttgcgactcttgctgcatgtggaagtaaatcagcttcccaggattctaatggagcgattaattgggctattccaacagaaatcaatacactagatttatctaaagtcacagacacttactcaaatctagctattggtaactctagtagtaatttccttcgcttagataaagatggaaagacaagaccagatttggctactaaagtagatgtttcaaaagatggcttaacttatacagctacattacgtaaaggcttgaagtggtcagatggcagtaaacttactgcaaaggattttgtttattcatggcaacgtttagttgatcctaaaacagcttcacaatatgcttaccttgctgttgaagggcatgtgcttaatgccgataaaatcaacgaaggacaagagaaagacttgaataagctaggtgttaaggcggaaggcgatgacaaagttgttattactttatctagtccgtctccacaatttatctactaccttgcattcactaacttcatgccacaaaaacaagaagttgttgaaaaatatggaaaagattacgcaactacttcaaaaaatacagtttactcaggaccatatactgttgaaggttggaatggttcgaatggtactttcacgctgaagaaaaacaaaaattattgggacgctaaaaatgtaaaaacaaaagaagttcgcatccagactgttaaaaaaccagataccgccgttcaaatgtataaacgtggtgagttagatgcagctaatatctcaaatacttctgctatttatcaagctaataagaataataaagatgtcacagatgttctagaagcgaccactgcctatatggaatataatactactggttctgtgaaagggcttgataatgttaagattcgtcgcgccttaaacttagcaactaaccgtaaaggagttgttcaagcagccgttgatacaggctcaaaaccggcaattgcttttgcacctactggtttagccaaaacaccagatggaactgatttggcaaaatatgttgccccaggttatgaatataataaaactgaagcagcaaaactctttaaagaaggtttggctgaatcaggcttgactaagctaaaattaacaattacagcagatgctgatgctcctgctgccaaaaactctgttgactatatcaagtctacttgggaagctgctcttccaggacttactgttgaagaaaaatttgtaacctttaaacaacgcttagaagacagtagaaaacaaaactttgacatcgtagtttctctttggggtggggattatccagaaggatcaactttctacggcctctttaagtcagattcacaaaataacgatggaaaatttgctaacaaggactatgatgctgcttataacaaggcaatttctgaagatgcgatgaaaccagcagaatcagcgaaggactataaagaagcagagaaaattttatttgagcaaggtgcttataacccactctacttccgtagtggtaaaggtttacaaaatccaaaattaaaaggtgttattcgtaatactacaggtttgtcaatagactttacacatgcttataaaaaataattaaattactttacactaaacctttgcaagaattggtaattgccagttcttgcttttggttaagtaaagaaagtgaaagagtttgctatttttagcaattctaagaaaaggaaatgatatgattaaatatattttaaagcgtgttgctattttgttagtaacgctatgggttgtcataaccctatcgttctttctgatgcagatccttccaggaacaccctacaataatccaaaactcactgaagaaatgatcgcattgcttaataaacagtatggtttagacaagcctgtatggcaacaatatttgacttacctttggaatgtacttcatggtgactttggaacgagttatcaatcagtgaatcagccagtatcacgtatgattagcttgagattaggagtttcagtacatctaggtgttcaggctctcgtatttggtgttttaggcggtattttggtaggagctatttcggcacgtcataagaatgataaagtcgatggtatcttaagtgttattgcaacgctagggatttctatgccttcatttatcattggtatcttattattagactattttggatttaagtggaacttgttgcctttatcaggttgggggactttctctcaaaccattttaccttctttagctctaggactccctacattagcatctgtttcacgcttcttccgtagtgaaatgattgaaactttaaattctgattatgtgcaactagctcgttcaaaaggtatgacaattcgtcaagtaactcgaaaacatgcttaccgtaattctatgattccaattttaactctaattggccctttggcggcgggtctgttaactggttctgcactaattgagcagattttctcgattccaggaattgggcagcagtttgttacttcgattccaacaaaagactatcctgttattatggggacaaccattgtttatgcagtaatgttgatggttgctatcttgataacagacgttgttattagtatcgtagacccacgtgttcgcttgcagtaaggagatgttatggcagataaaaacagaacatttaaacttgtaggtgcaggatcttctagcacacaagaaaaaattgaaaagcctgctctttcgtttatgcaagatgcgtggcgtcgcttgaaaaaaaacaaattagcagtagtttcactctatttattagctcttttacttactttttcgttagcctcaaatttatttgtaactcagaaggatgctaatgggtttgattcgaaaaaagtaactacatatcgcaacttaccacctaaattgagttcaaaccttcctttttggaatggtagcattaagtacgctggaaatacagaatctacagacgcttataagtctcaaaatgtccctgaaaaagttaagtatgctttaggtacagattctctagggagaagtgttgctaagcgcatcatcgtaggtattcggatttccttacttgtagctattgcagctacattcattgatttaattatcggtgttacatacggtcttgtttcaggttttgctggaggacgccttgatacattaatgcaacgtatcgtagaggtaatttcatcaattccaaacttagttatcgttacaatgttaggtttggtccttggtaacggtattacggctattattatctctattgcttttaccggatggacttctatgtctcgtcaggtaaggaatttaaccctatcatatcgagaaagagagtttgtgcttgctgcacgttcacttggggaaagtccaattaaaatagccttcaaacatattttacctaacatttctggtattatcattgtacaaattatgatgacaatcccaagtgctattatgtatgaagcggtactttcagcaatcaatttaggtgttaaaccaccgacagcttcattaggatcattgatttcagatgcacaagaaaatttacaatattatccatatcaagttatcttgccagctttagcattggtaatgatttcattggcatttattttgcttggtgatgggttgcgagatgcttttgatccaaaatctagcgatgaataaggaggtataatcatggaaaaagaaactattttaagtgttaataatcttcatgttgacttccacacatatgctggagaagtaaaagcaattcgtgatgtcaactttgaattaaaaaaaggtgagactcttgcaatcgttggtgaatctggttcaggaaaatctgtaactaccagaactttaattggtttaaatgctaaaaattcagagatatcagggaatgttcaatttaaggggcgtaaccttgttgaactatcagaagaagagtggactaaggtacgcgggaatgagatttctatgattttccaagaccctatgactagtttggatccaacgatgaaaattggcatgcaaatagcagaaccaatgatgattcatcaaaaaatttcaaaaaaggatgctttaaaattagctcttgagctaatgaaagatgtaggtatcccaaatgctgaagagcatattaatgattacccacatcagtggtctggaggaatgcgccaacgtgcggttatagcgattgctttagctgctgatcctgaaattcttattgctgatgaaccaacgactgctttagatgtaacaattcaagcacaaattttgaacttaatgaaaaaaattcaagcagaacgagactcctccattgttttcataactcatgacttaggggtcgttgcagggatggcagaccgtgtagcagttatgtatgcagggaaaattgttgaatttggaactgttgatgaagtcttttataatccacaacatccatatacttggggattattgaattcaatgccgacaaccgacacagaatcaggtagtttagagtcaattccgggaacaccaccagatttgttgaacccacctaaaggagatgcatttgcagctcgtaatgaatttgcattagatattgatcatgaagaagaaccaccgtacttcaaagtttcagaaacacatttcgctgctacatggcttttagatgaaagatcacctaaggtgcttcctccattaccgatccaaaaacgttgggaaaaatggaacgagattgaagggaggaaagcctaatgactgaaaatcgaaaaaaattagttgaagtcaaaaatgtttctttgaccttcaataaaggaaaagctaatgaagtgagagcaattgataatgttagttttgacatttatgaaggtgaagtgtttggattagttggggaatctggatcaggaaagacaaccgttggacgttcaattttaaaactttatgatatttctgatggagaaattacctttaatggagaagtgatctcacatctgaaaggtaaagcattacatagttttcgtaaagacgctcagatgatttttcaggatcctcaggctagcttaaacggccgtatgaagattcgtgatatcgtagcagaaggtttagatatacataaattagctaaatcaaaatcagatcgtgatagtaaagttcaggccctattagatcttgtagggttaaataaagatcatttaacacgttatccgcatgaattttcaggtggacaacgacaacgtatcgggattgcacgtgctttagcagtagagcctaaatttatcattgctgatgaaccaatatctgccttagatgtttcaatccaagcacaagttgttaatttaatgcaaaaattgcaaagagaacaaggattgacttatttgtttatcgcacatgatttgtctatggtaaaatacatttcagatcgtatcggtgttatgcattgggggaaactgttagaagttggaacatctgatgatgtttataacaatccaatccacccttatacgaagagtctattatcagctattccagaaccagatccggagagtgaacgtcaacgtgttcaccagccgtataatccagctattgagcaagacggacaagaacgtcaaatgcacgagattacccctggtcattttgttttatctacaccccaagaagctgaagaatataaaaaacaaatattataaaagatggctagcccatcttttatttttttactaataaaataaatttaggtatggaattttaaactctatgttattggtgttagccaacaggaaacttttttcagaaaatgtagaaaaagtatgaaaaaagagttgacaaagtaagagatgatgtagtaaactaaataagttgtctcgagagagcagtttctattagcgcgtagttaacaacttaaaaaaagtagttgacaaagcagaataagtttgctagaatatagaagttgtctcaagagaggcaaagacctttgaaaactgaacaagacgaacgaatgtgcagggtggatttacattgtaaatccgtcaatgacaaaaaacaataaatctgtcagcgagacagaaaagagcaaagctcaaacttttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggataaggaaacctgccatttgcgtcttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattgtagaaagtaacaagaaaataaaccgaaaacgctgtgaatatttaatgagttttctagttttaaagaaactaggttaataaggttaagttaataagggcgcacggtggatgccttggcactagaagccgaagaaggacgtgactaacgacgaaatgctttggggagctgtaagtaagcgctgatccagagatgtccgaatgggggaacccactagttaatgactagtatccatatctgttaaggatatgagaaggaagacgcagtgaactgaaacatctaagtagctgcaggaagagaaagcaaaagcgattgccttagtagcggcgagcgaaacggcaggagggcaaaccgaagtgtttacacttcggggttgtaggactgcgatataggattaatcattatagaagaattacctgggaaggtaagccaaagagagtaacagcctcgtatttaaaatgatagattaaccttagcagtatcctgagtacggcgagacacgcgaaatctcgtcggaatctgggaggaccatctcccaaccctaaatactctctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcgtcatagtatcatgttgtagacccgaaaccatgtgacctacccatgagcaggttgaaggtgaggtaaaactcactggaggaccgaaccagggcacgttgaaaagtgcttggatgacttgtgggtagcggagaaattccaaacgaacttggagatagctggttctctccgaaatagctttagggctagcgtcgatgttaagtctcttggaggtagagcactgtttgggtgaggggtccatcccggattaccaatctcagataaactccgaatgccaacgagatataatcggcagtcagactgcgagtgctaagatccgtagtcgaaagggaaacagcccagaccaccagctaaggtcccaaaatatatgttaagtggaaaaggatgtggggttgcacagacaactaggatgttagcttagaagcagctattcattcaaagagtgcgtaatagctcactagtcgagtgaccctgcgccgaaaatgtaccggggctaaaacatattaccgaagctgtggatgacacaaaagtgtcatggtaggagagcgttctatgtgtgaagaaggtgtaccgtgaggagcgctggaacgcatagaagtgagaatgccggtatgagtagcgcaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatatagtgatggagggacgcagtaggctaactaaaccagacgattggaagtgtctggtcaaacagtgaggtgtgatatgagtcaaatgcttatatctttaacattgagctgtgacgaggagcgaagtttagtagcgaagttagtgatgtcacactgccaagaaaagcttctagcgatacatatactctacccgtaccgcaaaccgacacaggtagtcgaggcgagtagcctcaggtgagcgagagaactctcgttaaggaactcggcaaaatggccccgtaacttcgggagaaggggcgctgattttagatcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctatgataacgggacgccagtttcgtttgaggcgttgttgggatactacccttgtgttatggctactctaacccagataggcaatccctatcggagacagtgtctgacgggcagtttgactggggcggtcgcctcctaaaaggtaacggaggcgcccaaaggttccctcagactggttggaaatcagtcgtagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataagcgctgaaagcatctaagtgcgaagcccacctcaagatgagatttcccatgattttatatcagtaagagccctgagagatgatcaggtagataggttaggagtgtaattgtggtgacacatttagcggactaatactaatagctcgaggacttatccaaaaagagatattgacaacgttacggtttcttgttagactatagatattcaattttgagtgaataaggctcaatagttaagtgataattgcctaggagatacacctgttctcatgccgaacacagaagttaagccctagaacgccggaagtagttgggggttgccccctgtgagataaggtagtcgcttagctataatccgccatagctcagttggtagtagcgcatgactgttaatcatgatgtcgtaggttcgagtcctactggcggagtagataaagggagactaactttggttagcctttttttattggaattattatccttaagattggctagcatcttaattgtccgaatttgtcatttgttatgttataatatggatattctatattttattagggaggttttatgaaaatttttgagaaagctcctgccaaacttaatttaggattagatattaaaggacgatgtgacgatggttatcatgaattagctatgattatggttagtattgatcttaatgactacgttaccatttctgagctaaaggaagattgtattgttatcgattctgatagtagcaaaatgcctttaaataatgataatgatgtgtttaaagctgcagatataatcaaaaatcaatatggtattaataaaggtgttcatattagattagaaaaatccattcctgtctgtgcaggactggggggtggttctactgatgctgctgctacaataagagctcttaatcgattatggaatcttcaaatggactatgacgaaatggttgctattggttttaaaattggtagtgatgttccttattgtcttggtgggggatgttcgttagtattaggtaaaggtgaaattgttaaacccttaccgacattgagaccatgttggatagttctggttaagccggattttggtatttcaactaaatccatttttagagatattgattgtaagtctataagtagagttgatattgatttattaaagtctgctattttgtcatcagattatcagttaatggtcaaatctatgggaaattcactcgaggatattacaattactaaaaatccagttataagtacaataaaagaacgtatgttaaattctggagccgatgttgcattaatgacaggaagtggaccaactgttttttcaatgtgttctacagagaaaaaagctgatcgtgtttttaatagtatgaaaggtttttgcaaagaagtttataaagttaggttgttgagataaaaggttttatcttcttcacctatctatgattgattcttctatatcttcgtgatataatttactggttaacaaaaaagaggtatatatgacagttttagaacaaaaattagaccatttagtgagtcaaatcttgcttaaagcagaaaatcaacatgaattattgtttggtacttgtcaaagtgatgttaaattgactaatacgcaagaacacattctgatgcttttatcacaagagcagttgacaaattctgatttagctaagaagttaaatattagtcaggcagctgtaactaaagcagtaaaaagtttaatttctcaggatatgttgaaagcgaataaagattctaaagatgctcgtattacttattttgagttatctgaacttgctaaacccattgcagatgaacacacacatcatcatgacaatacgttaggggtttacggaagattagtaaatcatttttcaaaggacgaaaaggtcgttttagaacgttttcttgatcttttctctagagaattagaagggtaatcatgcgatatattacagttagtggtcttacttttcagtacgatagcgatcctgtgctggaaggggttaattaccatttagacagtggggagtttgttaccttaacaggtgaaaatggggctgctaaatcaactttaataaaggctactttaggtattttaacgcccaaagtgggtacagttaatatctctaaagaaaacaaagaaggaaaaaaattacgtattgcctatttacctcaacagattgcaagttttaacgctggctttccatcgtcagtttatgaatttgtgaaatctggacgataccctagaaatggttggtttagaagactgactaaacatgatgaagaacatattagggttagtttagaagctgttggtatgtgggataatcgccataaaaagataggaagtttatctggcggtcaaaagcagagggctgtcattgctaggatgtttgcttctgatccagatatttttgtattggatgagccaacaactggtatggacgcagggactactgagaaattttatgagttaatgcatcataatgctcataagcatggtaagtctgttttgatgattactcacgatcctgatgaagtaaaggggtatgctgaccgaaatattcatcttgttaggaaccaatctttaccatggcgttgtttcaatgtccatacaaacgaaatggaggttgaatcagatgctacttgatatgctttcctatgattttatgcaacgagcgctcttagcagttgtggctattagtatttttgctccaattttaggcatcttcctaattttacgtcgtcagagtttgatgagtgatactttgagtcacgtttccttagccggtgttgcattaggcgttgttttaggtatctcgcctacatggtcaactattttcgttgttactttggcggcagttgtattagagtatttgcgtactgtatacaaacattatatggaaatatcaactgctatcctgatgtcgatggggttggctatatctttaatcgttatgagtaaagctcataatgttggtaatgtcagtcttgaacagtatttatttggttctattattactattgggaaggaacaagtgattgctttgtttgttattgcattaatcacttttattttaaccatcctatttattagaccaatgtatatattaacgtttgatgaggatacagcttttgtagatggattgcctgtgcgtacaatgtctattttgttcaatgttgttacaggtattgctattgcattaacaattcctgccgcaggtgctctattggtgtcaactattatggttttaccagctagtattgctatgcggttaggtcgaaattttaaaactgttatttttctgggtatgttaattggatttgtgggaatggtagctggtattttcctttcgtattattgggagacacctgctagtgcaacaataacgatgatttttattggcattttcctattagttagcttagtaggcttgcttcgcaaacgttaaataaaaaaatctatcttattctaggatagattttttatttatctccctgtttttttcgaatatattttatgagggatcagttgagaaattatctcgatgaggtatctactaagttttctggcttaagttgatagaaggggcaatgtgaatctatttttgcgttttaggataaaaaatactaccggcaattttgccggcagtaaattgtaattattgtgcttcagtagtgctgtgatgtttgtgttgatttaacgcttcttgttcagtcatttgaacgatattagcggtatttgcattttttatgttttctaaactataccaataagtatttgaacgacccttatttgcaacgtagacgattctattttggggagctacattatttgtatctgattcagaagtattagtgttagtattttcttctatatcagatgcactttcaatagctgcttcgttttcatcagcatcgctatttggatcttcaccttcttctgcctgtttcccatcttctttgattagcataccagttttgtaatcaatttttgcgagtggagacgtattttctaatgtaacagttgtgacgccgtattcatcaacttgttctttgccgccgcctaatttgatttctagaagttttccttgtttatcaattccaacatactgaagttcaactcggctaggtactaaattatttccttcgtatattggagtcactttgtaatcaagctagaaatttttatgatttgccaaccaactatctaatctattttcgtagtataacataccatcaggattattttcgctaaatcctgtatttagatatttggtcatagtaactaggttctcaggaacattgttcattcctgaaaattgataaccaacgaggtgacctcggtctataagccaagttgttttacccttttcagtagtaaatttgtagttgtgccaaccggttggattatacgtcagtctttctctttttatcttaggctcatctgcatcccttaattgtatgtgagaatatgttgctctttctaagttatctaatgaacctaccttgatttgcttattatgagtaaacggtaagatttttttgaagaagtacttacatactgtgtctcaacatgggatgtcgtcttataatgtttagccttagcttcaacattctgttgtaatgccccaacgcatagtacgacagttaatagtggtagtgatttgtataattgtttagataatttcataaacctaaacccttctaaatgatatttgtgaaggcctttcacaagtataattttatcattttattgggaaaaagtaataaaaaaacataactagttaattttttttggagattatgttatttaactagatagttattaaagttaaatgttatagatatactgttattacataataatttttatatgatttgttattttattagattttttaatggattatttctttagctgattttgattacaaagttaaggtattctaatcatattttcttgatttataacatgtaaaggttagaataaattcgttggtgttagacagacgatatttgttgtttttatgaaaaaattgtgggtattagatatgtatattttttcgataactatttactctatggtaaaaattctaagctgtttgtttggtgttatttcttaataaaaataaggtagtcatgtataataactataatttaaaagttgtctcttcaggaatgttgttcattaataaaaagtgtagtcaattgactacactttttattgtcttgaaatattattatcagagtatcgattacacttcaagtctatttaaagtttaatacaaagtattttttctttccacgacgaatgactgtaatttcattttcaagcttatcattttctgagatagtatattctaaatcttgaatacgatctccattaatataaatagctccattggagacatcttctcgagcttgacgtttagaattgacaactcctgaagtgactagaaggtctatgatattgaggttatcttccgtctgaacgtgataatttggtactccacgtaaaccttgtttgagctctttaacagacaatccttttatattgccagcaaatagctgttccgtgatattaacggcctccttataagctttttcaccatgaacaagagttacaacttcacgtgctagtgttttttgtgctaagcgttggtgaggtgcttcctcgaattgaatacgtatatcttctatttctttaaggcttaggaatgtaaaaatcttaaggaagcgaacggcatcagcatccataacattgagccaaaattggtacatttcataaggagaggttttgtcagcatcaagccaaacagcatttccttcagattttccgaatttttttcctgtagaatctgttatcaatggaacagtcataacatgagatacaccatttgattttcgtctaataagttcggttccagcagtcatgttgccccattggtcagaaccaccaatttgcaaagtgacattatagttcttatttaattcgtaaaagtcatatccttgcataatttgataagcaaattcagtataggaaatccctgtttcgatacgttttttaacagattctttactcatcatataattgacagtaaaatatttaccaacatctcgtaagaaatcaatgaaactaatattgctgaaccaatcataattatttaccaatacagctttgttatcacctgtttcaaactctagaaaattagataattgaccgcggattttattaccccaactaactacagttttctttgtttgtaaactgcgctcaacatctttaaatgaagggtccccaataagtccagttgcgcctcccacaagtgcataaggcttgtgaccagcaagttgtaagcgacgagaggttaaaatagcaactaaatgtccaagatgaaggctgtcagccgtaggatcgtagccagtatagtaagagacagaaccttcttcaagagctttgcgtaaagcatcttcgtcagttgtctgaaaaacgagtccacgttctttgagttcatcaaaaatattcatctttttctcctaattattaacttgttgtgtattaatgtcaactatatcaaaactctttaggatatgcaagttatattaaatctgatataatgtaggatgaggtattattcatgtttaaaggtaataagaagttgaatagttctaaattaggtgattacacaccacttgaatttggttctatttttttaagaattgtaaagcttttatcagatttcatctatgttattattttactatttgttatgctcggagtaggacttgcagtagggtatcttgctagtcaagttgactctgttaaagtaccaagtaaaaatagtttagtgacacaagttaatacacttactagggtgtctaggttaacttattctgataaatcacaaatttcagagattgccactgatttacaacgtacaccagtggcaaaggatgctatatctgataatattaaaaaggctatcattgcaacagaggacgaaaatttcaatgaccataaaggtgtagttcccaaagccgtactacgtgctgcagcgggatctgttctggggtttggagagagtagcggtggttcaacgctgacacaacaattattaaagcagcaaattttgggagatgatccgtcatttaaacgcaaatcaaaagaaattatttatgctctagcattagagcgttacatggataaggattcgattttatcagattatttaaatgtatcaccgtttggtcgcaataacaaaggacagaatattgcaggtattgaagaagcagcacaagggatttttggagtttccgcaaaagatttaacaattcctcaggcagctttccttgcaggtttaccgcaaagtcctattgtatattctccttatactgcagatgcccagttgaaatcagataaagatcttagttttggtataaagcgccaaaaaaatgtgttatacaatatgtatagaacgagagctttaaccaaagatgagtacaaatcctacaaagattatgacatcaaaaaagattttatcaaacctgcagtggcgacaacaaatcatcatgattatctttactactcggcattatctgaagctcaaaaagtgatgtacaattacctcattaaaaaggataatgtttcagagcatgatttaaaaaatgatgagactagagcgacgtacagacaccgcgctattgaagagattcaacagggagggtatactattaaaactactatcaataaatctgtttatcaagccatgcaggatgctgcagctcaatacggagggttgttagatgatggtactggcaaggttcaaatgggaaatgtactaacggacaattctagtggtgctattataggatttattggtggtcgtaactatagtgagaatcaaaataaccatgcttttgatacggcacgctctccagggtcaagtattaaaccgatattaccttacggaattgctattgatcaagggatgttaggaagtggtagtgttctttcaaattatccaacgacatattcaagtggcgaaaagattatgcatgcggatgaagaaggtactgctatggttaaccttcaagagtcattggacatttcttggaacattccagctttctggacttacaagatgctacgagatcgaggcgttgatgtaaaaaactatatggagaaattagactatccaattgaaaactttggtatagaaagtttaccacttggtggtggtattgatacgtcagttgctcagcaaacaaacctttatcaaatgattgcaaatggtggtgtttatcataagcagtatatgatagaaagtatagaggatagtaatgggaaagtgatttataatcacgaaagtaaacctgtccgtgtcttttcgaaagcaacagctactatcttacagcagctattacatggaccaattaactccggaaagactacaacctttaaaaatcgcttacaaggtttaaatagtggtttagctggggtagattggattggaaaaacgggtactactaactcaacttctgatgtttggttgatgctttctacacctaaagtgactttaggtggatgggcaggacatgataataatgcctctttagcgaaattgacaggttacaataataatgctaattatatggctcacttggttaatgctattaataatgcagatggcaatacttttggtaagtcagaaaggtttagacttgatgatagcgttataaaagctaaagttcttaagtctacaggtttacagccaggtgtagtaacagtaaacggtcgtcgaatcactgttggaggtgaaagcacaacaagttattgggcaaaaaatggacctggaacgatgacctatcgttttgctattgggggaactgatagtgattatcaaaaagcttggtctactttgggtggaaaacgataacaggtttacgatactgatagttttatttgaggagaatagagtgatctgttctccttttattttttccaagataatatgatttaattcttgtatagtcttctttcaaagaattagaaaaacaccagtatgctatgtttaaaaatcatcgtgttatgctaaaactcaagggtgttgatgaacaaattgaaattctagaagcttccttgaagtcaagagaataaaacttgatttattggtgaaaataagttataatgtacgtaactatttgtcgtctgtctaggttgaaatattgtccgacctagatatacagcagttaaatcaacttgataaagtgagatttagctgctctttttgtgcctaattttaagaaaaaaggttattgtaatatatatttaaactttctgaaaattaccacaaacgacatctataagcttgttcttgttaggcgagcaaatgaaataaactcactaagttttatgagataaaaacttagtcactctatctttaaaaaggagctaaaaacttggcaggacatgaagttcagtacggaaaacaccgtacacgtcgtagcttttcaagaattaaggaagttcttgatttaccaaacttaattgaaattcaaactgattcattccaagattttcttgatgctggcttgaaagaagtatttgaggatgtacttccaatttcaaactttacagatactatggatcttgaatttgttggttatgaattaaaagaacctaaatatactttggaagaagctcgtatccatgatgctagctactcagcacctatttttgttactttccgtttagttaataaagaaactggtgaaattaaaactcaagaagttttctttggtgattttccaattatgactgaaatgggtactttcatcatcaatggtggtgaacgtatcattgtttcacaattagtccgttctcctggtgtttactttaatgataaggtagataaaaatggaaaagttggttatgggtcaactgttatccctaaccgtggagcttggttggaacttgagacagacgcaaaagatattgcttatacacgtatcgaccgcacacgtaaaattccatttacaacactagtccgtgcacttggtttctctggagacgatgaaattgttgacatctttggtgacagtgaacttgttcgcaatactattgaaaaagacattcataaaaatccaagtgattctcgtacagatgaagcacttaaagaaatctatgaacgtcttcgtccaggtgaaccaaaaactgcagacagctcacgtagtcttttagttgcacgtttctttgatccacgtcgttatgacttagcggctgttggtcgttataagattaataaaaaactgaatcttaaaacacgcctattgaaccaaacaatcgctgaaaatttagttgatggtgaaacaggagagattcttgttgaagctggaaccgttatgacacgagatgtcattgattcaattgcagagcatatcgatggagacttaaacaagtttgtctacacaccaaatgattatgctgtagttactgaaccagttattcttcaaaaattcaaagttgttgctccaactgatccagaccgtgttgttactattgttggaaactcaaatcctgaagataaagttcgtgccttaactcctgcagatattttagcagagatgtcatacttcttaaaccttgcagagggtatcggtaaggtagatgacattgaccatttaggtaaccgtcgtattcgtgcagttggtgaattacttgcgaaccaattccgtatcggacttgctcgtatggaacgcaatgtccgcgaacgtatgtctgtacaagacaatgaagtcttgacacctcaacaaatcattaacattcgtccagtgactgccgccgttaaagaattctttggttcatcacagctgtcacaattcatggaccaacacaaccctctatcagaattgtcgcacaaacgccgtctctctgccttaggacctggtggtttgacacgtgaccgtgctggatatgaagttcgtgacgtgcactatacccactatgggcgcatgtgtccgattgaaacacctgaaggtccaaacattggtttgattaataacttatcttcatttggacacctcaataaatatggatttattcaaacaccatatcgtaaagtagatcgttctactggtgcggtaacgaacgaaattgtttggttgactgctgatgaagaagatgaatttacagttgcacaagccaactctaagcttaacgaagacggtacatttgcagaagaaatcgttatgggtcgtcatcaaggtaataaccaagagtttccttcaagcattgttgactttgttgacgtgtcacctaagcaagtagttgctgtcgcaacagcatgtattcctttcttggaaaatgatgactctaaccgtgccttgatgggtgccaacatgcaacgtcaggctgtgccattgattgatccaaaagcaccatatgttggtactggtatggagtatcaagcagcccacgattcaggtgcagctgtgattgctaaacatgatggtcgtgttattttttcagatgctgaaaaagttgaagtgcgtcgcgaagatggttctcttgatgtttatcatgttcaaaaattccgccgttcaaactcaggtactgcttataaccaacgtaccttagttaaagttggtgatctcgttgaaaaaggtgattttatcgccgacggaccatctatggaaaatggtgaaatggctcttggacaaaacccagttgttgcttatatgacttgggaaggttataacttcgaggatgccgttatcatgagtgagcgccttgtgaaagaagatgtctatacatctgttcacttggaagaattcgaatctgaaacgcgtgatacaaagcttgggcctgaagaaattactcgtgaaattccaaatgttggtgaagattcactacgtgatctcgatgaaatgggaattatccgcattggtgctgaggtaaaagaaggtgacattcttgttggtaaggtaacacctaagggtgaaaaggacttatctgctgaagaacgtctcttgcatgccatttttggtgataaatcacgtgaagttcgtgatacttcactacgtgtacctcacggtggcgatggagtagttcgtgacgttaaaatctttactcgtgcaaatggtgatgaattgcaatcaggtgttaatatgcttgtccgcgtttatatcgctcaaaaacgtaaaatcaaagtcggtgataagatggccggtcgtcacggaaacaaaggtgtcgtctcacgtattgttcctgttgaagatatgccttacttaccagatggaacgccagttgatatcatgttgaacccacttggggtgccatcacgtatgaatatcggacaagttatggagcttcatttaggtatggctgctcgtaatttaggtattcatattgcaacgccagtctttgatggggcttcttcagaagacctttgggaaactgttcaagaagcaggtatggattcagatgctaagactgttctttatgatggtcgtactggtgaaccattcgataaccgtgtgtcagttggtgtcatgtacatgatcaaacttcaccacatggttgatgataaacttcatgcccgttcagtaggaccatactcacttgttactcaacaaccacttggaggtaaagctcaatttggtggacaacgttttggtgagatggaggtttgggcgcttgaagcttatggtgcttcaaatgttcttcaagaaattttaacatacaaatctgatgatgttacaggacgtcttaaagcttatgaagctatcacaaaaggtaagccaattccaaaaccaggtgttccagaatcattccgtgttcttgtaaaagaattgcaatcacttggtcttgatatgcgtgtccttgatgaagatgacaacgaagttgaactccgtgatcttgatgaaggtgaagatgatgatgtgatgcacgttgatgaccttgaaaaagcacgtgtgaaacaagaagctgaagaaaaacaagctgaacaagtatctgaagtcgttcaagaagattaaatttatctagtttataactagaagcgaatatagaattgatatgcaatgctagtcctaggatttattgaaatcctagctgggctagtatgatgataaatcgaagaaaggtaaaactagtggttgacgtaaatcgttttaaaagtatgcaaatcacattagcatcaccaagtaaggtccgttcatggtcttatggtgaagttaaaaaacctgaaacaatcaactaccgcacattgaaaccagaacgtgaaggactttttgatgaagttatttttggtccaacaaaagattgggaatgtgcgtgtggaaaatacaaacgtattcgttacaaaggaatcatttgtgaccgttgtggcgttgaagtaacccgtgcaaaagttcgtcgcgaacgtatgggacatatcgagttaaaagcaccagtatctcatatctggtatttcaaaggtatcccatcgcgtatggggctcacattggatatgagtcctcgtgcacttgaagaagttatttattttgcggcttatgttgttatcgatccaatggacacaccattagaaccgaagtcactccttactgagcgtgaataccgtgaaaaacttcaagagtacggttacggttcgtttgttgctaaaatgggtgctgaagccattcaagatcttcttaaacgcgttgatttagatgcagaaatcgcagttcttaaagaggagttgaaatcagcgacaggtcaaaaacgtgtgaaagcagttcgtcgtctggatgtgttagatgcctttaaaaaatctggaaataaaccagaatggatggttcttaacattttaccggttatcccaccggatcttcgtccgatggttcaattagatggtggtcgttttgcggcatcagacttgaatgacctttaccgccgtgttattaaccgtaacaatcgtttggcacgtttgttggaattaaatgctcctggcatcatcgttcaaaatgaaaaacgtatgttacaagaagctgttgatgcgcttatcgacaatggtcgtcgtggtcgtccaattaccggaccaggtagtcgtcctttgaaatcattaagccatatgcttaaaggtaaacaaggtcgtttccgccaaaacttgcttggtaaacgtgttgacttctctggacgttccgttattgctgttggtccaacactcaaaatgtaccaatgtggtgtaccacgtgaaatggctattgagctcttcaaaccttttgtaatgcgtgaaatcgttgctcgtgacctcgcagggaacgttaaagcagctaaacgtatggttgaacgtggggacgagcgtatttgggacatcttagaagaagttattaaagagcacccagtacttctaaaccgtgcacctactcttcacagattaggtatccaagcgtttgaacctgtccttattgatggtaaggcgcttcgtcttcacccacttgtatgtgaggcctacaatgctgactttgatggagaccaaatggccatccacgttccattgtctgaagaagcccaagcagaagctcgtcttttgatgcttgctgcagagcacatccttaaccctaaagatggtaagccagtcgtaacaccatctcaggacatggttttaggaaattactacctgactatggaagatgctggtcgtgaaggtgaaggcatgattttcaaagatcatgacgaagcagttatggcatatcaaaatggttatgttcatttacatacacgtgttggtatcgctgttgattcaatgccgaataagccttggacagaagagcaaaaacataaaatcatggttacaacagttggtaagattctcttcaacgatatcatgcctgaagatttaccgtacttaattgaacctaataatgcaaacttgacagaaaaaactccagataaatacttcttagagccaggtcaggatattcaagcagttattgataacttagagattaatattccctttaagaagaaaaatcttggtaatattatcgcagaaacttttaaacgtttccgtacaacagaaacttctgctttccttgaccgtttgaaggaccttggatattatcattcaacacttgctggtttgactgtgggtattgctgatatcccagttattgacaataaagctgagattattgatgcagctcaccacagagttgaagatatcaataaagccttccgtcgaggtttgatgactgaagaagatcgttatgttgctgttacaacaacatggcgtgaagctaaagaagcacttgaaaaacgtcttattgagacacaagatccaaagaaccctatcgttatgatgatggactcaggagctcgtggtaacatctcaaacttctcacaacttgccggtatgcgtggtttgatggctgctcctaacggacgtatcatggaattgccaatcttatcaaacttccgtgaaggtcttagtgttttggaaatgttcttctcaactcacggtgcgcgtaaaggtatgactgatacggcccttaagacagccgactcaggttaccttactcgtcgtttggttgacgttgcccaagatgttattattcgtgaagatgactgtggaacagaccgcggtttgacaatcacagcaattacagatggtaaagaggttactgagacacttgaagagcgtttgataggacgttatactaagaagtcaatcaaacatcctgagacaggtgaaattctcgttggtgcagataccttaattactgaagatatggctgctaaagttgttaaagcgggcgttgaggaagtaactatccgatcagtatttacatgtaacactcgccatggtgtttgtcgtcactgttacggtattaacttggcaacaggtgatgctgttgaggttggtgaagcagttggtactattgcagctcaatctatcggtgaaccagggacacagcttacaatgcgtaccttccataccggtggtgttgcttcaaatactgatattacacaaggtctcccacgtatccaagaaatctttgaagcacgtaaccctaaaggtgaggcagttattactgaagttaagggtgaagtcgttgcaattgaagaagactcttcaacacgtactaagaaagtattcgttaaaggtcagacaggtgagggagaatacgttgttccatttacagcacgtatgaaagttgaagttggtgatgaagtagctcgtggtgcggccttaactgaaggatctatccaaccaaaacgtctccttgaagttcgtgatactttatctgttgaaacgtacctacttgctgaagtacaaaaagtttaccgtagccaaggggtagaaatcggagataaacacgttgaggtaatggttcgtcaaatgctccgtaaagttcgtgtcatggatccaggagatacagatcttcttccaggtacacttatggatatttcagactttacagatgctaacaaagatattgttatttctggtggaatccctgcgacaagccgtcctgtccttatgggtattactaaggcttcccttgaaactaattcattcttatcagctgcatccttccaagaaacaacacgtgtccttacagatgctgctatccgtggtaagaaagatcacttacttggtcttaaagaaaatgttattatcggtaaaatcattccagcgggtactggtatggctcgttaccgtaatattgaaccacttgctgttaatgaagttgagattattgaaggaactcctgttgatgcagaagttacggaagtatcaacacctacaacagaagattaatcaaaaagaacttgagtttaactcaggttctttttttacaagaatttggaatgagcagatattttttattttattcttattttttatataatactctctaaaggaagtgtattatgtatcaagttgtaaaaatgtttggtgattgggaaccatggtggtttattgaaggttgggaggaagatattactgaaattgctgagtatgataccttatcagaagctttgctctattttcaagaggagtgggataggggacaggaaaagtggccttattttcaaagtaagtctagtttgttggcaacgttttggagtataaaagaaaaacgttggtgtgaagaatgtgatgagtacctccaacagtatcattccttaatgttattgaaagaatggcaagaaattcctaaggaagaatctattgagcgatttgaagtatttaataagatagctgagttgccatcggcatgttctttaaatttgtaattaaaagtagtttaaaaaagttagatagtttttatggggatataataggtttgttcagcctctgcttcataatatttatgttactacctctcaagaaatcattgaaaagatctcaccaattggtgagatttttttattttattttcgaatatatggttaaggaggttacgggatggttcaatcattagcaaagcaagtcattcatcaggcagtagaagtaaatgctcaagatatttatatcattcccaaaggtgattgttatgaactctatatgcgtattgatgatgaaaggcggtttattgatgtttttgagtttaataggatggctagtcttattagtcactttaaatttgtggcaggcatgaacgttggagaaaaaagacgaagtcaattaggttcttgtgactatgaactgtcagagggaagactggtttcattacgactatcgagtgtgggagattatcgtggtcaagaatctttagttattcgtattttgtattcaggtcatcaggacttaaaatattggtttgataatataaagcaaatgaaggaagtactgggtataagagggctatatcttttttccggccctgtggggagtggtaaaacaactctcatgtatcaattagcttcagaagtatttaaaaataagcaaattatcacgattgaagatccggtagaaatcaagaatgacaagatgttacaactccaattgaatgaggatattggaatgacttatgatgctttaatcaaactgtctttacggcatcgtccagatattttaattatcggagagattagagatcaagcgacggcccgtgctgttattcgtgcaagtttaacgggagtgatggttttttctactattcatgctaaaagtattcccggagtctatgataggcttatagaattaggggttaactatcaagagttagaaaatagtctaaaattaatagcatatcaacgtttaattggaggaggaagcctaattgactttgagacaggtaattttaaaaaacactcatcagacaagtggaatagacaagtggatatcttggctgaagaaggacatatcagtaagaaacaggcacaagtcgaaaaaattatccctcaagaaacaacggaaagtagtccaactttttaataatctttttgctagtggtttttctttaactgatatggtcaccttcttaaagaggagtaagttattgtctgattgttatacagatagtatgaataaggcattattagagggaaaagatttatcaaaaatgttaggagagttaggtttttctgacactgttatcacacaggttgcattagctgatttgcatggtaacatttcaaggagcctactaaagattgagtcttatttagctaatcttttgttagttagaaaaaaagtaatagaagtagctacttacccattgatattattgtcttttctggtgctaattatgattggccttaggaattatttaatgccccaattaggagaaaataattttgcaactagactgattacaaatgtgccgaatattttcttattacttttagcagttgtacttatttttagtttaatattttatattattcaaaagcgattgtcgcgcattaaagtagcttgttttttaacaacaattcccttagttggatcatatgttaagctttatttaactgcttactatgcccgtgagtggggaaatttattaagtcaaggtattgaattggaccaaattgttaaagtaatgcaaaatcagaaatccaaactttttagggaaataggatatgacatggaagaaggttttctatcaggtaaagcatttcaccaaaaagtattagactatccgtttttcttaactgagcttagtttaatgattgaatatggccaagttaaggcgaaattaggaacagagttagatatatatgctgatgagaagtgggaggatttttttacaaaattagctagagcgacccagttaatccaacccgttatttttatttttgtagctcttatcattgttatgatttatgcagcaatgctgttaccaatgtatcaaaatatggagatattatcatgaaaaatttattgttaaaatgtaaggataagaaggttaaagcatttacacttttagaatgtttggtagcattggttacaatcacaggagctttactagtttatcaaggactgacaaaattgttggctcaacagatagtagtgatgtcttcttccagtcagtctgaatgggtgttattaactcagcaactaaatgcagaatttgaaggcgctcatctggaatatttaagacagaacaaactttatttacgtaagcaagataagattgtaacctttggcaaatctaataaagatgatttccgtaagacaggttatgatggtcgaggttatcaaccaatggtttatgggttagacaattgtcaaatgagtcagaccaaaagtatggtaaaacttgttttttattttaaggacgggttaaaaaggacattttactatgattttaaagaagaaacttaaagctggcatccttttgcaagctattgtattggctgctgtatttacactcgtcttacagttttatctagcaagaatattggcaacagaaagacagtatcatagccaaattgaagcaagtaaagcttatttaacagcgcagttagcttataaaacaatagaaggtgactccatatcaggaaaatgttattttacaggaggatatgcttcatacctccaagaagggaactatttacaagttaaggttacattggataagggaggaaactataaccataagttttatcgtaaaacagacactctccaagtacctctcaagtctaatgataataaagcaagccataaacattaaaaatatacagtgatgaaatattagtaagacaaggttttgcttaaaaacaggatttttgtttgcttctcttttcagatgctgtgttttttgttatgataaattctggaggaaatcatgaattttgaaaaaattgagacagcctatgagctgattttagaaaatatccaaacgattgagaaccaattaaaaactcatatttatgatgccttaattgaacagaactcttattaccttggttcaagttgtgatttagatatggttgtggtgaataaccaaaaattacgtcaacttgacttaagtcaagaagaatggcgtcgcactttccagttcatttttatcaaatctgcgcaaacagagcaattacaagctaatcatcagtttacgccagatagtattggttttatcttgttatttcttttggaagaattaacgagtcaagagacagtggatgtcttggaaattggaagtggaactgggaatttagctcagactctcctcaataacagctcgaaagagttaaattatatgggcattgaagttgatgatcttttgattgatctatcagcaagcattgctgaaattataggttctagtgcccaatttatccaagaggatgctgttagaccacaaattttgaaagaaagcgatgtaatcattagtgatttaccagttggctattatcctaatgatggtattgctaaacgatatgctgtatcaagttctaaagagcacacctatgctcaccatctattgatggagcaatctcttaaatatttgaaaaaagatggaatcgctatatttttagcacccgaaaaccttttaacaagtccacaaagtgatttgctgaaggagtggttaaaaggatatgcagatgtcattgccgttttaactctaccagaaactatttttggaagtcgtcaaaatgcgaaatctatatttgttctcaagaagcaagcagaacaaaaaccagaaacctttgtatatccgctgacagatttgcaaaatcgtgagaatatggcaaacttcattgaaaattttcaaaaatggagcagagaaaatagtcattactcaaaaaatatgataaaatagagattgtgaaaacgctttagagaggtaaattatgtcaaaaacaatagcaattaatgctggaagttcaagtttgaaatggcaattatatgaaatgccagaggagaaagtagttgccaaagggattatcgaacgtattggtttgaaagattctatttcgactgtaaaatttgacgataaaaaagatgaacaaattttagatatcgtagatcatacccaagctgttaaaattcttttagaagatctaacaaaacatggtattatcaaagactttaatgaaattacaggtgttggtcatcgtgtcgttgctggtggtgaatattttaaagagtctgctttagtagatgataaagttgtagaacaggttgaagaattatcagctttagctccactccacaacccagcagctgcagcagggattcgtgcgtttagagaaatcttaccagatatcacgagtgtatgtgtatttgatacagccttccatacaacaatgcaacctcatacctacttatatccaatcccacaaaagtactatactgattataaagtacgtaaatacggtgcacacgggacaagccaccaatacgttgcacaagaagcagctaagcaattaggacgtcctttagaagaattaaaattaatcacagcacatgtgggtaatggtgtttctattacagcaaattatcatggacagtctattgatacatcaatgggattcacaccacttgcaggaccaatgatgggaacacgttcaggagacattgatcctgcgattatcccttatcttgtagctaatgatccagaattggaagatgcagcagctgttgttaatatgcttaacaaacaatcaggattgcttggagtatcaggaacttcaagtgatatgcgagatattgaagcaggtcttcaaagtaaagatccaaatgcagtgttagcctataatgtctttattgaccgtattaagaaatttattggacaatacttggcagtattaaatggcgcggatgctattatttttactgcaggtatgggagaaaatgcgccattaatgcgtcaagatgttatcgcaggattatcatggtttggcattgaacttgatccagaaaaaaatgtttttggttattttggagatatcacaaaaccagattcaaaagtgaaggttttagttattcctactgatgaagaattaatgattgcgcgtgacgttgagcgccttaaagctaaataagttatcaaaaaattgataagaccagaaaagttgatagtttaactatcaacttttttgtcttttgaacagatatgtaaaatgtacttgacaaaaaatgtatagttaactatactatgaatgtaaagctaactatacaaaaaaggtgtaagatatgaaaaattctctacaaaagttacgaaaatctaggaaattaagtcaagcagaacttgcagttgcacttggagttactaggcaaactattatttctctagaaaaagagaaatacacggcatctttggagctagcatttaagatagcgcgttattttgataaacaaattgaggaagtttttatttatacagaaagtgaaggaggatagaattttaatggaaaaatacagtccacaaaagacaaaaggttaaaagttaatctgtaatatgtcaaggatgtggactattgatttttgtccaccaatcgtttaccagcaatatgtttttatcattactattagtattagcattgcgatgtctatttttgctatttatcgctatgcttcattgaagaaaacgatataatagctgatgattaaattgaagttttagaaagtagtattctatgttaataaaaggattattgtcacccaatagtaaagtatctccgaaggattacaaagtatatatgagagttttgtcttttgtttttagtgtatgtagtttgattatgatagtatcatcatttctacatacctttgaatctaattttactaaaggtttttcctttggttcaggtattgccttatttgcaggaagtttttattttttggtgataacatttagtgaaaagcgatttcaacattactataccaaagtttttgatgagcgtaatcaatttattgctaatatgtcttgtcgacttcttttccttttatctgtccttgttttagtggtattgtgtctgattaatgtctggtttggtataactttttcctatgcaaagttcttgctattgatactctcttttattttatatggttatttattaatttactttattttacagaagttattgtgagataagtctataagatttgaaaatatgttatgatagaaaaaagttaataatttattttggaggtttttgtgtcatttattattagaaaaggcaaaattttagctttgctaatagcatttttagttattaatcaacttgttcctatattggctgtgtggctcctaaagaatcactatcaaacgccttttactagtatattgttgattggcttagaattacttattattgctcttttcctttattatgccaaggttaaacaaataatcagatggaaagcattattgacaaggaaagcattagttactattctcttaggttggttatcattgagggttccacaaattattggttacctcattatgactatgcaaggggttaaagatacagcaaatcaaacagtaattatggaattaacaaagcaacttccactagctttgatgttaatttttgccataattggtgcccctattatggaagaaattatatttcgctatattatccctaaagaactttttgcgaaacatcaaaaatggggttttgtcatcggtactttagcttttgctcttattcattccccttctgatataggtagttttattatttatgctgggatgggtgctattttatcttttgtttattataaaactgagcacttagaatatagtataatgattcattttattaacaatgctcttgcttatagcgtgttaatcagtacaatgatgaataactaaaaaaactttgagcaatttgctcaaagtttttttgctttctcaatagtagcatcaatggcagaaataacactatgcgtcagaccatttttttctaagtctaaaaggccagcaatagtagttccgcctgggctacaaatgttgtcgattaagtcagaggtgctattttgtccttgtaataggttttgactagaagctaagacagtctgtcctacaatagagagtgcttgttcttttggaaatccatattttacacctgctttagctaaggcttctataaatagatagatataggcagggctagaacctgctagagcagtgaaggtatcaaaattggtttctgctatatcaaagctacttccaaaactatccgtaatttctttggctaattgtcgtaactcatctgatacatgattgttgtaacaaatagctgtgcaactttgaagtatttgtgcgttaatatttggcataatacgaatcaatggtaaatcagaacgagttaattggcttaaacgcgctaaggagattcctgctgccattgagatgattggttttgtgatatcaagtggaagaagaaccttttcaaatagttgaggtttaatacctaacatgataatatcagcttgattgattaatgactgatgagattcggcgtaagtaacatcaagtctttctgcaatttcttttgaacgctctaagcaagatccggatatgataatgtcatgttgggtttgtttgaggccttgaataattgcactggccatttttccgacgccgataattccaattttcataatgttgatatggggatgaaaggagatactaaaatgtgtctaccttatgaaactcccatcctttctatcttaataacctttaataatatccaccgtcgagcggtctaatttgttaacgatggcctgaaggtaagcttgtgcttgtagaaaatcatccatagcgtagagtgtttgatgagaatgaatgtagcgtgcacagacaccgatagttgtagaaggaataccactattttttaggtgagcagccccagcatcggtaccaccatttgcagcataatattggtattttatacctgcttcttcagctgttgtaagtaagaaatctctcatatctttaagcatgatatgtccgggatcataaaaacggattaaggttccctctcctattttgccttgttccccataaatatctccagctggggaacaatcgacagctaagaagatatctgggttgaatttagttgttgaaacatgtgcgccacgaagtccgacttcttcttgaacatttgccccagcaataagtgtgttgctaagactttgatcttttaagctttttagcaattcggtcaccataagcacaccatagcgattatcccaagcttttgacataatatgtttttgatttgcagttaaaatggtttcagatttaggaacaatgatatcgccaggagcaatgccaaagctttcagcttcatttttatctgtgaatcctccatcaaaaacaatgtcactaattttgggtaatgttgttccaccgctttgtccacgaagaaagtgaggaggaactgagcctgatataacaggaatagcatcaccagaacgtgtgtagagggtaaagcgttgtgagctgactactaggggattccatcctccaacctcaagtacacgaaatgttccatctggctgaatatgactaaccataaagccgacttcatccatatgggcagcaaccatgactttaggagcattagtctcatgagtatttttaactccaaaaattccaccaagtccgtctgtctcaacttgatcaactaaaggagttatttcttgacgaaggaagttgcggatattgtgttcatagccagcaatcccatcaagctcagttacggttttaattttgttaaataaatctgacataattacctcaattctacaaatactattttagcaccttttaattaaaaataaagaacagaacaggtttcagtcaatataaagactttcaaaaagaatatcaagtactatcggaagactgttatgactgacaaagcctattatagtgaaaactgggttgaatacaacggagataatgtttatcggcttaagctaataaaaaggtagatagaaaagataatacggctaaaaaagtgataaccatagcaattaaagtcaaatttttggggtgattcttattgattaaaaatgaagttgtgcaaagcagtattagcgtcacaatagcaaaaagttctccattttgaagacgaaataaaaaccagtgatcacctaggaagagtagacctagcaaacaatttaaagcaggtactaataatttttctttcatgttttttctttctgtttgaatgattaaccataatggtatcttaagacaatgtcatcctattataccacaaggaataagttgttttttttcataactgttatgtggatttcttccatcaattcctgtgtctaattccggggggtatggtataataacagttatgaaaaataaaaaaatcttatttgggactggccttgctggtgtgggtttactggcagctgctggttataccctaactaaaaaagtaacagattataaacgtcagcaaatcactcagaccttaagagaattttttagtcagatgggtgatattcaggtattttattttaatgaatttgaatctgatattaaaatgaccagtggtggtcttgtcttggaagatggcagaattttcgaattcatttatcgtcaaggtgttcttgattatgtggaggtgagcaaatgattttaccagaatcttatgaagaaatagcagcctatattgatagcactaagaaagttgttttcttttttacagcagattggtgtccagattgtcaatttatatatccagtaatgccatcaattgaaaaagatttctcagattttgtctttgtacgtgttaatcgtgatgactatatagaattagctcagcagtggaatatttttgggattccgagtttcgttgttgtggaaaatggtcaggaactgggtcgtttggttaataagaatcgcaaaacaaaggctgaaattactaaatttctcgctgaaattaactataaataagacagaaaatagcaaaatttaaaggagaataaatgatttttacttataatagagagcatgttggtgataccttaatggttattgttaaggatagtcaaggagctaagctagatgttgatcgtcgcggacaagtagcacgcgtctatctgcaagatagtaaagaaacagttgcttggaatatctttgaagtgtcaagtttaattgttattgagggagcaggtcaaataactttatctgatcaagatattaaaatccttaatgcagaactactgaaagaaggattcgaagactctcttgttaataatattgaacctacatttgttgtggcgcaaattaaagaaataattgatcatccagatagtgaccatttacatatctgtcaagcagaaatcaacgatgggaagacggtccaaatcgtttgtggggcacctaatgcttcagtaggtcttaaaacagttgcagctcttccaggagctatgatgccaaatggtagccttattttcccaggaaaacttcgtggagaagatagctttggaatgttatgtagtgctcgcgagttagctcttccaaatgctcctcaagtcagaggtatcattgaattatctgatcaggtaattgttggagagtctttcgacgccaataaacattggaaaaattagtaaaaatcaacttagcttcagctaagttgatttttagttgtaaacttaagaagttacaatgactttttaagtgtgatgtgttgcaaaaaagcaatatctttataaggagctttgtcagcaacacttagctcgatagcaagcattttgtttagccaaccagtttcagttttaaaatggtttggttgtaatgaatagaaggtacgaataccctgataacgttcaactaataaatttgtattttgttttagttcttctaaggtataaatatttccctggtcaaaactggcacttttaaagtttgcttctcctgttaagagttccatcgcagtggaggtatcattgctaaaaataactgattgtaatattttaccggttatattatgtttgatgagagatagttctccattgggttttagaagtcgagaaaattcgtcaaaataagcaggatgattatgtttgtctatatattcaagaacattatgacaaataatagtatcaaagctttgatcaggcaaatctcttaatgcttcgtaggaacctaggattttataaatattgtcactttgattatcgtaaagcagtttaggattgggttcaatagcagttacattgttttcttttgctagatgttgttcggtgagacaaaaaccagctccaaaatctaaaacgttctgatttttgatatggcttaattgagcaaaagttatttcatattgtatttttccccaaggtttagccagcatttctttataactagttacatttgtcatcttaattctcccagaacaatttcatatattttagcatttttcttccttattttcgaataataatagtgaggaggtaatcaatgtataataaagttattatgattgggcgtctaacagcaaagcctgagatggtaaaaacaccaactgacaagtcagtgacgcgtgcaactgttgctgttaatagacgctttaaaggaagtaatggtgagcgtgaagcagattttattaatgtggttatgtggggtcgtctagcggaaacccttgcgagctatgggacaaagggctctttaatttcaatagatggtgaattgcgtacgcgcaagtacgaaaaggatggtcaaacgcactatatcactgaagtattagcatcatcatttcagttgctagaaagccgtgcccaacgtgctatgcgtgaaaataacgtttctggtgatttgtcagatttagtattggaagaagaggagctccccttttaaataaaatcactctcaaaatatcatttctaaatatactggttgcttttcacagaaagcaacctttttttattgaaaatagaaaggcaaacgattacaataaaggggatagaaagcaggtttaagatggaaaaagtcattatttttgatatggacggcgttattgttgattccgagtacacgtttttagataataagacagaaatgttacgtgaggagggtattgatacggacgtctcgtatcaataccagtacatggggactacttttgaattcatgtggcaagctatgaaagaggagtttggcttaccgaaaacagtaaaagagtatattgctgagatgaacagacgtcgacaagcgattgtggcgcgtgatggtgttaggcccatcaaaggagctcagcgactgattcattggttacaccaacatggctatcgcttagcagttgcgtcctcatctccaatggtagatattaagcgtaatctaaaagagttgggtgtgacagaatgctttgaatacatggttacaggagaagatgtatcgtcttctaaaccagcaccagatgtttttcttagagctgcagagcttttagatgtagaccctaaagtttgtatagttatagaagatacaagaaatgggagtttagctgctaaggcagcaggaatgtattgctttggctttgctaatcctgattatccaccgcaagatttatcaatggcagacaaggttatttcagattatcaagatatctatatttatcttccggagtaaaatggtatcttgaggaggataagcatatgttgatggtgttgttattccaaaggctaggaattattatgattttagcctttttattggtaaataatagttattttagacagttaattgaagagcggtctaaacgtgaaacggtagtccttgtcatcattttcggcttgtttgttattatatctaatataacaggaattgaaataaaaggggatcgaagtttggtcgagcgcccttttctaacaacgatttctcattctgactcacttgctaatacaaggactttagttattacaacggcaagtttggttggtggacctctggttggatcaattgttggttttattggaggagttcatcgcttttttcaaggaagcttttcaggttctttctatattgtcagttcagttctagtcggcattgttagcggaaagattggtgataagcttaaggaaaaccatctctacccttcaacaagccaagttattttaattagtattattgccgaaagtatccagatgctatttgttggcatttttacaggatgggaacttgtcaaaatgattgtcattccaatgatgattttaaatagtttaggttccacacttttccttgcgattttgaaaacttatttgtcaaatgaaagtcagttacgcgcagttcaaacgagagatgttcttgaattgactcgacagactctgccctaccttagacaaggtttgacaccgcaatctgctaggagcgtttgcgaaattataaagaggcatactaactttgatgctgtgggattaacagatcggtcaaacgtattagctcatattggtgttggccatgatcaccatattgcaggacaaccggtcaaaacagacttatctaaaagtgttatttttgatggcgaaccaagaattgcgcaagataaagcggcgatttcttgtccagatcacaactgtcagttaaattctgctattgtagttcctctaaaaataaatgataaaactgtgggtgccttaaaaatgtactttgcaggagataagacaatgtctgaggtggaggaaaacctagtccttggtttagcgcaaatattttcaggacaactggcaatggggataacagaggaacaaaataagttagccagtatggcagagataaaggctttacaagcacaaatcaaccctcatttcttctttaatgccattaacacaattagtgcattaatccgtattgattctgataaagcacgttatgcactgatgcagttaagtactttttttagaacaagtttgcagggtggtcaggatcgtgaggtaacgcttgagcaagaaaaatcacatgtggatgcttatatgaatgttgaaaaattacgtttccctgataaatatcagttatcttatgatattagtgcaccagaaaaaatgaagttaccaccttttggtttacaggtactggtagagaatgcagttcgacatgctttcaaagaacgtaagacggacaaccatatattggttcaaataaagccagatggtcattattattgtgtttctgttagtgacaatggacaaggaatctcagatactatcattgataaattaggtcaagaaacagttgcagagagtaagggtacaggtactgctctagttaatctaaataacaggctgaatttattatatggtagtgtaagttgccttcatttttcgagcgacaagaatggtacaaaagtttggtatcgaatacctaatagaataagggaggatgagcatgaaaattttaattcttgatgatgaaatgtttgccagacaagaattatcgtttttagttgaacatagccaggaggttgacaaccctgagatttttcaggctgaggatatcagtgaagccgaaaaaatcttatttagacagcaaattgatttaatttttttagatatttcgcttagtgaagaaaatggctttactttggctaatcagttgagccaacttgcacatcccccacttgttgtttttgcgacagcttatgataactacgctgtgaaagcttttgaaagtaacgctgttgattatatcatgaaaccgtttgaacaacagcgcgttgatatggctctatcaaaagtgaagaaattgagccaactcaccactgcttcagatgtagagcaagcaatacctaaaaaagccagtgttgaattgttaaccttgacattatcagatcgcagtgttgttgttaaaatgcaagatattgttgcagctagtgttgaagatggcgaattaactgttagtacagttcagaaaacttacactattcggaagacactcaattggtttaagtcacgcgctgtagcaccatattttctccagattcatcgaaacacagtgattaatctagagatgattgaggaaattcaaccttggtttaatcatactttgttactaattatgtctaatggagagaaatttccagtaggtcgatcgtatttaaaagacctaaatgagcatttaaccatgtaaaagtgcttttgcgaacttccctttgttgtttagaagcttgaatttgcaattcggcttctttttttggtaactgagactaaaaatgaaaacgttttatttgttttgaagtacaatatagctatcaataaaacaagttaaaacattgtaataaaaggaaggggtagtgactatgaaacacaccagtaaagaaaccaaaacaaaagaagctccaatgtttattcaaatgtcaatatatgcagctattctattagtttcacaaatgatttcaatgttattaccgaaatcactaccaatcccaacgacggttattggtttggtgctaatgtatgtattgctaactgctaaaattatcaaggtagagtgggttgactcttttggggctttgatgataagcatgattggttttatgtttgtcccctcaggaatatcagtagcagcgaatcttgatatcctaaaagctgaaggcttgcaactagttgctgttattacaatctcaactgttgttatgttggtagtggtagcatatgttgcacgattaatacttgctatcagagaactcagtgtcacagatttatttaaaaagatattacctaaccactatagtaagaaagtagaggaaaaataatatggaactcttaaaaacacccatctttggtatttgcttttctttaatactctatacgataggagaacatttatttaagaagagtaaaggtttcttccttttgcagcctcttttctttgcaatggttagtggtattgtcattctttggcttatgtcaaaaggtttaggaaccgatgttaagacattttatacacaagcttataaaccaggtggtgatttaatattttggtttttaaatccagcgacaattgcttttgcagttcctctctataagaaaaatgacgttgttaaaaaatattgggtagaaattctcagcagtttagtaatcggtatgattgtttcccttatacttatcgtcgctatttctaaaatggttgggcttagtcaagtcggaattgcttcaatgttgccacaagcagcaacaacagcaattgctcttccaataacagcagcaattggagggaacacagctgtgacagcaatggcgtgtatcttaaatgcagttattatttatgcattaggtaaaaaattagtgtcatttttccatttgaatgatagtaagattggtgcaggattaggtctagggacctctggtcatacagtcggagcagcctttgcattggaattgggagaactgcaaggtgcgatggcagctatagctgtggtggttatcggtttggtagttgatttggttattcctatctttagtcatttgattggtttgctataactaatagcgtggttaaggctgaatttattcagcctttttatgatgtctattaaaatacattggattaacatggtttatgagctagtgtctagaattgtgttttacctaactttaagttattaatgataaaataacaaattttctaattaaccagttaagtaattgttctcctacttttttcttgttataatgaaaaaagttgtcaaaaatattatttatcaattaaaaaaggaggtttaatagtgactaaatatttgaagtacatctcttttgttgctttgtttctggcgagtatctttttagtagcttgtcaaaatcaaaattcacaaaccaaggagcgaacgcgaaaacaacgacccaaagatgaattggttgtttctatgggggcaaagcttcctcatgaattcgatccaaaggaccgttatggaatccataatgaaggtaatattactcatagcaccctattgaaacgttctcctgaactagatataaaaggagagcttgctaaaaaatataaaatctctaaggatggcttaacgtggtcgttcgacttaaatgatgattttaaattctccaatggtgagcctgttactgctgacgatgttaagtttacttatgatatgttgaaagcagatggaaaagcttgggatttgacctttattaagaatgttgaagtagttgggaaaaaccaggtaaatattcatttgactgaggcgcattcgacatttacagcacagttgacagaaatcccaatcgtccctaaaaaacattacaatgataagtataagagcaatcctatcggttcaggaccttacatggtgaaagaatataaggctggagaacaagcaatcttcgttcgaaatccctattggcacggtaaaaagccttattttaaaaagtggacttgggtattacttgatgaaaatacagcactagctgctttagaatctggtgatgttgacatgatttacgcaacgccagagcttgctagcaagaaagtcaaaggaacacgtcttctagatattgcttcaaacgacgttcgcggactgtcattgccttatgtgaagaaaggtgttgtgaaaaattcaccagacggttatccagtaggaaatgatgtcactagtgatccagcaatcagaaaagccttgactattggtttaaatagacaaaaagttctggatactgttttaaatggttatggtaaaccagcttattcaattattgatagaacaccattctggaatccaaaaacagcaattaaagataataaagtagctaaagctaagcaacttttgacaaaagctggatggaaagaacaagcagacggtagccgtaaaaaaggaaatcttaaatcggaatttgacctttactaccctactaatgatcaattacgagcaaacttagccgttgaagtagcggagcaagctaaagccttaggtattactattaaactcaaggctagtaactgggatgaaatggcaactaagtcacatgattcagccttactttatgcgggaggacgtcatcatgcgcagcaattttatgaatcacattacccaagtttagctggtaaaggttggaccaatattactttttataacaatcctactgtgactaagtaccttgacaaagcaatgacatctcctgaccttgataaagctaacaaatattggaagttagctcagtgggatggcaaaacaggtgcttccactcttggagatttaccaaatgtatggttggtgagtcttaaccatacttatattggtgataaacgtatcaatgtaggtaaacaaggtgtccatagtcatggtcatgattggtcattattgactaacattgctgaatggacttgggatgaatctgctaagtaactaatttagttaatgtaggctactttaagtttggagtcagagaaaacaatgtacaccttatggtgtgaatggtttcctcgactccttttttaacaattaaggagatttatctgtgaaacatattaccactgtagttatctggaagatacttaggtgtttgtcactcgtttttggagtatcaattttgacctttattttactaaaacaatcaccggttgatccagtcatggcaagtgtcaattatgacacgtcactaacccctgttcagtacaaagcgattgctcaccactatggtttggataagccagctccggtccagtattttatttggttaaaaaattttatacagggacatttagggacttcactagtttatcggcaacctgttattgatattattagatcacgggcaggtgcctctttcatacttatgggactctcctgggtcttatcgggtcttattggatttatcttaggaactttatcagctttccatcaagggaaattgcttgatcgaattgtaaggtggttttcttaccttcagatatcagtaccaactttttggattgggctcatttttttattaatcttttctgtccagctggggtggttcccgattggtatttcttccccgataggtactttgagtcaagatattacgttagctgatcgtattaagcaccttattttacctgttttcacgctaagtattctaggcattgccaatgtaactcttcatactagaactaaaatgatgtcggtactttctagtgaatatgtcttatttgccagagcgcgtggggaaacggaatggcaaatttttaaaaatcattgtcttagaaatgctatcgtaccagctattacactgcatttttcctattttggagaattgtttggaggatccgttcttgctgagcaagttttctcatatccaggactagggtctaccctaactgaagcaggacttaaaagtgatacaccgctacttctagctattgtgatgatagggacattatttgtttttgcgggcaatcttattgcggatattttaaacagcataatcaatccacagttaaggagaaaagtatgatattgagacgtcgaactattgttttatggcaactgggtatcgccatttctctcattcttagtattctagccttaaatctttatttccatagtactcccttgcaaaccaatgcagctttacggaaccttgctccttcattaaaccatctttttgggacagatggtttaggtagggatatgtttgtcagaacgattaaaggactttatttctctctacaagtctgcttattaggtgcccttatgggggtcattctggcgacagtttttggagtgcttgcaggtttaggaaatagcattattgataaaataatagcatggttagttgatttgtttattggtatgcctcatttgatttttatgattctcatttcttttgttgttgggaaaggtgctcaaggggtcatcattgcaacggctgttacacattggccttctttagcaaggcttatccgcaatgaagtctatcatctaaagaataaagaatttgtccaactttctaaaagtatgggaaaaacgccttattatattgtgaggcatcatatcctgcctttgattgcttctcaaattttcattggttttatcctcttatttccacatgtcatcctacatgaagcatcaatgactttcttaggatttgggctctctgccgaacaaccttcggttggtatcattctgtcagaggcagctaagcatatctctcttggaaattggtggttggttatctttccaggactttatcttattttggttgtcaatgcatttgatactatcggagaatctttaaagaaactcttttaccctcaaactgatcatttttaggaggtagagatatgacagaaacattattaagcattaaagacctctccatcaccttcactcaatacggaagatttttaaaaccatttcaatcaacaccgatacaagcgctgaatttagaaattaaaaaaggtgagttattagctattataggtgctagtggttcagggaagagtttattagcacatgctattatggatattcttcctaaaaatgcatctgtaacaggagatatgatttatcgtggtcaatcactaaattctaaacgcattaaacagttgcgaggaaaagatattacgttgattccacaatcagttaattatttagatccatctacgaaagtcaaacatcaggtgcgcttaggtatctcagaaaattcaaaggctactcaagaaggattgtttcaacagtttggtttaaaagaaagtgatggtgacttgtatcctttccaactttctggcggaatgctccgacgtgttttgtttacaacgtgtattagtgataaggtttctttgattattgcggatgagcccacccctggattacatccagatgctctgcaaatggttttagaccaactacgctcctttgcagataaaggaataagcgttatatttatcactcatgatattgtagcagctagtcaaattgctgatcgtattactatttttaaagagggaaaagctattgaaacagctccagctagtttctttagcggaaatggagagcagttacaaacagaatttgctagaagtttatggcgctctctcccacagcaagaatttttgaaaggagttactcatgaccttagaggctaaaaagcttggcttttatcataaaaaagatcaatggctttttaaggagattaatttagaggtagcacctggtcaagttttaggtatatttggacaaagtggttgtggaaaaactagtttatccagggtgcttgcaggttttttacatcctaaatctggtgaagtattagttgatggcagtaatttgcctagcaaagcatttagacctgtacaacttattcaacaacatcctgaaaaaacgatgaatcctttatggcctatgaaaaaaagtttggaagaagcctattacccaagtcgagatttactagatgcttttggaattcaagaaaaatggctaaatcgtcgacctagtgaactctcgggaggagaattacaacgcttttcgattgtgcgttcattacatccagagactaaataccttattgcagatgaaatgactactatgttggatagcattacacaagctagtgtatggaaaagcctgttggagattgtaaaggatagaaatttaggtctcatcgttattagtcatgatttcgctatgttagagaaactttgtaaccaatgctatatgattgaagagaatcgtatcgtatctttcaatggagattaaaaaactcacctactatatcaattagtaggtgttttttattaagagagtattgagggtgactgatctactcatgactctaacattttggtaacgttggtgagaaattctaatgttttgggtattattgactaatttattttataatttatagattttttaaaaagataagctaaggatttgcatagggatatgtaatcgtttacaattatgttgtaagctagtcttatttaagtttctgccttggagtcacagactctccgttaaatagataaggataaacagatggaacaatttaaacatgatgccaaagccttgttagaggcaattgggggtaaagaaaatattagtgcagtgacacattgtgctacacgcatgcgatttgttttgaatgacagtagtaaagctaaggtaaaggtaattgaggagttaccatcagtcaagggtacctttaccaatgctgggcaatttcaagtcattattggtaatgatgtccctattttttataatgcttttgtagccgtttctggtattgagggtgtgtctaaagaggcggcaaaatcggctgcccaaaaaaatcaaaaccctttacagcgtgtgttgacaatgctggctgaaatatttacaccgattattccagccattattgttggtggtctgatccttggttttcgtaatattttagatgccgttccatttgaatttttaggtcaaaaagttgttgatggtgtcaggcaagtagactcttctgggcatccaatttggaatactctagtagatgtttcaacgttttggagcggagtagactcttttttatggttaccaggtgaagctatatttcatttcttaccagttggtattgtatggtctgtgactcgtaagatggggactactcaaatcctcggtattgttctaggtatctgtctagtgtcgccacaattacttaatgcttattctgtagctagtacttcagcagcagacattgctaaaaattggtcttggaattttggttactttacagtacaaaaaattggttatcaagctcaagttattccagctctgttagctggtttgagcctgtcttacttagaaatcttctggagaaaacatattcctgaagttgtttcaatgatttttgtgccatttctatccttagttccagctattatcttggctcatactgtccttggacctattggttggacactaggtaaatggatttctgctatcgttcttattggattgactggtcctgtaaaatggctctttggtgctatttttggtgccctgtatgccccatttgttattactggtttgcaccacatgacaaatgctatcgatactcaactcatagcagatacaaaaacacatacaactggcctttggccgatgattgctctttcaaatattgctcagggttcagctgtactagcttattattttatgcatcgtcatgatgaaaaagaggctcaaatatcacttccagctgctatctcagcctaccttggtgttacagagccggcgctttttggtgtaaacgttaaatacatttatccatttgttgctggtatgattggttcaagtgtggcaggtcttttggcgacaacttttaatgtccaagctaactctattggtgtaggcggtcttccaggcttcctgtcaattaacgttaaatatatgggatatttctttatctgtatggcagtggctatctttattcctttatttttgacactattctttaaaaaatcaggtattttgacaaaaactgaagaggaaaaattagtacctgatgctgtcattgcttcaacaacagaaacaaaatcagcaaaagaaaaagctgtcgtatcaggtacaaagcttagtgtagtaagccctttatcaggtttagctaaaccactggatcaagctagtgatcctgtcttttcacaaggaattatggggaagggagtggttatcgatccaagtgatggagaactagtttcaccggtcgatgcgacagtttcagttcttttccctacgaaacatgctattggattgttaacatcagagggggttgagtttcttattcatattggtatggatactgttaatttagaaggaaaagggtttacctctcatgttgctcaaggtgacactgtaaaagtaggagataaactcattactttcgatattccaatgataaaagaagaaggatacattgtggaaactcctattctgattactaatcaacaagaattccgaccagaagaattgatagatttacccaaacagataaaacgtggacaagcattaatggttgccaagaaaatttaaaagtaattaggtattctttttaaaaaagagcactcttataaaatgagaggtaatttgaggaattgtttgaggggcttaatacattagctccttgaattattttgaacataagaaaaaactcataggaacaaatatcactgtaaaaatgttatatttttgatgatagttgatgttatagttagactgctaaatacagcagcattttgggaaaggagtagaatatgacgattgataaacgtaaagttgtctatcaaatttatccaaaatcatacaaagacacaactggtaatggggttggtgatcttcgtggtattatcgaaaaattaccctatttagcagaacttggtattgatatggtttggctcaacccattttatccaagtccacaacgagataatggatatgatatctctgattatacagctattaaccctgattttggaacgatggacgattttgaagaaatgattgaggtgggacgtcaataccgtatagattttatgcttgatatggtgcttaatcattgttcaatagaacatgagtggtttaaaaaagcacttgcaggagatcgctactatcaagatttctttatcttacgtgataatccaacagattgggtatctaaatttggtggaaatgcttgggcaccatttggtgatacagggaagtattatcttcatctttttgatatcactcaagctgaccttaattggcgcaatgccgatgttcgcaaggaactttttaaagttgtcaatttttggcgtgataaaggggttaaaggttttcgatttgatgtgattaatttaattgggaaagatgagatacttgagaactgcccaattaatgatggaaaaccagcttatactgatcgtccaataacacatgattatctcaagatgttgaataatgctagttttggacaagatgattccttcatgacagttggtgaaatgtcttcaacgacaattgcaaattgcattctttacactgcaccagaacgtgaagagttatccatggcttttaattttcaccacctcaaagtagattataaagatgggcaaaagtggaccattatggcttttgattttcctgcattacgtgaccttttccatagttggggcgaagggatgagcgaaggaaatggttggaatgctttattctataataatcatgaccaaccgcgagcattaaatcgttttgtagacgtgaaacgttttcgaaatgaaggagcaaccatgttagcagcatctatccacttatcgcgtggtactccttatatatatatgggtgaagaaatcggaatgcttgatcccgattacagttctatggatgattatgtggatattgagagtttgaatgcctaccaaataatgcttgatgaaggcaagtcacaagaagaggcatttagcattattcgagcgaaatctcgagacaattctcgagtaccaatgcaatgggatgatagtacgaatgcaggtttttctgaaggcgctccatggttgaaagtaggaaaatcatataaagaaatcaatgtcgcaaaggagaaaacagggctgatatttactttctatcaagagttgataaggctacgtaaacaactgccaataatagctgacgggaattataaagcagctttcaaagataatgaaaaagtatatgcttttgaacgccatcttgataaggaaaaacttcttgttttaaataatttctttgctgagaaagttaagataaaattaccggagaattatctccaaggacaagttcttctatcaaattataaggatgttactcttgatgaaacggttactttgcaaccttatcaaactttagctatcttagtgtcataacattttaaaaacctttacttattcaattaagtaaaggtttttaaagtgctgcttgtggaaaggaatcttgctctagattttgcaatttctttcttttttctttactctataacaatagcccaaattcattcaattgatagtagtgccagattgggctcaaatgacctagaaaaatgtaaacggttactataaaataaaaatagaaaggaaaacaaatggttgataataagactgttgtgataatgttggtatttttagctcggaaaaatctttccttgtatgagttaacagtgcaaacaaagttttcaataaaagttatcatagagcaaattaactatctcaatagttttttagcaaaaaatcacctaccagctattgctcactctgctggacgttatcagttattaggagatgaaaaagagcatgataaaattgtctccttattagaagctgagcaattttacctaacccaggaagaaagggtatgtctgatttacctttatagcttttgccgaagagagtttgtctccaatgtgcattatcaagattttttgaaagtaagtaagaatactactttatcagatatcaagatgctacgttctaaattagcaaaaagaggtatctcactcacttatacaagagcaaagggatatagtctagtaggagatgagatggataagcatcaagttgcttttcagatgataactcaactactagaatctcccattggtttttggtctttgaattatatcttgtcttcttggaaattcgctctctcatatgagaagttagaaaagacggtagaatatttctatgaatcttttcaactttctccaatacaagataggcttgagaaatctttatattttatcattttaatactgtgtcgttatcaaaggtcagtagatcgtgttttgcagggttctcctattgtttctgaacaattaaaagagttaacgactattattgtgactaatttaagtcaggatatttccttatctaaaccattagatcagaaagaaaaagattatattaccttgatcttatctggctgttttgaaggtgagggaactaaagatgatgatttctttgaagcattggcaaaagcaatcgttgatgagatggaaactgtttcacttcttaatttttccaataaagaagagttattacaaggtctgaagcgtcatattattccagcttatttccgattgaaatatggtttaactggcgatagtggttatacacaaaatattaaagagcattacagtgatttatttctattggttaaaaaggcactacgtcctttggaagagcaagtaggattaatacccgatagtgaaatttcttacttcgtgattcactttggaggctatcttagacaatcaggtggtacacaatcaatgtcttataaagctttgatactctgtccaaacggcgttagttcatccttagtgattaaggaaaaattgcgtggattatttcctcaaattcattttcatcgtgtctctaaaattgagcagctgaaactgattgacaatcaaacttacgatatggtcttttctactatatttgtagaaacaaaaaaacctaattatctagtttcgctgatgatgacagcagagcaagtacaacagctcaaagaactggttatttcagattttcccaaggcttgccttgacgatttccaacttgatcaattaatagcaactataaaaaaatacgctcatgttcattgtgaagaggaattaaaattggctttgaggacaatggtaaaacaagatatacttagaaaggatgtgaggcccttgttgcaccaacttataacagaggaaacttatcagacaagttctgaacaaatgaattggaaagaggcaattcgtttagcggcaaaacccttgttagcttctggaaaaattacggaaagttacccagaagctatgattgaaaaagtcgaagagtttggtccttttatcaatcttggtaaaggtattgctattccacatgccagaccagaagatggggtaaactctgtcggtatgtcaatgcttgttttggaacagccacgccgtacgcatgaaaactttctcttcatccttttgtgcccggacatcaattttgaaaagattcctttttaaatcaatgatctgcttagcctctttctccaaataattggactaaataatcttccaaatggacagaaatataccgttgtttgcgacgataactgaggtcttttttaggaaataccatcactttgagaaaatataagcacatttttcggataagatttaggttaaatgcggctcttttatccaatgtctgatgatgatcttcatgataaacaacgtccaataaccagtgcatactctctatctgccaatgacctcgtacacaattggcaaatgtgaggacatccggcttaaagctaaagataaaataacgattctcttgactcagctgaccatccttatcaatcgtgttacgagtcatcccaataccacgtaacttatgccatttgggatggttttgacacaaccatttgatatcggaagacacccagtattctctaacttcaatctgtcccctagatttttcaacagtctgataatactgcgcattttcttggagttcttccaataagttgacatcactaaaataaagagcaatatcatcataaagtgtttcttgatttcctttgacggctaagcaatagtctgctttaccttttataatcgtatcaacgatagccgtctgcgtgcccattgcgtctatcgttacaatgcttttacggatatcaattgtccgcaataactgaggaatggcaacaatttcattacttttctcctcaaccgctacctgtcccaaactaagatgatgacccccatcataagccgttacaatatgaacaggcttctgatttttacctcgattgcctcgaatcgttttaccgtccactgaaatcagttgatgaacggcatctaagcttgtcaatgattgctcaaattgaactttaagctcttttaaacggtctgaattaacaagactaatcacacgctctaaggtatcatgagacggacaaccttcactcaaatcaacgtaggtcgcaaacaatggttcattcatttcaataaaatcttccatctccttccaggtttcaatgccagctaactgacaaacaaagacaagaaatagaatggttgataaggggtagcgaattttccaagattgacgactatccaattcaactgcgcaatcatcaatagaaataataaaatcaatcatcgtagtcacctcatctatagtgtactactttgattgattttgtcattatgaatctagttttctgaaaacaaaagtttcttcatgcgtttggcgtgtggaacagcctatttatttattggatgaccccaaacaggaaatttatctcttattatgcatagcagctattgataatgaaacgcatttgaaagctctatcgcatttgacaacaatacttcgtgataataataatgttaaagctttgttagcttcacgtaggtatcaagatattgaaatgattataaaacaggaggattaaagatgttaagaattggaacagcatgtggatcaggtttaggttcaagttttatggtacaaatgaatattgagtctattttgaaggatttgggggtttctgatgttgaagttgaacattatgatttaggtggagcagatccaagtgcagcagatgtttggattgttggtcgtgatttggaggattcagctggtcacctgggggatgttcgtattttaaacagtatcattgatatggatgaattgagagaattagtgacaggtatttgccaagaaaaaggcttaatctaggaggttgatgccatgaaaggtctattggattttttagttaatattgccagcacgccagctattttagtcgccttgatagccattatcggtttagtactgcagaaaaaaggcgttcctgatattgtaaaaggtggaataaaaacatttgttggcttcttagtggtttctggaggtacagggatagtccaaaattccttgaatccatttggaaaaatgtttgaacatgcttttcatttggtgggggtagttcctaataatgaagccattgtagcagtagctcttacgaagtatggctcagcaactgctttgattatgttagcgggaatgatttttaatattttaattgctcgttttacaaaatttaaatatatttttctgacaggacatcatacattgtatatggcttgtatgattgctgttatttttgccgtagcaggctttacttcgttctcgctcatcctttttggaggtctagcgttagggattattatgagcgtatctcctgcatttgtgcaaaaatacatgattcaactgacaggtaatgataaggtggcacttgggcactttggttctttaggctattggttgagtggatttattggtggaattgttggagataaatcaaaatcaacagaagatattaaatttccaaagagtttatcatttttacgtgacagtaccgtaagtattactatctcaatggcaattatttaccttatcgttgcagtgtttgctggtgaggcttatattgcaaaagaaataagtaacggtgtcaatggtcttgtttatgccctccaactagctgggcaatttgcggcaggtgtattcgttattttagcaggtgtacgccttatcctaggtgaaattgtaccagcctttaagggaatctcagaaaaattggttccaaattcaaaaccagccttggattgtccaattgtttacccttatgcacctaatgcagtattgattggttttatctcaagttttgttggtggattggttagtatgatagtcatgattgtgactggcactactgtcattttaccaggggtcgttcctcatttcttctgtggggcaacggcaggtgttatcggtaatgcttctggtggtgtgagaggagcgactattggtgcatttgttcaaggtatcctcatcagtttcttgccgattttcttgatgcctgtactaggtggacttggtttcaaagggtcaacattctcagatgctgattttggtttgaccggtatcattcttggcgctcttaatcatgtcggcggtgcgatagctattgttattggtattgtagttatcttaattggactttttggcatttcatttgttggaaaatcaacccataaggaaggttaataatgacatcaccagaagaaagatattcatctctaagacgatttgcaacggagattcgtttaaatactctagaaacgctaaaccatttaggattcggtcactatgggggtagtttatcaattgttgaggctttggctgttctgtatggtgatattatggatataaatcctgaaaaattcaaagaaagtgatcgggattatatggtcttatcaaaaggacatgctggtccagccttgtatagtacactctatttaaaaggtttttttgataaaacattccttcattcgctcaatacaaacggtaccaaactaccttcgcatcctgaccgcaatttaactcctggtatagatgtaacgacaggctcgttaggtcaaggcattagtattgcaacgggaattgcttatgctcaaaagattgagaattcaagctattatacttatactattgtaggtgatggtgaattaaatgaaggacaatgttgggaggctatacaatttgctgcgcatcatcaactgcaccatttaattgtttttgtagatgataataaaaaacaattagatggtttgacagctgatatttgtaatcctggagactttgttgctaaatttgaagcttttggatttgatgcagtacgtgtaaaaggagatgacattgaggcaattgacaaagctattaaaacttttcaagattcaaatagtgtcagaccaaaatgtattgttttagatagcatcaagggacaaggtgtgaaagagttggaggagttagcttctaatcatcatttacgaccagatttacaacaaaaaacaatgttagagcgagcgttgataagcttgagagaaagtttggaggtggtagaatgagatgttcaaccaaagaaatgaggcttgtctatcgtgatttcctccttcaagctaatcaagaaaataaacaaattaccgttttagaagccgatttgtcgagttcaatgtcaacaaatgcactggcatcagaatttggaaaacgttatattaatctaggtattatggaggctgagatggtaggccttgcagcagggctcgccattaaaggttacaagccataccttcatacttttggtcctttcgcgtcaaggcgtgtctttgatcaagtattcttatcgttaggttactcacaattatcagctacgattattggctcagatgcaggaattagcgcagaaatgaatggcggaactcatatgccttttgaagagttaggtctactaaggttaattcccaaagcgactatttttgaggttagtgatgatattcagtttgaagcaattttaaaacaaacattaagtattgatggcctaaaatacattagaactattcgtaaggcccccactgcagtttatgagggacgcgaagatttttcaaagggttttatacaattacgccagggaaaagatattactcttgtagcaagtggtattatggtttctagagcgatagaagcagccgactacctcaaagaactagggattgaggcctcagttatcgacctttttaaaattaagccccttccagaagaactgaaaccattactgatagatcaatccattgtaactattgagaatcataaccgtattggcggtatcggaagtgcattatgcgaatggcttagtatggagaaagacactactgttagtcgtatgggtattgatgagcgatttggtcaggtaggtcagatggaatatttattagaggagtatggactcgctgttaaagatatagtacagcattgcaaatcaatttataaatcataacaaaaaggcaacattggagttgcctttttgttattttctgaaatttttaagttttgtataagtatcttgtggtattttatccttactaaaaataaaggggtggtcgttatgcgagcttggaaaggtattgttttaattttatctagcatagtggtgacactagtagcatggcaaaatgcaggattaagtgaatttgttgtaccaggattagctttgacaagtttatcgctaacattcctcttatcaaccaaatttaggatacttgaaagttactttcaaggtattgaaaatatgtatttttaccacaaggtaatggctgtattttcaatgattttgcttctattgcacaaaattggtcttggacaaggcggacatggaagtgagtttgcaaagactattggcagtgcgggattatatctttttctaagtattgtttttgtagcttatttcggaaattttttaaagtatgaaatttggcgttttattcatcgctttgtttatttagcttatattttgggattggtacatacttttatgattttaggagataggatactaggaaatactttactcagtttaatcgtattaggttatgctgtcattggggttatatctggattttatattattttcctatattctagaatgcgttttcgtcgtgtagggtacgttcaaaaggttactcatcttaaccatgatacaactgagattgaaatagcaatgaagcgtccttatcgatatgactatggacaatttactttttttaaaatttatcaagctggctttgaatcagcagctcatcctttctcgatatcaggtggtcatgatagagtgatatttttaactgttaaagcttcaggagattatacgaaatccatttacaaacagctaaaagttgggacaaaaatagccttagatagagcttatggtcatatgttatttgataaagacaagaaagaacaggtttggattgcaggaggtatcggcatcactcccttcatttcatttattagagaaaatagtattttgactaagagagttgacttcttttataccttttcaaatcaagacaatttgatttatcaagatatgttagaatcctatgctaaagccaatcctaattttaaacttcacttaaataatagtagcctcaaaggaagacttgattttagtcagtctgtttttgaaggacaaccaacaatatttatgtgtgggccaactagtatgacatctacttatgctaaggtctttcggcaaaaagatgcaaagtctcgtttagtctatgaaggattttcctttagagacagttggttatccatatttctattaaaaacttttgacaaagtttattctaatttgataaaataagagggtctataagacaaaccaactttttcttggttttaggagtgccaatcctaagactcggatgaagcaataaaaggagaatatattatggcaatctcaaaagagaaaaaaaatgaaatcattgctcaatatgcacgacacgaaggtgatacaggatcagttgaagttcaagtagcagttcttacttgggaaatcaaccaccttaacgaccacatcaaacaacacaaaaaagaccacgctacttaccgtggattgatgaaaaaaattggtcaccgtcgtaacttattagcatacctacgtcgtacagatgttaaccgttaccgtgaattgattcaatcacttggacttcgtcgttaatagacaacagagtcaagtaaaaacactagaaaattttctagtgttttttgttttaaacgcactatgaacgtaagtactttgaggaggccagcagtaagaaagtgttttaacctatgaagagggttattaagcaagctaagattaaccctagaaatttattttaatcattgtaacaaggtctgattgctagtattaataatcagactttttacgtttacattaatgaatgataatacagcttcctccacggattttcgctactcaattttatagaattatgttagaataaagcttatacgtggttttatgcaaagttgagtttagaacagctagattgaactttgtaggaaacgcgtaaacaaaaaaatatggagaataatatgtcaaaacaagtctttgaaatgatttttgctggaaaaaaattagttgttgaaactggccaagtggctaaacaagcaaatggatcagttgtcgttcgttatggagattctactgtactcacagcagcagttatgtctaagaaaatgtcaacaggtgattttttcccacttcaagtcaattacgaagaaaaaatgtatgctgctgggaaatttccgggtggctttaacaaacgtgaagggcgtccaagtacggatgctaccttaacagcacgtcttattgatagaccaatccgtccgatgtttgctgagggatttcgtaacgaagtacaggtcatcaatactgttctttcatttgatgaaaatgctagcgcaccaatggctgctatgtttggttcatcattagcattatcgatttccgatattcctttcaatgggccaattgctggagttcaagttgcttatgttgatggtaattttattattaatccgacagcacaagaacaagaggcttctgcgttagaattaacggttgcaggtactaaagaagcgattaacatggttgaatctggagcgaaagaactttcagaagaaatcatgctagaggctcttcttaaaggacatgaggctgtctgtgaattaatcgcctttcaagaagagattgttactgctattggtaaagaaaaagccgaggtagaacttcttcaagttgatccagaacttcaagcagaaattattgctactcataacatagctttacaggctgcagtacaagttgaagagaaaaaggctagagaagcagctacagaagcagttaaagaagtagttataggtgaatatgaggcacgttacgctgaacatgaagaatatgatcgcattatgcgtgatgttgctgaaattttagaacaaatggaacatgcagaagttcgtcgcctcattacagaagataagattcgtcctgatggacgtcgtgtggatgagattcgtccattagacgcagagattgattttttaccacaagttcatggatcaggtctctttacacgaggacaaacccaagcattatcagtattaacgttagcacctatgggtgaagcacaaatcattgatgggctaacaccagagtataagaaacgctttatgcaccactataacttcccacaatattcagttggtgagacgggacgttatggagctgcagggcgtcgtgaaattggtcacggtgctttaggagagcgtgcattagaacaagtccttccaagattggaggagtttccgtatgctatccgactagttgcagaagttttagaatcaaacggttcatcatctcaggcttctatatgtgctggaacgcttgctcttatggcaggtggtgtgcctataaaagctccagttgctggtattgccatggggctcatatcagatggaacaaactatacagtcctcactgatattcaaggattagaagaccattttggcgatatggactttaaagttgcgggtacacgtgaagggattacagcacttcaaatggatattaaaattgaaggtattacccctcaaattttggaagaagctcttgcgcaagctaaaaaagcacgctttgaaattcttgatgtccttcatggagctatcgcagagccacgtccacaattagcaccaacggcacctaagattgatatgataaaaatcgatgttgataagattaaagttgtcatcggtaaaggtggcgaaactatcgataaaatcatcgctgaaacaggtgttaagattgatattgatgaagaaggaaatgtatctatcttctctagtgatcaggctgctattgatcgtacgaaagacattattgcaagtttagtacgtgaagcaaaagtgggagaagtttaccatgctaaagtagttcgtatcgagaaattcggtgcctttgtcaacctctttgataaaacagatgcattggtacatatttcagaaattgcatggacacgtacagcaaatgtagctgatgttcttgaaattggtgaagaagttgatgtgaaagtcatcaaaattgatgataaagggcgagttgatgcttctatgaaagcattgttaccacgtcctccaaaagctgacaatcctaaaaaggaatcttaatatgacaagtacaaacgagttagacattagattgcgtgcttttatcaatgcaccggataattttttagatagtataggtcttgtgaatgccttgcaccactctacggtttgggcaagcaaggaaccctatgctattcaagtagatggtcaagaagttgttcctgtttttacggatattactgaccttaatcatttcaaagaggagcaagaaagtgctcgagatatgttttgggagagtcgtcgtagtttagacgttcttgatgaagctatttcacatggcttagcaggattggtctataatttaaaaaaagaaggcgattttgggaactcgactattttctactgtgaagatatggtgcaatttatgaataattacaccacaatcttaaatcagttgttaaatgaagataacattgttgccgatatcatggataaaacctacttggtacctgcctttgtccatccacgtgaagaaggtagttttgaccgtcttttccctacaatgtctacccccgaaggaaaaagttatgttccagtattctcaaaccttttaagttttgaaaaatggtataaccataatgattttggtggtgcttttaggaaagcacaaggagtaattttagcctggacgattgacgatatttataaaccgcgtaatggagaaaatgagattgatgatacctttggagtagccatcaatccatttgatgaacaacaagttttagttgattggtctgatgtagaaaacgattgaggataactatggggtggtggaaagaaagtatagctattgtcaaagaacaagatccagctgctcgtagttctctagaagttattttaacttatccaggaataaaagctcttgcagctcataggctatctcattttttatggaatcataattttaaattgttagcacgtatgcacagtcaattttggcgtttctggacacaaattgaaattcatcccggagcgacgatttcggaaggggtttttattgaccacggttcaggattggtcattggagaaactgccattgtagagaaaggtgctatgctataccatggggttacattgggtggcacaggtaaagacaaaggcaaacgacacccaaccatacgtaaaggagcgctaatttcagcacattctcaaatcattggtccaattgaggttggagaaaatgctaaagtcggtgctgcagcagttgtccttgcagatgtgccagcagacgtaacagtagttggtgttccagctaaagttgtccgtgtccatggtcaaaaggatgatcttcaaatccgaagtattgaacatgatcgagaagaaagttattattcgtccaaactttaggaggtatttgtgaaggattatgtaacaactcaaatattatcaatcttaggtatactagcagcagcttgtttaagctatttaaagtttgcacaaggtaaccctctcttaggaattatttgggctgcttttgttttaatgtatgttgttcgtttgtataaagcttatcaaaaacagaaaaaggaaaaaccatgataaaaatttacgacactatgactcgcagtttacaagattttatacctctcaatgaaggtaaagtcaacatgtacgtctgtgggccaacagtttataactatatacacatcgggaatgcccgcagtgtagtagcttttgatactattcgtcgttattttgagtattgtggttaccaagtcaattatatttctaactttactgatgttgatgataaaattataaaaggtgcagctgaagcaggtatggatacaaaatccttttcagataagtttatttcagcatttatggaagatgttgctgcattaggtgtcaaacctgctacaaaaaatcctcgagttattgactatatggatgagattattgattttgttaaagttttagttgataaggaatttgcctatgaagctaatggagatgtttattttagagtaagtaaatcacatcattatgcaaaattagccaataaaactttggaagatttagagattggtgcaagtggtcgtgttgatggtgaaggagagattaaagagaatcctttagattttgcactttggaaatcagctaaatctggggaagtctcatgggaaagtccttgggggaaagggcgcccagggtggcatattgaatgttctgttatggcaactgagatccttggtgatactattgatatccatggtggaggagctgatttagaatttccacatcacacgaatgagattgcacaatctgaagctaaaacaggtaagacctttgcaaattactggatgcataatggttttgttaacgttgataacgagaaaatgtctaaatctcttggtaactttattactgttcacgatatgttgaagagcgttgacggacaagtaatacgttttttcttagcgacacaacagtatcgtaaacccgtgaatttcactgaaaaggccgttcatgatgcggaagttaaccttaaatatttaaaaaatactttcaacttaccaatccaagagaatgctaatgatgaagaattagagcaatttgtgaaagcatttcaaggagcgatggatgatgattttaatacagcaaacggtattactgttatctttgaaatggcaaaatggattaattcaggacactatacttcaagagttaaggaaacctttgctgaattattagaaatttttggtattgtattccaagaggaagttcttgatgctgatattgaatctttaatagaacaacgtcaagaagcacgagctaatcgtgattttgcaactgctgatcgtattagagatgaattagcaaaacaaggaattaaattgttagatactaaggatggcgtgaggtggactcgtgattgatgttcgtttgattaatggtattgctttagcttttgaaggagatgcagtttattctttgtatatccgacgccatttaattatgcagggttttaccaaacctaatcagttacatcggaaagcaacccaatatgtttctgctaatgcccaagcattgttaattaatgccatgttagaagaaaatattttaactgatgaagagcagttaatttataaacgaggacgtaatgcgaatagtcatacaaaagctaaaaatgctgatattattacctatcgtatgtctacaggttttgaggctcttatggggtacttggatatgactggtcagataaagcgcttggaaactctaatacagtggtgtattgaaaccattgaaaaataaacaaaaagagaggctatatcctctcttttttatagagacattaggatttgttggtaaaatattgctataaaaagctttatgctatagcattcatgatataatatgactatgaaagataaacaatttaaagaagaatcaagtgaccttgtctatggcttacatgctgtgacagagagtttaagagctaatactggtaataaattatacttgcaagatgacttaagaggaaagaacgttgataaagtcaaagcactagcgactgaaaaaaaagtatccatttcctggactcctaaaaaaaccttatcagacatgacaaatggtggagttcaccaaggattcgttctaaaagtttcggaatttgcctatgcggatttatcagagataatgacaaaggcagagaatgaagaaaatcctctcattttaatccttgatggtctgaccgaccctcacaacctaggttctattctacgcacagctgatgcaaccaatgtaacaggtattatcatccccaaacatcgttctgttggagtgaccccagtggtttcaaagacatctacaggagctgttgaacatgttcctattgcaagggtaactaatctcagtcaaactttggatactttaaaagataaggagttctggatatttggcactgatatgaatgggacaccatcgcataagtggaataccaaaggtaaattagccctagttattggtaatgaaggaaaaggtatttctcataatatcaaaaagcaagtagatgaaatgattacaattcccatgaatggtcatgttcagagtttaaatgccagtgtcgcagccgctattttgatgtatgaagtatttagaaaccgcctatgaaaaaacattctatcttactcgttgatggctacaatatgattgctttttggaaagatactcgacagctttttaaaagcaatcgtttagaagaggcaagggaagtattacttagaaagctaaatcattacgcacatttcgaacacattgatattatttgtgtatttgatgcacagtatgttcctggtgtacgtcaacgttatgaccaatacaaaatatccgttatctttactgaggaggacgaaactgcggatagctatattgaacgagcagcggcagaacttaatcaatctgtgttaaatttagtctccgttgctaccagtgatttaaatgaacaatggactatattttctcagggtgctttacgtgtctcggctagagaattggaacagcgtgtagcgacagtaaaatcagatttggataagatgtccagtcaaatcgatttgagtacgccaaagttaaggccgtggaatgatgaacaactaggaaaactcaaggattttttagatggtatgtaaaacctaacactttattagccagccaacaatttttttgatataatattggaactactttgattatcaaataaaaataatagattgaggtaacaatgacttttaaaatactaacggattcgacatcggatttagatgaaaagtgggctcaagagcacaatgtcgatattataggtttaaccattgaacttgatggaaagacttatgagacagtcggagacgaaaaaattactagtgacttcttgttggagcgtatgcaagagggagcaaagcctacaacaagccaaattaacgttggtcagtttgaagaagttttttcaacctatgcagaaaatgaccatgccttgttatatttagcgctatcttcacatttatcaggcacttaccagagtgcaactattgcgcgtgagatggtcttagacaaatatcctgatgctcaaattgagattgtggatacgatggcagcttcatgtggtgagggtgtcttagcgatgttagcaactaaagagcgacaagaaggtaaatctttagaagaagtgaaacaaaaaattgaatcacttctccctaaattaaacacatactttttagttgacgatctcaaccatttaatgcgtagtggtcgcttatcaaaaggtgcagctatcattggaagtgttgctaagattaaaccattacttaagttagatagtgagggtaaattagtaccatttgccaagacaaggggccgtaaaaaaggtattaaagagattgtgactcaggcaacaaaaacactatcttatagcactttaattattgcttatagtggagagaaagattcagctcaagttatgaaagaacagttattagcagatgagcgtattgaagaagttattattcgtccattagggccagttatttcagctcatgtgggctcaggtgctttagctctattctctttaggggaagaaaaccgataacaaatcaaagggcataacagtacgttatgttcttttagtatacattttataaaatgtattttatatgatgctatgaaactataaaatagtaggagacctattataaaaaataaaataagaactatcctcaatatgataaacgacaacaacaattggttttacaaagttatcaaaaatgtttttagacgatggtttttatcttatggcttgaaagtgtttttggaaagctaataaggggagtgtgttacctgattttataataatattaactttatttagtggtatttctattttgttacgacttctaatctaaaaagcgtctctccgtttgttgatgaaagtttttggaaaatgtttttgttgctggcgcatttgccctcataggaataactattttattgatgcttttactaggaaggttgatattgctacttatttttcaaggggagatgatgcaattttagcagttataggaatatcattgatagctatgggaatttcagtgtactaccataagtataaggacagatagtaatatgaaaaatttacgcttaaagacggctagagctagtatggatttattataacagtctctagctgaaaaggtcggtgtatcatgtcagacaatagccgccattgaaaaaggagactataattaagcgattaaattgtgtcaagctttgaataaaactgtagatgatttattttgggatgaaaattgataaaataaaagaaataacttgacgaatgctaccttattttgatatgattataagcggtattgtttaccccatttgtaaggccccggaacctttcaaatactctcgtggaccggaacatccacacctgtaaacaaaaacgaattcgtataggagaaatcatgaacaaaacaactttcatggctaaaccaggccaagttgaacgcaaatggtacgttgttgacgcagcagatgtacctcttggacgtctttctgcagtagttgctagcgtacttcgcggaaaaaacaaaccaactttcacaccacacactgatacaggtgactttgtgattgttatcaatgctgaaaaagttaaattaactggtaaaaaagcgtcagataaaatctactacactcactcaatgtatccaggtggtttgaaacaaatctcagcaggtgaacttcgttctaaaaatgctgttcgtttgattgaaaaatcagttaaaggcatgcttccacataacactcttggacgtgcacaaggtatgaaattgaaagtatttgttggcggtgagcatacacatgctgcacaacaaccagaagtacttgatatctcaggacttatctaagaggaaaggagcattatataatggcacaagcacaatatgcaggtactggtcgccgtaaaaacgctgttgcacgcgttcgtttggtcccaggtactggtaaaattacaatcaataaaaaagatgtagaagagtacatcccacacgcagaccttcgtcttgttatcaaccaacctttcgcagttacttcaactcaaggttcatacgatgtttttgttaacgttgtaggtggtggatatgcaggtcaatcaggtgcgatccgtcatggtatctcacgtgcacttttagaagttgacccagatttccgcgattcattgaaacgtgctggacttcttacacgtgacgcacgtatggttgaacgtaaaaaaccaggtcttaagaaagctcgtaaagctagtcagttctcaaagcgttaaaaactgctttacatcaacgattacaagcattttgcaagtctcttgcaaggtgctttttttgtcgttttttgcttttgataccttttttgataccgtttcggaaaaacttctccatcttttttgactgttattttgcttttagatagtccgcaaattgtttgactgacctatcttctccagtagttgtcgaatgactgtaagtatctaaggtcatttgactacttgcatgccccagtctttttgctgtgttgactgggtcaactccaatctcaatcatcaaggtagcatgagtatgtctaaaaccatgaggactgattttctttaacccgtgttttctgataatccgtgataggacgttgttgatatagtctgcatgtagtggctcaatagagcctgaccgtgtacaataagtgaagagaaaatcttgctcgatagaaagaggtgcaactgctagttgtgccttttctttttggctgatggatttccattcttgcagaatagaaatagtttcgctatctagcttaatctttcttactgagaaatcatttttagtgcctttttcgattgcctgtccgtctaatcgtcctaagctcttatcgacacttagtgtctcagtttgaaagtctatatctgcccacttaagagcgtatagctcgcctttccttaagccactgtaagctagtaatctaaatagtgcatagtgtttgtaaggctcttcctgaaggacaatggctaggaactcctgaagttcttgaaccgtccaatagttttctatccgtgtctttttccgttttggcataatgatttctgccatagggttatgcttaagcagtttcatcttgatagcaaaatcaaagaccttcccagtataggacttgatttgcttgatattcttaaaggtctttgctttatctgtgatgaagttctggcagtctaaaggggagattttgctgatgggtaagtctcccataactggcagaatgtgaagtcgaaacatatcaagagtacgtgaagcagttgttggctctaccatatcttgataggcttgataccatttctcgaatatctcgttataagttttatgagttggtttgatgaactcttccaactttcctgaagccttaagataaatgagtctggcttcgtagtctttggcttcctttcgagtacgaaagccacgtttgatatggtctgcacgttgactgtctttgaccatatagattttgacaaaatacaaatagccatttttggcttttttgcttgggtatttgtgaatggacattgtaatttctcctttatttttctaaggtttcggagcttataaaataaagaaattacgttgcctattatttttttaaaagttctaatctctcttttacttctttatcaagagtttttcgaagatttttagcctctgcttcaagttcatcaattttctggttaagcttgattttttcttgcttaatttcctcaagtctgtcacgtatgggagagttgaaaagagtttttttgctaactttttcaagggtttcaagagtagaaaaataatcttgacccatatcctttttgacttgttcaaaaaaacttaataaatttgtatctttgattgttgaatttgctatttttgaattgttatcaagccctagtaagtaagggatagatacaccgaaaaaatcagctaatattttagaattttctatgctaagactagtttttccgttttcatattttccatattgagattgattagtattgatgactttagctagatcagcctgagttaaccctttgtcttttcgtagttcttttagtctattgtacattattccctcatgacttttattgttttatataaagcattatatcacaaataatcaaaatttaacttttttcttgacataagttattttttaacttaaaataatagttataaaataactttttcggagtttataaaatagagaaaggggtcagttatggcttacacactagaagaacgagaaacgattgtccgttatgatgaaatggataactgttggtattttgagagtaatgttaggaaacacattactaaaatcatgaaaactattgatagttgtcagattttaggtcaagagaaagaagacgaccgcattatatggattcatgctaaattgacaaatcttgatgattatatggtttctccatttgttcgaaaacgagttaaacgtgaaatgactgaagaacaacgagaggaagcaagaaaaagaatggcaagattacattctaagtctgaaatatgattctacaatcacaaataacagattaaaaaccttctcaggtatatttaccctaggaagatatttaaattctgaaatacttgattacaataagcgtttcagagcttaaaatcgattttaacaaaaaggagaactcaaaatgacagaaggatttaccattcagctccccaaagtaactgaaaagaagttactggctcgctatgacactatggttcaaaaagcaatagaaaaagcccttgaggacaaagagctatataagcctatggttcgtatggctggcttgtgccgttttttagatgtctcaacgacaactattgtcaaatggcaaaaggcaggcatgccacatatggttattgacggagtgactctgtacgataagcgcaaggtcgctcaatggctacaacaatttgaaagataggaaatttggcatggataaaaataatttagaagacttgacaggaaaaaagatacttagaaatggttttggtggtcttcgtttggaatatgggacaatctttcttgatgttggattgttcacttatattgtgctgatactatcaatatttttctttttagttgaacgttggtttttgggagctttaacttttgtgttgcatgttcccttgcttctacttgggatatggtgtggagagagataggaggtaagaactatggactatgataacgacagctatcttatcccgaaagttttactgcaagatgatttctacagtagtctatctgcgagagatattttagtctatgctgtcttgaaagatagacagatagaagctcctgaaaaaggttggatagatactgatggcagtatatatctaaattttaaactgattgaattagctaaaatgttttcttgcagcagaacgacaatgatagatattatgcaacgactggaagaagttaatttgattgaacgagaaagagtagatgttttttatggctactctttaccctacaaaacctatatcaacgaggtataagcaatgataaagatttattttggaaaagatataacacttaaccaagctattcagtcgcgattggatagctatcagattgactatcaagcattctcaagcaaagatatagatgctaaaacactgatggaatggctattcaggtcgaccgatatatttgaattactaagcactaagatgttgaaatacaagctgaatacacaaattaccctcagtcaatttgttcgaaagattttaaaagatgtcaatagcaccttgaagcttcccattgttgtgacagatgaggttatttattcgaacatgtcccctgactatgtgacagtactcttgccaaaagaatatcggaaaattaaaagaattcagctgatgaggaagatggagcagttagatgagggacgtctattctggaaaaactttgagtcactacgtaagcaatctgagctacgttggtttgaactgaatgagttactgtttgctgatatgtccgacgatttaggagaaatcaaaaaagctaaagaccgtttctttagctacaagaaaaataaacaggttccgcctgatgacattatcgaaaaaatcctcaagatatttttggttgaccgagaagactttttcaaaaaatctgtgttggattgacaaaatttctagtcaaaaatatttatgaaaataactatgaaaatattttgaaaacagagatttgaggtcagatttattggggttctgaaaaatttataacagggcgccctctaacagcccgctatgtgcacatctgaagtgcatttactacacccgttttttggcaagtttggctggagcaaaatgaaaatggtccgactccgaaggggtcggcttggggctactcccccaagaatgtcattttacgtaggcctttgcgcagacaaaaaaatcggcgccgttaggcgaccgccaaaaagaaaggaggtttgtttgaaattaaaagtcagcttagacaatatcactatgacagcctatatcaaatctaaaaagtatttagctatgaaacaactcatagaaacccatttagctattactgttcaaactgcgatgactgacatgtttcgagccaccactggggatggaatccacgttgtgctccatatgaattatgacaaacaaaaaggacaagaccgcaaggctcgtccatttcgcttggagtttaatcccaataaactccgtttagttgacagtgaaattatagatactattataccatttcttgaagatatttcaatatcacgtgctgatttagcttttgatctatttgaggttgattgtagtgagtttgtgctcgaaaaaaagggcagaccaaccgcaaccaaggaatttcgttctagtactggaacgttagaaacaaaatatctaggtgctccacgttctgaaaaacaagttaggctatataacaagaaaaaggaacaactccaaaatggtactgataaagataaagactttgcaagtcaatttaagcactggtggcgcttggaatttcaattaagaagccgttcaattgatgagatattcgaggttattgatactattatttttaaaccattcaatcttaaaggcttatctattgagacccaaatctatctaactgctcttattcacgataaaaatatctggaaaaaactccatagaaatacaagagcaagatacaaaaaaattttagaaactcatcaaacatcagatactgattatttaggtttgctgaaagacttgttgaagcatgaaagaccaagactagaaaatcagctcgcttattatgggggtaggatagacaaaaatagctttcaacccttttgttgaaaattcagtattatcaaggagttacgaggtcaaaaatgagaataaaagattatgctgatagtctaggagttagtagccaatctatctataaacgcatacgctctccaaaatataaagaaaggttgaaaggtcatttataccgagacaaccaaaaggttgaaaatcttgatttgataggcattaaaatacttgaagattatcattttgagaatgatgtcattgaactggaaaaaacgctgggtgatattcaagaagaattcgagcaagaaaagaagggaatgcaatatcggatagatagactagctgataagttaactcctttacttgaggataaccaaaacttggtacaaaaaaattatgagttactcaactatgttcggagcttggaacgacagaagctattgctgattattgctttagctgtcatggtaatcactttattagtggcaatatggcttgccatcttttgatggcaattgtcggacaatgcgaagcgtccgaccaagggcactgcttaagtgctctactcgcttcggcgagtataatcgaagctcctcttgtggctcgagaggtggttcgaagtcgctcctgtattcggagcgaagagctgtctgcaagacccttcggagaacgcacatttacgtagtaaagtgtagtgcgttacactttacatggaagttatgccgatcccctaagaagaaatccagataataggttgcttattcatggtggcaattaccgccaccatctcggcgaccttttgagccgagaaaggagaattaaaaatgagttatgttgttgctagaatggctaagtacaagtcaggtcagttgacggctatttataatcataatgaacggatttttaaaaatcactcaaataaagaaattgacgttgagaaatctcaccttaattatgaactgacaaatcgagaccaggcacaaaattatcacaaacaaataaaggagcacatcaatgaaaatcgcttatctactcgtggagtccgtaaagatgctatactctgtaacgaatggattattacttcagataaaacgttttttgactcgttagatgagaaacagacacgagagttttttgagacagctaaagattattttgctgaaaaatatggtgatgctaatattgcttacgctagagttcaccttgatgaaagtactccgcatatgcatttaggtatcgtgccaatgaaaaatggtaagttaagttcaaaagcactgtttggaaataaagagaaacttgtagcaatccaagatgaacttcccaagtaccttaatgagcatggctttaacctacaacgtggcgaaataggcagtaagaaaaaacatttggaaactgctgaatttaaagaaaaacaacgattactggataacgctgatagaaaactagctgataaacatgaagaattgaaagcacttgatgataagatttcaaatgttaacgatacaatagctgataaagaaagtaggcttaaagaattggaagcgaaagaatgggatgctgttggcgatttgaagcagtatgaattagagaaacagtcactagctgaaagcattgaagacataaaagacattgaactattacaacttgatagaattcaaaaagaagatttggtaaaacaaagctttgatggcaaattgaagatggataaagaaacctataatagactatttcaaactgcttcgaaacatgcatctagtaatgctgagttaaaaagagacttggttaaagcccagtcgcagaacaatcacctttctagagaattactcaatcaccgtaagacagctgaaaaaaatatcaaattaagtcaagaaaacagaaaattaaaggacaaagtaaaaatgcttgatgaacaagtgaaaattctgaataaaagcctctctgtttggaaagaaaaagctaaagaatttatgcctaaacaggtttatagagaaacattatcaatcataaacactctaaatcctattggtttagctaaaacagcaatcagacaagttaagaagatggttgatagtaatagttagctacttttatgccgtgaaagtctcttgataacaagctaggcaagtttagactagatggggtcgagtcgtcaggctaaagaactggcgaccgatcgccatagactaaaacagtctaggttacttgttgtcaagagaaccatggaataaatgagtaaggagaaattaaaatgacagataaaaaaattgtttattactttgaccatgacttatcaaaaaaagatatgggaggagtaggacctacctacaccggtaaaaatcttttattcctactttggtggacatattcttatgtggcagaagacaatttagacattgatacgtcattgtttgaagtcccagaattcaatgatttttacaataatggtctagagctttatcgtataaaaaatgaactagctaattacaatatcagatttggatatgaggttaatccaaaagatagtacaaagatgctgataggtattttgccaactgatgaagaagattatgttaagggatatagaaattttattgctgatatttccaatcctgacacacgttacgcaatctatcatcgactaattaaaaccatggacacaatgctaccgattgaacaaattaatgtttataaaagccttgcaaaaggtaataaaaagtgatagagtggaagaaagttgagactgagtttgaattggtaacaattcattcaaaaaatacttattgaaggtattaggtagaggtgttgcctcctgagtatacttaggtaaatccccgattgggttctcagcttttacattaggagaaggttgattgactggtaacagttttctcaaaggtattgtttgtcaatacagggttggctctgccttgtggaatatctactaaacagcccgaactaattttgctcctagttaatttgtaatcttcaaaaagccttggtattacgctaaggctttttgattgctatttaaacaatttcatatagtcgcttcgagtaggaagcaagtaatcaataacgaccctattctcttcctcctcgatatggtataggacaatataatctttacttaaggtataacctctagtgctgtggtacttactgatttttgaaccatatttttcatcggcatcaaaaccaacttcagggaaaacctcgagtttttctatgtcactaatgatttgctccattttgtgctgacctgatgtcgaggaatagttttgagaaatataatcacgaatttcctttaacttctctaaaacatcaggagcatagataatctgatatttcttatagtccaagttcagacctcacttcttcagaggtataaaatttcccttgacgaacatcttcaatatttttgttgatttcagcttgaaattgcttgaaaagtttttctttctctagctcctcttccgtcaataagtcaacctcatttgtgacaacgacattttgaaggaataatcttaaagcagatgataaggttaaatttttcttgtttaatactgtcattgcttcgcttaccaattctttgttagcttggaatgtgacagctctatttttttctgctgtaaccatattatgtaactcctttatttagtttatttaattatctcatatacataaaaaaagtcaataaaaaaatcccaattgattgagatagctttcgtttattttataagctccgaaactacagaaaattgatacctttttgataccgtttaggtttaaatatttgtctataaataagaatttcagtgattttttattttagaaacgttgattttaaagggatttgactttaaataatggagtgaaccaaaaaccaggtcttaagaaagctcgtaaagcttcacaattctcaaaatgttaatcagtacgattatatcaacgtttcaaagcactttgcaagtcttgcaaggtgttttttaaaaccttttgataaccctttctgttttgaaagtaaggtaaatgtaatataaatcgctgtttgtatttttaatagattaacctattatgagttttatctgtgtaaggaacatctaaatatgctatactgcagttaaaaaaatagggagcaaatgatgtcacaaattaaactaacacctgaagaactccgtatttcagcacaaaaatatacaacaggatcacaatcaattacagatgtgttaacagttttgactcaagaacaagctgttattgatgaaaattgggatggtacagcatttgatagctttgaagcccaattcaatgaattatctccaaaaatcacacaatttgcacaattattagaagatataaatcaacaattattgaaagttgcggatgttgtcgaacaaacagactcagatattgcctcacaaattaataaataattggcttattcaaattcataagtttaacttaggaaggcataagctctcctaagttgatatattatagctagatgatgtaattgtttcataaaggagtaaaaatgaaaaagagtacccaaataatactactaatagttgcattattcatacttgtttttagcggaggattttatatgaaagaacaacaaagaaaagaagaactaaaacggaatcgagaatatgaagttagtctagtcaaagcattgaaaaattcctatgagaatatagaagaaataaaaatcacacatcctgtttcaactgaaattcctggagattggcattgtactgtaaagatttcatttaatgataaaaaatctattgtttataatattacacataatttggaatcgaaaaaaaattatagcggaaaatttaatgaaaaaaatatgaatttttttgattcaagaattggtaaaacaaaaaaaactataaaaattattttttcagatggtcaggagaagatacaataatggtatttacatataccgagaaagaacttcgtgaattcaatattggagataatgtatattcagttaaccccgattatgcagaaaaaaatcattcaactgtcataacggatttaccccagaaagataacgaaacaaatattattacaacagaagatagaaaaaaatttaaggtattaaaaacttctcctgacgatatgtctggctatcagggtatggcagttgcaccaattatcaagggtaaagtagattataacagtgttgcagttatatccgccgcaacggattcaagtaattataaagatttaattggcgcagtttcatctgctcaaccacatcaaagttcgactcagttaaaatcagctgataaatttttaaaagacgtacagtcacatgacaaatggactgtgactcagctttcaggctattctcaatctgcatatatgttaaaattaggtgctcaatatcatatcccgactacagtatttaatggatggtttaggtatagcactttaaatgaagatgaaaaaaattcatggctaagcatcctgaatattttgtgaattttcgacataaagaggataatgtaacttggtggaacgattttaataaactagatgataaagattatggtaccgtgaaatgggtaaatggtaaaagtcataaaatagagagttggaaatttactgatgatggtaagttaaaagatgaaaaaggtaacatcgtaaatcctaagtcaccagctgttcagtctgttctttatgaagaagttcattttcaaaaagctaaagctaaattaaaaaaatctggaggcaaacttagtcatagtgaaaaagtatatttagattctgaacaggctatatttattgctaacggtttaaccacggcatctcaaacagcttctgatgatatcaagaagaatgctgaattagttaaagaaaaagcatcagaactatttgcaaaaactaaagtgatgcctcctggtataacagatttaagtccggaagaattagctgatacatatagtgagggcggagttagagaggacaccatagtaacaccaattgaaactttctttgatgaaaaagttactaatgcacaagagattacaacttcatatattaatcttcaaaaacaaattgaatctggtgtccaaaaattgctagaagaggactccaaattagcaggagaatttaaggaatggtcacagtactagatcaaaatgaaaacaaaattaatagtctaaaaataaacctagggaaattggaagataattatcatcgcgaaaatatggagatagaagataaattatatagccttgaggataaaaagaacgagttagagacttatttacaagaagtctatgaagagacaagtcaccttttgagacaaaatgattcagatggttcgacttttatgagtttaaatcgaataattgaaagttatcaaatggaattaattgatgaatatgaaaactataaacagactatcattgtccaagaggaaaatagtcggacacagtttctaaaagaccgagtaaaattagaaaatgacatttctagtttagaaggaagaaaatactactaattcagatggactataaagtgaaagaggcaataaatgagtttaataggcgctgtattgaaaggaaccaaagaagacaaagaattcaaaaagcaaattcaaagagctttagtaaggattgtctatgcccctgaaatagtagaagaagctgattctattaagatgacttatagtgacaagattgataatgtttctgagacggccaaatcatcaattaaaacgatagcaaatcaaatagattcaggacttgtaggacaatttggggaaaaagtaaaggcacaggtagatttaaataaaggtagttatgatgatttataatcgagtgaaaatgttgaggaagcttactatcctgatagttattatagatatgaaaataatcaagttggattagaagacataacattttacatgaaggataacaaagtttattatttacattttggtaaagcaatagataaaaatgaagctaaaaatgataagtatctcaatcaaattataaataattaatttctttattttataagccccgaaaacaaattttttgataaccttttgataacccctccgcgaacatattgtaatacatagtgcacttttgggatataaattgttgatttttagctagtttataccatataacaccatatattacagttgtcagagaaaaccaggtttaaaaaaagcccgtaaagcatcacaatcctcaaaacgttaatatatacctatatatcagcgattggaagcacttcatggttcacaccatggggtgttttttgtgtaatattcaaaaattgtcctaaagtcatttttaaaacttctaaatacttgagaaaccattgtaaatttaaataactactttaaatagcacaaaggcaatgacaaagttagatgagatgattctattttaatttataattgaaaaaaagagtatatgatggaggaattttgtatggtaagtactcaatatatgaaagtaaccttacgagaaaaattcccagataaattaacatatgttgatttagaagaacttgtgatatgatattacaaataaaagaaaatgactatatatcagctcatatattggttaaagttggtaaatataaattattgaaattacctcataagtttaccaatgagattacggttagaaaggaatactaatgtttaaatatgtccctatttttagggaatttcgacttaatcgacagttttctcttaaacaggttgcttcaaatgaactttctgtttctcagttatcacgatttgagaggggtgaatcagatttatcattaacaaaatttttaggggctttagaggcaattgatttatcaattagcgaatttatggatagagtaaataaatatcaaaaatctgatcagatatctttaatgtctcagatggctcaatatcattatcaaagagacgtagctgggttagaaaagatgatttctgtggaagaaggtaaactaaaaaaggatagttcagatatacgttgtcgtttaaacatagttctttttagaggaatgatatgtgaatgtgactcctcaagaaaaatgtcggaagaagacctttgctttttgtcggattacctctttcaaaaggatagttgggaaattagtgactatattttgattggaaatctttaccggtattacaacacaaggcatatttgccaacttgttaaagaggttatcaatcaaaaggaatattatcgagatatttatacaaaccgcaatgttgtcgaagcaaccctcctaaatgtggtagagacactaatagaacggcgcgctctagaagaagcaacgttttttctagagaaagttgaagcacttttaaataatgagcggaatgcttatcaccgtattattttactctatgaaaaaggatttcttgcctatgctaaaggggatagtcgaggaatacaaagcatgaagcaagctattttttgcttccaagcaattggttctaaacatcatgttgaaaattttcaggaacactttaatagggtaacaagattataaaaaatcccatttatgggattttttaatatttctccttttggtttgctataatgtcgaactaaggagggaattatgaatattaatggtataaaattactatctagtcgagcagtcagtaaacttggtgatgtgttttatgattatggaaatagtacttggattgcttcgatgggtggtctaggacaaaagattttaggtatttatcagatagtagagttgttggtttctattgtcctcaacccttttggaggcgccttagctgatcgctttcaacgaagaaaaattttactaataacagatgctatctgtgctatcatgtgtttcttactttcttttattggagatgataaagtaatggtgtatggtctaatagttgctaatgctatcttagcggtttccaatgctttttcttctccggcttataaatcttatattcctgaaatagtagataaagctgatatcattacctataatgctaatctggaaaccattgtgcaaattattagtgtaagttcccctgttttaggtttccttatttttaataattttggtattaggattactttaattgttgatgcgattacttttttgatctctttcctgtttctttatgctattaaagtggaaagggtacagctttcaaaacaagaaaaggtagcgataaaaaatattttagctgatattgcagatggatttacttacatcaaaaaagaaaaagaaattatgttttttctaattattgctgctttattaaacactttcctagcaatgttcaattatcttttaccttttactaactccctattaaaaacttcaggtgcttatgcaacaatacttagtatatcagctatcggatcaattattggagcgcttattgctagaaaaattaaatctagtattaattctatgctatctatgctagtattcagtagtttgggagtcatagttatgggattcccatctctatttgaattaccgatatggataccttacagtggtagttttctttttaatagtcttctgacaatgtttaatattcattttttcagtcaggtacaaatcagggtcgatgaagcgtatatggggcgtgtgatgtcgactatatttactattgctattatgtttatgcctataggaacactatttatgactatcttttcatttgccttatcaaatgttagctttattgttataggatgtgccattgctatattgggaggattaggatttagctatagtaaaaaacaattttagaacttaagaaattattctgaaacatcaaaaaaacttgtctctactgacaagtttttaatagttattttcttggttcaagcatgcgttggataccgcctaggattaaatcagagaaaattgccataagggctgttggaagagatcctgctaagataatagcaccaccatttgttgcattagttcctcttatgatgatatctccaagtccgcctcccccgacgaaagcaccaatggctgtaataccaattgctacaacaagggcatttctaagtccagccatgataacggaaatagatagtggtaactcaaccataaataaacgttgacgcttagtcatgcccattcctttagcagcatctagtaagtcggagtcaacatttctaataccagtgtaagtatttgtgatgattggcagaagagaataaagaaagacagttgcaactactgttttaatacctagccctagacctaacataatgatagagatcatagctaaagaaggaatggtttggatgacatttgcgattcccataacaaaggttttaattttaccacgtctagcgatgaagatacctagagggataccaacaattgcagctaaaataacgccgtaaactgaaattaaaaagtggtggataaattgttctaagatataactaccattatgttggaagtagtagataaattgttggaaagtattcatttgtttcatttatttatctcctctaaaataatggtttttttctaaaaattgtttggcaacaactgaaggttctaaaagtttatcatctaccatataattaaggttttgcatcgtttttaaattgattttaccatcgagtcgatggagtaatttttttagtttaggatcttttttgatgatagaattgttgacaaccatagaggcttcataaggaggaaagaattttttatcatcccttaaaatttctaaatcatagctcgaaatacgaccgtcagtggagtagcctaatacagattgcattttgttactttcaaccgcatcatagactaagccaatttgcatagggtaaatatgtgaaaattcaaaaccgtatgttttagcgaaatcagtgtatccatctccctcgcgattcatccatgaactatcaacccctgccttcatagttgttgataattttttaagatcagagatcttagtgattttattctgtctggcaaactctttagtaaccatgaatgcataagtatcagaaaaaccataagtaggataccaagtttgattgtagcgtttttggaattcagtttttacaatcttagaagcttctttagggtctttaacagcttttaaaccaagagtccctgtgatgtctgttcctgtataacgtgtggcagcaatgtcagcatcaccacggagcaaagcttggtgagtaaccgtagaggaaccaagattgcttattaaagttgtgttgtatcctaattcgtgatgaattaattcggtgataatatttgccataatactagactctgtagaactttgggcagcaaccttaattgtggtatgaccagactttttagtatcggttaattgacaaccagaaatcgttaagagggctaagcaaagtgtaaatatctgtaaaaagtgcgattttttaagcatatctaagcctcccttcttgttgttctgggcgttagagctgtttccagtaatcctaaaagataatctataataagtgacaggataataacaggaattgtgccccctagaattaatttggactgaaaaagatttaacccgctaaaaatgagatcaccaagtccacctgcacctatataagaagccaatgtagcccaagcaataacataaatagtagacaagcgaataccagccataataattggagtagctaaaggtaactcaacttgaaatatagattgaataggtttcattcccatccctttagcacaatctttaagtgttggattgacattattcatacctatataagtattccttagtataggaagcaaggaataaataaataaagcaacgatagctgggatttttccaattccaaacaatggaatcattaaagctaataaggctaaacttggtatagtttgtaacatgctagctatagcaatgataattttggctactttgggaaaacgtgttaagaccacacccaatggaacagcaattgcaatcccaagtgctatagcaaagaatgagatatagacttgttcccatgtttttactaatatttgcatgccatactgtgataagaaattgaccattattgatcctccgtttcagtatcgccccaaataatatcgtataacatatcaactagggatgcacgagtaacaatgccctttaagttattctcatggtcaacaactggagcgtattttaaaccaagttttaaaatacgctcagcagtatttctaagtaagtcgtcttccataacataaaaatcagtatgttttaagatatcagaaacaagtcgatctttcttatatttactgcttagagattctaagtcaataaaaccaattaatttaccgttatcggttactagaagtgagtcaacgcgtttttggcgcattagtgtaatagcttcagttagtgttttttcagcagttattgaaacaggattatttaacattatctgtttaacaggagtaatatcagcctgcgcatgaaggagacgctcttctccaatcatttgttcaacgaaactagtagcaggatgatgtaagagatcattgggtgtcccttcttggaccattttaccattgtccataacaataatttttgttgctaacttgagggcttcatccatatcatgagtaactaagatgatagttttccccatttcttcctgaagagacttgactaagtcttgaataccttctctagtaataggatccagagctccaaaaggctcatccattaaaataatatcttggtctgctgcaagagcgcgaatgacaccgatacgttgttgctgaccgccagacaactcactagggtagcgatccaaatattcttcgggtaattcaactaatttaataagttcccttgctttagctcttttagcttcttctgaccatttcaataattttggtacaagaactatattttcgtaaatggtcatatgaggcattaaaccaatgttttggataacatatccaattctgcgtcttaattcaatggggttaatagtagaaatatcttttcccttaaataatagagtaccatttgttggttttaacatatggttaaccatacgcattaatgttgttttacctgatccactcgtaccgatgaaacaaacaaaatcaccagggtaaattttaaggttaatgtcttcaaccgcaacattttccccatacactttattgatattttgatattcgatgataggttcttggcccatattattctcctctacaaactatattatagtaataatatcaaaactttggcaacatgtctgaaatttgttttaaaatttaatgattttaaaaagaatcgttaagcttgagcctgatctacattttcagaaaatgtagaaaaagtatgaaaaaagagttgacaaagtaagagatgatgtagtaaactaaataagttgtctcgagagagcagtttctattagcgcgtagttaacaacttaaaaaaagtagttgacaaagcagaataagtttgctagaatatagaagttgtctcaagagaggcaaagacctttgaaaactgaacaagacgaacgaatgtgcagggtggatttacattgtaaatccgtcaatgacaaaaaaacaataaatctgtcagcgagacagaaaagagcaaagctcaaacttttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggataaggaaacctgccatttgcgtcttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattgtagaaagtaacaagaaaataaaccgaaaacgctgtgaatatttaatgagttttctagttttaaagaaactaggttaataaggttaagttaataagggcgcacggtggatgccttggcactagaagccgaagaaggacgtgactaacgacgaaatgctttggggagctgtaagtaagcgctgatccagagatgtccgaatgggggaacccactagttaatgactagtatccatatctgttaaggatatgagaaggaagacgcagtgaactgaaacatctaagtagctgcaggaagagaaagcaaaagcgattgccttagtagcggcgagcgaaacggcaggagggcaaaccgaagtgtttacacttcggggttgtaggactgcgatataggattaatcattatagaagaattacctgggaaggtaagccaaagagagtaacagcctcgtatttaaaatgatagattaaccttagcagtatcctgagtacggcgagacacgcgaaatctcgtcggaatctgggaggaccatctcccaaccctaaatactctctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcgtcatagtatcatgttgtagacccgaaaccatgtgacctacccatgagcaggttgaaggtgaggtaaaactcactggaggaccgaaccagggcacgttgaaaagtgcttggatgacttgtgggtagcggagaaattccaaacgaacttggagatagctggttctctccgaaatagctttagggctagcgtcgatgttaagtctcttggaggtagagcactgtttgggtgaggggtccatcccggattaccaatctcagataaactccgaatgccaacgagatataatcggcagtcagactgcgagtgctaagatccgtagtcgaaagggaaacagcccagaccaccagctaaggtcccaaaatatatgttaagtggaaaaggatgtggggttgcacagacaactaggatgttagcttagaagcagctattcattcaaagagtgcgtaatagctcactagtcgagtgaccctgcgccgaaaatgtaccggggctaaaacatattaccgaagctgtggatgacacaaaagtgtcatggtaggagagcgttctatgtgtgaagaaggtgtaccgtgaggagcgctggaacgcatagaagtgagaatgccggtatgagtagcgcaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatatagtgatggagggacgcagtaggctaactaaaccagacgattggaagtgtctggtcaaacagtgaggtgtgatatgagtcaaatgcttatatctttaacattgagctgtgacgaggagcgaagtttagtagcgaagttagtgatgtcacactgccaagaaaagcttctagcgatacatatactctacccgtaccgcaaaccgacacaggtagtcgaggcgagtagcctcaggtgagcgagagaactctcgttaaggaactcggcaaaatggccccgtaacttcgggagaaggggcgctgattttagatcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctatgataacgggacgccagtttcgtttgaggcgttgttgggatactacccttgtgttatggctactctaacccagataggcaatccctatcggagacagtgtctgacgggcagtttgactggggcggtcgcctcctaaaaggtaacggaggcgcccaaaggttccctcagactggttggaaatcagtcgtagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataagcgctgaaagcatctaagtgcgaagcccacctcaagatgagatttcccatgattttatatcagtaagagccctgagagatgatcaggtagataggttaggagtgtaattgtggtgacacatttagcggactaatactaatagctcgaggacttatccaaaaagagatattgacaacgttacggtttcttgttagactatagatattcaattttgagtgaataaggctcaatagttaagtgataattgcctaggagatacacctgttctcatgccgaacacagaagttaagccctagaacgccggaagtagttgggggttgccccctgtgagataaggtagtcgcttagcaaagggagtttagctcagctgggagagcatctgccttacaagcagagggtcagcggttcgatcccgttaactcccatagaagcgggtgtagtttagtggtaaaactacagccttccaagctgttgtcgcgagttcgattctcgtcacccgctttactttataagaaagtaaaaaccaagcaatagcttgggcgcgtagctcaggtggttagagcgcacgcctgataagcgtgaggtcggtggttcgagtccactcgtgcccatcaagaatatggtccgttggtcaaggggttaagacaccgccttttcacggcggtaacacgggttcgaatcccgtacggactattttttgttatatggaggattacccaagtccggctgaagggaacggtcttgaaaaccgtcaggcgtgtaaaagcgtgcgtgggttcgaatcccacatcctcctttaaagatatcgcgggatggagcagctaggtagctcgtcgggctcataacccgaaggtcgtaggttcaaatcctgctcccgcaataggctcggtagctcagttggtagagcaatggattgaagctccatgtgtcggcggttcgattccgtctcgcgccatttataccttaggagagatagcgaagaggctaaacgcggcggactgtaaatccgctccttcgggttcgggggttcgaatccctctctctccatagtaaacgggcatagtttaaaggtagaactaaggtctccaaaaccttcagtgtgggttcgattcctactgcccgtgttttttctaatatggcgggtgtggtgaagtggttaacacatcagattgtggctctgacattcgtgggttcgattcccatcactcgccttttcatggggtatagccaagcggtaaggcaagggactttgactccctcatgcgttggttcgaatccagctaccccagttttaagatagccggcgtggcggaattggcagacgcgctggactcaaaatccagtgtcctcacggacgtgccggttcgaccccggccgccggtatacttataaagacaaggtttctaaaccttgtcttttttctactagataatttattgtgaaatgttacttgtaatatatatttatttttttcattgtagaagaatttatataataataaatattaattattaatttaattagggcatttaaaatatacaaatgattttctgtttacatgttaagactaaaactataaaaatacgtgaaaattttgttatactaaaattaattttataatgttggtgaataatagttaatttcattatatacttgatatataaaatttatattctaagaaaagagaacatgatgagaaaatatataaaatggttaattcccatatcaatttttgggatgatacttggaggctgtcaaatgaatagtgaacataaaattcagtcaaacgaagtaaaaaatagcaagcaatcagaagtgaagaaagataaaaaaatgacaaaaaaagaacaattagcctatctcaaagagcatgagcaagaaatcatagattatgtaaaattacataacaaccaaattgagtccgttcaattcgattggtcaagtgtaaaagtagaacaaagcgggaatggaactccacaagggggtgattataatctttcactgagaggaaagtttaatcatctacaaaattcaaaattaatagttgatttttatttagctcataaaaatgatatcccaaatatcaaatcaatgggaatgctaaataagccgtatatacataaaaatggtatttggcacatttatgaatagcttgaatcatcctatataaagtaatagaatttttaccacaagcaaggtagaggagaagaataattgagtaattggaacttagataattttgataacttacatagctctttagcagaaagtgcatataatagtcgacctaattcatttcctgaattatttgagactgactcagtaacagaagtaaaattttctcaaccctcagaagataacaaaggtcaaatcacacagggtggcactaacctccccaatgatggtattgtctacctgcaaccagataagtccttaaaatctattgatgaaaatgtaaaggtcctcattccagatgtcaatggaggctatcacactgagcattatgttactcattcttatcaaaaaggtgtgcttactgacgataaggcaggttttaatgcttactacctgtcagatactgaaaaaatagatagcactacaaagcacacttatctagccattcgtggtagtgatgggattggtctagatacactaaacgattgggttagtaacaatgcaatgtttgctgtctctaacaagtatattccacaagcgaaattggctaataaggctatgaaagaaaaaattgccgagctaaaaggaaaagcgcctggagctattatagatgttactggtcactcactcggtacgattgtatcttctcaagcagttgttaatcttagctatgcagaattggagaatgttggtcaagtagtccttttcgatggccctgatgtatcaagaagcttggaaaaaatggaaggcatttctgctaaaaaaatccaagaagctgggaagcatgttacctactatgtcaatccctttgatatagttagtatgcttaatcgtgaaaagccatagaaagaccaattcgggaaagtaaatgtcattgttcctagtaaatatacgggtacttttgatgagcaatcttctcacgattttggtgccttccaaattgatagtagcggaaatcctttagttgcttctgaaagctatcatccagaattattaacatctggtcaagacttagctagactcgaaaaaaaattcataaagaatcttttaggagagcattatgattcggataagctaggaccagtactcaaaggcgctctgactggggacctgactcgactaattgcaacattaaaagcttgtggtatcagtgtcactgtaaacgaagctaaaaaactgtacgataacttccaaaaagactacaaagccataatttccaaagctaaaaaagatggcctcgagtgggatcgcaaaaacatcgcaagcttccatagtaggatcaaatcagcatcaggcagtcaacggattttacttagaactcaaatgctctatatggcaacgcaattagcagaatcagatgtttcagaaaaagtctctgcaacaaaaaaacatattagtgaagctaaggatacgattgtagaaatatcgacatccactatttcatcagctgaaataatggctatgcaccttgaccaatcagaagttgatgctctggtttcagatataaaaatgtcaacagtttggaatgatggcgtagagacttctgattatgaagcacttgatcactataaaacaaaaatgaccacatttacgaccaatttggtaacagttgcacaaaatttaacagctcaagatgagcaactagctggtgatattgtcacgaacttatcctaaaatagagagattaaatgaatgtccaaagaattgaaattgcccttgaatgaaatgttgaaagaacaagaaagaatagctattaaggcaatagttgctacagcaaaaagcactattacggatactggaacaaatttaaaagcaactttagagtcagatgcccaagacctaaaaaactatgcatccacctataacgccaatatcacggatggtcttgaaggccagtcagctcaagcagcatctgatttcttgacacaacttccaaaaccagagttagataatccagtcaattaggaggctagtatgatagatacaaaaaaactgcaagaactcgatcaagaatatgatcaaaatctcagaaacatttatcgtaacagagagcaactagaagatgactttcacttgtttatggcaagaacagacagcctaaaagagtctgtctatcaagcaactttaggacaaggttgggaattaccccaagaagctcatgcacacctatataatatggatgataataaggatacattcatatcagaattcaatgaatatatggaaaagcttgaagaaaaggaaatagatcttcgaagagtttataatgatagagtagatgaattgtatcagaaggctaagcaaaacgaagcaaaaaaaggataaaaattttttcaagtaatatatataaatatgaaaaataaagaatcttgcagtaaaatgagtatttatttttcacgacgaacagtcactacaaaatcactaaaatctcaaaattacttggtttttaagttaatgtctaatactcaaaccttgttaaatcaatgtttgttatctttaaaaagtgctcagtagcactcaaaatccattgtcctcacggacatgccggttcgaccccggccgccggtatacttataaagacaaggtttagaaaccttgtctttttctatttttttttaaaatcaataaccataagggtaccatttatagttttatactttttcaattagatattttgctatattatcatgatcccgaaaaagattcttacggttaattcctatattgtctaattctttcataattttcattttgttttgtactttaatagttttatagagataatgagtaaatatttatttaaatactgggagtttatttcacgataaataaaatttttactcaatagatgaacagaaaaagattgtatactattgaaaaatttaattcaactggagattgtttggtgagtttatataaaagattattattgtttcaaattattggattctttgtgaagttattaatggaattactttaaataaaggaggaaaaattattttaaaaagtttgacttgttgcattacttattattccaagaagaagatctattccatgagttagtagatataaagacataagcttgaaaattttcaagcttttttatcttgctatttataacattaagtgatatatttataacataatacatgtgatatatttataacataaacttgggagattttatgaacaataaaaacaaatggactataattttacttatttttactatcatcgtaattgatgttagcttactatttggcgggaatcgtttaagtttaccaatcaaattattaattttattagtaaccagtatagcagaattttgttcgatttttataatgataaaagttccgactcctcaaaaatataagaaagaaccatttggattaaaagcaaaattttattctattgtactctttctctcgactattctttatacaattgggatatggaatgtgacgccagcttccccatacaatgttaaagaatcaattcttggagttggcattttaatacaagtagttttcttcatttattttctattaaaaaaaattaacgaaagtcccgatgaacgcttttatagtaatttagcattgtcagcttctttgatgtttttgatatcaataatgttattaattcttatagctatttaccttaatatatatggaacgttagagttaaaatcaggctacctttatattatggtaggtttattattactaatgtttgctgttacatattactttcttgagggacggagataataatggggaaagaaacaaaaattatcagttctttaaaacaggttagagaagatatcggaatgactcaacaagagttagctattcggataggtgttaggagagaaacaattggtcatttagaaaataacaggtataatccttctctagagatggcacttaaaattgttaagattttcgacatgaagatagaagatatttttcaattaaggaaagaggattaaggtgaaggaagtaatttgttcgttttgtggggaaaagattttataacttataaataaaataaggggtacgcaggattgcttcctcttaataggatattagctactggcctagaagtacatcatgatatttgtagaaattgtggtactattgctagaagttatataaatgacttggagaaattgaaataggtatataaaatatattggttactcaaaaatcactaaaatctcaaaatttcttagtttttaacctgatttccaaaacacaaatcttgttaaatcagtgtttgtttactttaaaaagtgcttggtagcactcaaaatccagtgtcctcacggacgttccggttcgaccccggccgcctgtatactttaaaagataaggtttctagacctcgtcttttttgttttgttagataatttattgtgaaaagttacctaaaattacttatatttgttttttattattgtattttttataatgtagttaataacttttcaaggaggtaatattatggaaattttaattgaaacacacttatttatttactctggaagaaaggaaataaaaattgaataaattttttttagaatcagagagacttattataaggccactagaagaaagtgattatgatagttggtatactagttttatgaatcgtggaccatctttaactccatttgatgatgggatacttgatatgtctatgtgtgacattaattggtttaaaaatttagtaaatttacaaaggaaagaatgggaaagtgacatagtatatatatttggtgtttttctaaaaagcggtgagcacgtaggaatgttaaatattgttacccttgcaagagcagatatgcaatggggagaattgggatatgtttttcataatcaattttggagtaatggctatgcatttgagtcaatcttggcattacttaatagtacttatgaaaaattgggttttcatcatattgaagcacagattactcctgggaatgaacgatcggaaaagttggttagaagattgggattaacctatgagacaactcgaaaagatttttcatttgagaatggaaaatggacagataaactgatttatagtataaatttacataataataatttagaataattttatagacttacaaagaaatttaaagcttataatattgtatttttggagattattgaagtggtttatagataattaaggaaggaatattgattagaaatgaataatttggatacactatattgtaaattagcaatgtgcaacacagtactaacggaaagattacgactccagcctgttgaattaactaatgtaaatgattttttagaattttcatctgattctgaaacagtattctatatgcaacgttataaagctaataccgtagaagaagcacaagtcgttttagcaaatgtttgtatgaaatcaccattaggaatttatgcaatgattgaaaaagaatcacagaagatgataggtattattgaattagaaatcagagatgaattttctgcagaatttggttatattttaaataaaaattataatggaaaaggttatatgacagaagcttgttcaaaattgatgtcaattggatttgaacatctagacttggaaagaatttatgctagatttgacattaataataaaaaatctggaaatgttatggaacggataggtatgaaaaaagaaggcgagcttcgtcatcttgcaaaaaatccaaaaggtgagtggaaaacaagagcgtattattctattttaaaagaagaatattttaataaagttaatactaaatagtctgagatgtagagaattagatataatctttttaatcagccagtgggtgatgtcgttgaaaattttacggaaggtaaaaatccgaagattgatacacttaatgggaaaacagttagaatagaaaaaataaatccagatcattttgaagacttatttcaagtttatggagaattgtctactgaagatagtttaacttatatatcttttagcaaatttaatagtaagaatgaatttgatgtctttttccaaactctattaaaatcagaagatccttattatttagctattgttgataataatactggtaaagtattagggactttttcattaatgcgtattgatacaaaaaatagagttgttgaaatgggatgggtggtttattcatcaaaactaaaacaaacaaggatagcaacagaagctcaatatttggttatgaaatatgtttttgaagaactctgttaccgccgttatgagtggaaatgtgatagtttgaatgcaccatctaataattctgcaaaacgacttggttttacttttgaaggaacttttagacaagctgtcgtatataagggtcgtaacagagatacaaattggtattctattttagataaagagtggccagagaaaaaaacacggtttgaaaaatggctagatgattcaaactttgctgtaaatgggtatcaaatcagatcactatcaagcattgagcagaagacaaaatagagtcattcattaatcactaaaatttcaaaattacatgtttttttagctaacatcttaaactttgttaaataaatgtttattaacttttaaaggtgcatggtaggactcaaaatcgggtgtcctcacggacgtgccagctcgactttggtcgcgggcatcaaagaaaaaagtcaagattattatcttgtctttttttctatgagttattaactgtaaaagttacataaaattaccaaataaattttttaacaattaattatcattctttatctaatttataatagggcttatattctatgtttgcccctatacttgaagcatgtacccattctttttctttaagttgtttaaagttttcggctttacctgttaatattattcccgaaaattttaatttgtcgctattatttaccttgtcgtattttttggcatacttttctaaatctgagtagatatttatattattaaagtatacttttgagttaccttttaagttttcttttattttatctatgaatatttgtggtgtattcaaagtttcaggatctgtaccgaattgatactttgttggccaatatgatgtatctaattctgtgcttgtacctatccataaccaattttgttttatattatttggtatcattgtttttatttctttgtaactataggacttatcaaaagttattgcaatttcaataagatcattattcaatttatttacatattttaaatcatttgttggagttgttttggcttctccttttttatacttaacatttttattgaaaaattgtggaactttttgtctagtacctcgatcatacaagccattcttttctgatttttcatcagcatttgtgccaaaagtacctgagatactataattttcttcaaaactagaatatggaatttgaaccccatcgatatctttaaatctatcagcatgtactttaccagtaaactgaccgcttggctggtaatagagactatcataggaaatatttggatatgctatttcagaaagtagttcaaagttatgatatgttttttgaccattttttgaagttaaatatgtaaaccctttaaaagctattccaactactaatagtacagttattaatgccaatactacggtcttgaataatgttttccttttcctttttttggctaattgttccagtggatcactaaactttgtttttatcatattttaaaattatccttttctaaatattttttaacttctcttctagctcgcataagtcttattttaattgtactttgtgattgtccagtaatttcagatatttctttaattgaaaaatcattaaaataatataaatctattaaagtttgataatctttcttcaagtgtaatattgcttcatgtaattcaaaaaacttctctgattcggtgtaatacaaattattttctataaagaattctttttgcaggatttcgttatagcgtttatttcttcgataaagatcaatatacctcctaattgtagtacgatacatccaagcttttattttatcaagtggaagggagaaatcagattctagtatttgtaaaaagacgtcttgagtaacatcctgtgcttgactaggattaacacctgacttaataaggtaagctattatttgatgtgaaataactagtaattctttttcatagtcatctaaaattgacattttacctcctttcgctattatattaaaccctcttcattaatataacgaattaaagagagctttggttacataaaaaaataatttatatatattaaaaatcaggtgatggtaaaaattaaagataaaataataaacttgtttttagttcatatgttagttctaaataataatataaaatcgtaaaaattttgttagactaacattggttttaaaatcttgtaaaaaataattatttttattaggtacttgacataagaagtagtttttaagaaaagagagcatgatgaaaaaatatataaaatggttaattcccatatctattattgggatgttactagtaggctgtcaaatgaataggggacctaaaagtcagtcaaacgaagtaaaaaatagcaagcaatcagaagtgaagaaaggtaaaaatatgataaaaaagaacagttagcctacctaaagaacatgaacaagaaataatggtgaattatttaaatgtatcttttgatagagtagagtatacgatggtatttttaatgagatgtagagtagattgaatgctttctttaaatttagaagtattatctagctcagtaattttaatatttgtttttctatttgttttagttcttcctctagattttcaggctttatattaaggatatataattgaataaagaaagtaatgaactgtccgattactgctcgaagtatttccattttattcaacgaatttccttcacttaaacagttgaaaattttagtaatgtttggatcagttgaatttattagcttagtaaaaatagttgatgtttcactattgattaataattcttgcatcaatattttaatgagatcattatttttttcaataaatttaaaacggtcctgtacaaagaaatgaattagttcctctttagtagaaaatgtagataattctgtaaagaaggggcgtccaatagtttgtacgattaactcgagaataaagaccaaaagcttgtctttagtttcaaaatatttatatatagttgcttggctaacttctgcatttttagctagttgagcagtggaagttccatggaagccttgtgaggcaaagagctctatagcggataaaataactttttgttttccttttggcatctcttggtcattaatatactgttcaatagaaaaaataatattatttttcatacttagttccttttcaaatggtattatactttacggtatcgttttagtccaaagatatttgcgatggttaaaataattaaaaatagaagaagtaccagaagatttgaagaaacgttaggtaatccttgaccgtacataattatttttgtaagtgcatcaccagagtaggagagcggtagaattttaccgactgtctgagcccaacttgccatattttctagagggattattcctgaaaagaataattgaggcattataattaagggaataaattgcatcatttgaaattctgattttgctagagtagacattaagattcctaatgataaggcaaccagagccaaaataaaattgacaatgatgacactaaaaatactacctacaacttgaatatctagtagccaaatagttgataaaacgataactatcgtttgaataattgctagaatgccgtatgataacatatatccaaatacaatatcactacgtttaacaggagttgcaaggagtcgatcaagtgtaccagaagtacgctcttttaataaagccattccagaaattaaaaaaacaaagaagaagaccataaatcccattagtattggtatcatttttgcaaaaaagcctgtatttttatttccgtaattatatttttctttgatatatttggagcgagtttgtaaggattgtgctagtttcggattcttattagctaaaattttaacttgcgaaatcagttccttactgttcattgtattaacagcggttttaaaagcttgtcttgttaaagtcgtctttgaagaatctgtattcgcatagaagacagtataagatttattgtcctccgaaataagagcatcaattttatttgatttgagtgcttttttagcagatgagttaaatttaaatgatctcacttgaatatgcttaatattatctaaatttgaaacgaccttcgtgttaacgttaatagttccaatcttaacttttgtattactattcgcagaaaacataacattcatcaaaaacataattaaaataggtgctaaaaacatcatagcaagtgttcttttatcacgaaacagttcttttataaccttttcagttattgcaataattctcatgattattctccttcagcttttaagaaaacttcctcaatagtactcacattaaattgtttttttaaatgtaatggagtatcaaaggcaataatgtttccacgtaatagtagtgcaaccttacttgttaattctgcttcatccataacgtgggttgtaataaagatagaatgtccttcatccttaatattaattagctcttgccagatttttctcctcaaggatggatcaattccaacggtaggttcatctaggattaaaactgtggggtttccaagtagggcgatggctagagaaagccgtcttttcatacctcctgagtaacctgagacaaatttatcaagttggttttctagatctactactttagaaatatgagttatctgctgttttaattcagttttttgaatacctttcatttttccaaagaataataaattttctaagccagttaaagactcgtataaggcatcagattgagccatatagccaatttgatttaaaatattacgatctggcatttgagtatcaagaacaagagctgttcccttatctgctttttccatgccaagcatagttttaatcaaggtagatttccctgctccagagggtcctattaatccaattatttcgcctttaaacacctccaaattaatattatttaaaacggtttctgaggcatatgctttttgtagtttttttaaatcgatgacttttttcatgataactttttgctcctctctcagtgagtgagtgtttactcacttatttgatatcatatattatagtgtgtaaagacaggcttgtcaataaaagaattgacaggaagttaatataccataatagtcaataaaatggcttatttgagataactaattttttatcttaaaaatcagttgcatggagagcattcgtgaaaatgggcacagaataaaacgactaagaatatccttgtcgttttattttttatatagttatacctcttttaaaattcaatataatagacttcctgcgaaactaaaatcctagttcacggttgatcattccagcaatcaaattcattcgtaatccaaaccgtttgcgtcgatttcgataggttgttgaaaatattttaaacgtttttactttggcaaaaatattctcaaccttgattctctctttggatagcgtatggttataggttttatcttcaagagttagtggcttaagtttgcttgatttcctcggagtttgcgcttgtgaatacatcttcatgatcccttgataaccactgtctgccaagattttagcagcttgtccgatgtttctgcgactcattttgaacaacttcatatcgtggcaatagttcactgcaatatccaaagaaacaattctcccttggcttgtgacaatcgcctgagccttcatagcatgacatttctttttaccagaataattcgctagttgatttttttaggacgattgatttttacctctgttgcatccacaatcaccgtatcctcagcactaagatgagtttttgaaatcgtaaaaccactttgaataagagttgattcaacccattgacttcgacggattaagttgctttcgtgaatgccaaaatcagccgcaatttgttcataagtgcggtattctcgcatgtattgaagagtagccatgaggagatcttctaagcttaacttaggggttcggccaccttttgcgtgtttacgttgataagctgtttttaacacagctaacatctcttcaaaagtagtgcgctgaacaccaacaaggcgcttaaatcgtacatcagttaattgtttgcttgcttcataattcatagaactattgtaccatattttgtttcgcaggaagtctaataatgtttattcaggtattttttaacaatgatatgaagagagaagctaagtcccagtataattaaataaatccaaagggggatattaatgaaaggaagatgataatattttcctataaggatataagctatgataagcgaaagaattagaaatatatatcgaaagaaatatttcttttctttcgatttatcgaagttatatgtagcatatattatggtatcagctatcttgacagcaataatactgataaagattgcaaaaagaacatctaatagagtaatagggattagatctggtactgactgttgaagtgcttcagtaatgagatatcctcctaaaaagataatcatttggatagttagtagtaaaatggctaaatcccaacgttgtaatgtttcttctttcttagagattttaggtgtagatttaataacttggtttataaagtcatgcctatcttctccaaatacactaactaaacttgcttgtcgctcttgtgcttctaataacatattgacaatatcatttcgaatgagctcctgatggtaggggctaatgctagcacctcgcaaatagacaatcatatctgtataggtttggttattagagttatcaattcttccttctaatagcgtattttctttttgtaattttttcagtttatccatgctagtttcctctccaatttttagagtagtttgtttaatgctttactaagtgactcccaattctgtttaaattgggctaattgctccacgccttcattggttaacgtataatatttacgcttaggtccttgaggggaaggcttttgttgtccttttatatatttattgctttgtagtcttaagataatggggtagattgtcccttcggaaatttctccaaaaccataagaatttaatttttttgagatttcataagcataagtctcctcttgctgtatgatttttaggatagctccttcaagtaatccttttagcatttgcgatggaatcatattatatccttgtctatattgtaatacaagttactggtatagctacattgtaatacaaagtagttgagatgtcaaatataactaagttaccggtagaaaataagagtgatagacgatgattcttctaaaataggtttgtttatgtcctttagtttatgttataataatgtgaagaaactttaggagtgagtatgaaaatagataaaaaagaacttttagcacttattgctagtattattttattaatttttgcttctgttacgtttttcttatttaaagatcatggcactactcaaatggatactgtagaaagcagtgttaaccatgtcagtgattctcaattaactgaggcacaagatatgttagataaatttgagaagaaaccttcagaaaaattattgaaggatgtcgaacttgctttaaataaattgtccaattcttctaaaaaagaagctttgcaaaaacgttttaagaaagcaaaagataagtatcttaaagacgaagcagataagaaagctaccaaagatgctacagatttagtagaaattctagaacaagccccttcagaagaaaatgtgttaaaagctgaagcagcagtcaataagttaactgtcaaagaatctaaagaagctttacaaaaacgtattgatactgttaagacacaatatggtttgattgggaatcaaactccctctagttcagtagctgaaactacagaacaagggacagctaatcctgctagtcaggatacttctagttacgttaatcagaatgtagcaccaacttatgagcaaccgcaagcgaataatacaccagttactccaggggttaacaatactgttccgactccaggaactggtactgtacctgctactaatgggacaggtgttgctcagtaaaatcctgaaagtctagttttactagacttttttgctatgctttttaattagccattctcatcaaaaactataagagaattagcaattgatagttttgaagaaggaaaagaattatgagcaacagcaattaaaaccttaaaaatacaaccaagtgaagtggtttataacaagtgtacagttctttcttagaataaaccatgacttgtcaaaaaataggtatataccatttacaaaaataccttaaagcgttataatgagagtgaatggggggaagaagatgacgaagtacatcaaggctgaccgattcttttatgctgatcatgtaaaggaaaacggttatttagaaataaaagataatcactttggtaaatggatagaaaatatttctggacaagaggagattttagattattcaggttatcaaatagcacctggtttagttgatacacatattcatggttttgctggcgctgatgttatggattgtgattcagaaggaattttgcgaatgagtgctggcttactatctactggagtcacatctttcttgccgacaaccctaacttcagatacaaagcgactagaagaggcgtctaaatcagttgcggcagtagcgggcaaagaacaaggagcaaaaattcaaggcatctattttgagggaccatattttactgaggaatataaaggagctcaaaatccgatttatatgagaaatccaaacttggaagagtttgctcaatggcagaaggctgcaaaaggcttgattacaaaaattgctttggcaccagaacgtgagggagttgaggaatttgtctcagcaatcacaaagcaaggtgttacggtagctttaggtcattctaatgggacatataaagaagctaaaaaggcagtgaaggcgggtgcctcagtttgggtacatgcgtataatggtatgcgtggtttgacacaccgagaaccaggtatggttggtgcggtttataatttacctaatacctatgccgaactcatttgcgatggtcatcacgttgatcctgttgcttgtgacattttaatgacacaaaaaggccataatcatgtggcattaataacagattgtatggcagctggaggtgcccctgatggagattatatgttaggggaattgcccgtggttgtgtctaatggaactgcgcgtttgaaagatggaggtaatttagctggttctattcttaagctcaaagatggattaaaaaatgttgtagaatggggaattgctactccggaagaggcagtgcgtatggcgagttatgttccggcagtgtctgtaggcattgataatgtctgtggacagataaaagaaggttatgcagcggattttattgtattagataaacatctagatttagttgcaacataccttgatggggaaaaacgttggcaatcttgaaagaactagtttttactagttctttttaatttattaatttttaatgaaatatagtttgacaataaaactattttttcttataatgttgtaatataatacaaaacaataggagtttacaatgtcaattattattgggttaatggccgctatgtttattattcgtttagcttatttaaagctatctatagctaatgaaaaggccttaagaaaaaatggtgctaaagaatatggtgtaggtgtttcaaaagcaatcacagttcttcatattatcatttatttttcatctgtaactgaggctattctaacaaaagcaagttttaattttgttagcgtaatcgggcttagcttgatgattttttctgtgtttatgttacatacagtaacacgtttacttggtcgtatttggacagtgaaattaatggtagataaaaatcatcaatttgtagatcactggttatttagggttgttaagcatcctaactatttcttaaatattgctcctgaacttttaggtgtaactttattgtgtcatgctaaatacacagcattatttgtcttgccaatttatgcttttgttatttatttaagaattcgtgaagaaaacttattattaaaaacgatcattattccaaatggaatcaaaaagtctagggtatattaagaataagataaatagtagacataaaagtcattttttgttatactgtctcagtaagaagaggtgttcatcagctgtttttttagcgagctcaaggtagtgaaagttgggtagaataggatgaatattggcactttttagtgagtaaaagtacaatcaaaaatgaagtaataaattagggtggaaccgcgtctttgacgcccctgtgctgttgggcataggtggtgtaggacgtggtttttatcatttgtccgttttaagtcaattgttgtcaccttcccaacagctgtaataaagtgtgaaagaaggaaaatgatgtctaagaaattaacttttcaagaaattattctaactttacaacagttttggaatgaccaaggctgtatgttaatgcaagcttatgataatgagaaaggagcagggacaatgagcccttatactttcttacgtgctataggccctgagccttggaatgctgcatacgttgaaccatcacgtcgtccagctgacggccgctatggcgaaaatccaaaccgtctttaccaacatcatcaatttcaagtggtaatgaagccttcgccgtcaaatattcaagaactttatttgaagtctttggaattactaggtatcaatccacttgagcatgatatccgttttgttgaagataactgggaaaatccatctacaggttcagctggattaggttgggaagtttggcttgatggaatggaaataacacaatttacttatttccaacaagtaggtggacttcaaacaggtcctgtaacttctgaagttacttatggactagagcgtttagcctcttatattcaagaggtagattctgtttatgatattgagtgggcaccaggtgttaaatatggtgaaatctttactcagccagagtatgagcattcaaaatattcatttgagatatcagaccaagtaatgttacttgaaaactttgagaaatttgaaagagaagcaaaacgtgctttagaagaaggacttgttcatccagcttatgactacgtccttaaatgttcacacacctttaatttattagatgcacgtggagcagtatctgttactgagcgtgcaggctatattgcacgtatccggaatttagcacgtgttgttgctaaaacctttgttgccgaacgtaaaaaacttggtttcccacttttggatgaggaaactcgtatcaaattacttgctgaggaagactaatgaacacactcattgttaatagtcatcctgatttttcgaatccgtactcatttacaactattctacaagaaaagtttattgaactttataatgagcattttcctaaccatcagttatctattttaaatttatatgattgtgttttgccagaaattacgaaagaagtactactttcgatttggtctaaacaaagaaagggtttggaattaacagccgatgagattgttcaagctaaaatctctaaagatttacttgaacagtttaagtcacatcaccgtattgtctttgtttctccaatgcacaattacaatgtgactgctagagcaaaaacttatattgataatatttttattgcaggtgagactttcaagtacactgaaaatggttcagtcggattaatgacagatgactatcgtctgcttatgttagaatctgcgggttctatttattctaaaggacagtatagtccatatgaatttcctgttcattatttaaaagctatctttaaagattttatggcttttgatgatttctgtgttgttcgtgcagaaggtaccgatattttagataggcaagttgttcttgataagatgaatcaggatttaagagaagcatttgaagcgttttacagtaaggagtaggaaatgactaaagatttattattggagcttggccttgaagagttgccagcttatgttgtgacaccgagtgagaagcaattgggccaaaaaatggtcaagtttttagaggatcatcgtttatcatttgaaactgttcaaattttttcaactccacgtcgtttggctgttcgtgtgaaaggattggcagaccagcagacagatttaacagaagatttcaagggtccttctaagaaaattgctttggatgcagaagggaatttttctaaagcagcccaaggttttgttcgcggaaaaggtttaagtgttgatgatatcgaatttcgtgaagttaagggagaagaatatgtttatgtcactaagcatgaaactggaaaaagtgcgattgatgttttagcgagtgtgacagaggtattaacagaattgactttcccagtgaacatgcattgggcaaataatagttttgaatatattcgtccagttcacactttagtggtattattagatgatcaagccttagagctagacttccttgatattcattcagggcgtattagtcgaggacaccgtttcttgggttctgacactgaaatttcatctgccagttcgtatgaagatgacttgcgacaacaatttgttattgctgatgcaaaagaacgccagcaaatgattgttaatcaaattcatgctatcgaagaaaagaaaaatatttcagttgaaattgacgaagatttactaaatgaagtgcttaatttagttgagtatccgacagcattcttgggttcttttgacgagaaataccttgatgtacctgaagaagttttagtcacttcaatgaaaaatcatcaacgctattttgttgttcgcgacagggatggaaaattgttaccaaactttatttctgtgcgtaatggaaatgctgagcatatcgaaaatgttataaaaggtaatgaaaaagttttagtggctcgtcttgaagatggtgaattcttctggcaagaagatcagaaacttaatattgcagatttagttgagaaattaaaacaagtaactttccatgaaaaaattggttcactttatgaacatatggatcgtgtaaaagttatttcacaatatttggctgagaaggcagatctttctgatgaagaaaaattagctgtgcttcgagctgcaagtatttataaatttgacctcttaactggaatggttgatgagtttgatgaattacaaggtattatgggtgagaaatatgccttacttgcaggggaacagcccgcagtagcagcagcgatacgtgaacattatatgccgacatctgcagatggagagcttccagaaaccagagttggtgcaattctagctttagctgataaatttgacaccttactttcattcttctcagttggtttgattccaagtggttcaaatgatccatatgctcttcgtcgagctactcaggggattgtccgtattttggaagcttttggttgggatatcccacttgatgaattagtaactaacctttatggtctatcgtttgctagtttagattatgctaatcaaaaagaggtcatggcctttatttcagctcgtattgaaaagatgattggctctaaggtccctaaagatattcgagaagccgttttagaatcagacacttatattgttagccttattctagaagctagtcaagcattggtgcaaaagagcaaggatgctcaatataaagtttccgttgaaagtttgtcacgtgcatttaatttagctgaaaaagttactcattctgtattggtggactcttcattgtttgaaaataatcaagagaaggcgctatatcaagctattttgtcacttgaactgactgaggatatgcatgacaacttagataagcttttcgcacttagtccaattattaatgatttctttgataatacaatggtaatgacagatgatgaaaaaatgaaacaaaatcgtctggctatactcaatagccttgttgcaaaggcaagaacagtcgctgcttttaacttattaaacacaaaataaggaggcattttatggatcctaaaaaaattgctcgtattaacgagctttcaaaaaagaaaaaaacagttggattgaccggagaagagaaggttgaacaagcaaagctccgtgaagagtatattgaaggtttccgccgatcagtccgtcaccacgttgaaggaattaaattagtggatgatgagggcaatgatgttaccccggaaaaacttcgtcaagtccagagagaaaaaggactacatggtcgtagtttggatgatccaaattcttaatggtgagacaattttagattaaagtcaacacttgggtggggcaaaagataatctttgtctcgccttttttattaggaaggaaaaaataatgattgaattactattagcattactgttatggaatattttagtatttgcaacctatgctattgataaaaggcgtgcaattagaggggcatggcgtattagtgagaaaacattgatgatagagagtttattattagggggatttggtgcattcctaggtggagaagtttttcgtcataaaacgactaaatggtatttcagactagtttggtatatcggaatgattattgatttagctattatttggctaatttggtgttattgatgatatcttatcaaaaattttaggagcatattaaatttttgatagtgcaggatagactgatttaggtataatagaattacaaaaagaaaacgcttacttttaaggaggaagtttatgtcttcagaagaaaaatacattatggcgattgaccagggaacaacaagctctcgagcaattatttttaataaaaaaggtgaaaaaattgcgagtagccaaaaagaatttccccaaatttttcctcaagcaggctgggtagagcataatgctaatcagatttggaattctgttcaatctgtcattgctggagcttttattgaatcaagcatcaaacctggacagatagaggctattgggattaccaatcaacgtgaaacaactgttgtttgggataaaaaaacaggtcttccaatttataatgctattgtatggcaatcgcgacaaacagccccgattgctgatcaattgaagcaagaaggtcatactaacatgattcatgaaaaaactggtcttgtcattgatgcttacttctcagcaacaaaagttcgttggattttagaccacgttcctggagcacaggaacgtgctgaaaaaggagagttgctttttggaacaattgatacttggttagtttggaagttaactgatggtctcgtccatgttacagactattcaaatgctgctcgtacgatgctttataatattaaagaacttaaatgggatgatgaaattttagagttactaaatattcctaaagcaatgttaccagaagtaaaatctaattctgaagtttatgggaaaactactccattccatttttacggtggagaggtgccaatttctggtatggctggtgaccaacaggcagcattatttggacagttggcctttgaacctggtatggtaaaaaacacttatggtacaggttccttcattatcatgaatacgggcgaagagatgcaactgtctcaaaataatctattaacaacgattggttacggcattaatggtaaggttcattatgcacttgaaggatcaatcttcattgcaggaagcgctattcaatggttacgtgatggtcttagaatgattgaaacgtcaagtgagtcagaaggccttgctcaatcatcaacaagtgacgatgaggtttatgtggttccagcttttacaggtttgggtgcaccgtattgggattcaaatgctagagggtcagtatttggattaactcgtgggacaagtaaagaagattttgttaaagctacacttcagtcaattgcttatcaagtacgagacgttattgacactatgcaagttgattcaggaattgatatccaacaacttcgtgtagatggtggagctgcaatgaataatttattaatgcaattccaagcggatattttagggattgatattgctcgtgcgaagaaccttgaaactactgccttgggtgcagctttcttagccggactttcagttggctattgggaaagtatggatgaactaaaagaactgaacgcaacaggacaacttttccaagcaacaatgaatgagtctcgaaaagaaaaactgtataaagggtggagaaaagctgtcaaagcgacacaagtatttgctcaagaggattaagggggtgtagagatggaattttcacgagaaacacgacgtttagccttacaaagaatgcaagatcgtactctggatttacttatcataggtgggggtatcacaggcgctggtgtcgctttacaagcagcagctagtggattagatactggacttattgaaatgcaagattttgcagaagggacaagtagtcgctcaacaaaattggtccatggtggtcttcgttacttgaagcaatttgatgtagaagttgtttctgatacagtatcagagcgtgcagtcgtgcagcaaattgcaccacacattcctaagccagatccaatgcttttaccggtttacgatgagccgggttctacttttagtatgtttcgccttaaagtggctatggatttatatgatttattagcaggtgtgacaaacacacccgcagccaataaagttttaagcgcagaagatgttcttaagcgtgagcctgatttacaaaaagaaggtttgctaggcggaggggtctatttagatttccgtaataacgatgcacgcctagtgattgaaaatattaaacgcgctaatagggatggagcttatattgccagtcatgtcaaagctgaggacttcttatttgatgacaacaatcaaattataggagtacgtgcgcgtgatttgttgactgaccaagttatcgatataaaagctaggcttgttattaatacaactggaccttggagtgacaccgttcgcaacttctccaatgaaggtaaacaaattcatcaattacgtccaactaagggagttcacttagttgtagatcgccaaaaattaaatatttctcaacctgtttatgttgatacaggcctgaatgatggtcgtatgatttttgttttgccacgtgaagataagacttattttggaactacagatactgattaccatggagacttagaacatcctacggtaactaaagaagatgttgactacctccttaatattgtaaacaaacgcttcccagaagcagagcttactattgatgatattgagagttcatgggcaggtttgcgtccactactatcagggaatagtgcctctgactataatggaggcaatagtggaaaactaagcgatgaaagttttgaagaattaattgattccgttaaagattatattgcacataaaaatcatcgtgaggatgttgaaaaagctatttctcatgtagaatctagtacttctgaaaaagaattggacccatcagctgtttctcgaggatcaagttttgagcgtgatgataatggcctattaacacttgctggtggtaaaattactgattatcgaaaaatggcagaaggtgccatggaaactattattaacattttggataaagaatataatcgcaagtttaaactaatcaattctaaaacctatcctgtttcaggaggagagattaacccatctaatgttgattctgaaattgaagcttatgctcaattgggcacactaagtggtttaagtattgaggatgcacgttatattgctaacctttatgggtcaaatgcaccaaaattatttgcattgacacgccaaattacagaagcagaaggtctgagcttggtagaaacgttgtcacttcactatgctatggattatgaaatggcgcttagcccaacggatttcttcttaagacgtacgaaccatatgcttttcatgagagataatttagattctttgattcagcctgttattgatgagatggctaaacattatcaatggtctgatcaagacaaaactttctatgaagaagaattacatgagactctaaaagacaatgacttggcagctttgaaggataattgaaggagataataatggatatttttggagaattcttaggaacagctctcttagtcttacttggtaatggtgttgtagcaggtgttgttttgcctaaaacgaagaatcataattctggatggattgttatcacatttggatggggacttgctgtagctattgcagcgttggtatctggcaatattagccctgcccacttgaatccagctgtgtcattagcttttgcgatcaaaggtgatttagcttggggaacagctattctttatatgattgcacagattattggtgcaatgctaggttcacttcttgtttatttgcaatttagaccccattatgaggctgcagaaaatagagcagacatccttggaacttttgcaactggtccggctttgaaggataatttttccaattttttaagtgaagtattgggaacacttgttcttgtacttactatttttgccatcggaaaatacaatatgcctccaggagttggtacgatgagtgttggtatgttagtggttgggattggtctatcgctcggtggaacaacaggttatgctattaatcctgcacgtgattttggtcctcgtttattgcatgccttgttaccgatgaagaacaaaggtgattctgattggacttattcatggattccgatagtaggacctatggtaggagctattttagcagccttaatatttgctatgatgtaagagatttttgatgctgagaccgactttatggtctcagttttttgttaccgttttcaaaaataacttcttttgttataataagtaattatgacagaaaaatatgtaaataaagtaattgtcattttaggagcttcttttgctggtatgacttgtgcgcagaaattacgccaattaaatcctaattgggatatcgttttgattgataaagaaattcatccagattatgttccaaatggcttaaattggtattatcgtcacgaaattagtggtttaaatcaggccatgtggcagacagaagaagagcaacggttgcagaatatacgctgtctatttggtctaaaagttgagaaaattaataaagaagatagggaattaatgttatcagatggttcttctgtctattatgatcaattgatttgtgccatgggctcccaagcagaatcaacttatattgatggggctgatgcgcaaggtgttttaacaacaaaaacttatgcaactagtcaaaatgctaagcaggtattagataaaagtcataaggtagcagttgttggggcaggtatcatcggtttagatattgcttatagtttacatgaatcagggaaggcggtcactttgttagaagctcaagaaagaccagacttcaggcatacagatcctgatatgtcccttcctttacttgatgcgatggctgaatcaaaactacattttttccaaaatcaaaaggttgagaaaattactgtaacccgagaagaaaaactttgtttgcgaacgctaacaggagacacctttacagttgatgctgtcatattagctgttaattttcgtccggatagtcgtcttttaactgggttggttgatttaagtgttgataatagtgttgttgtaaatgattatttccaaacgagtgaccctaatatctatgctattggcgatttgatttggtcgtattttaaaggtcttaatagtgcttattatatgcccttaattaaccaagcaatccgttcggcacaaatgttggcataccatttatcgggacatgctgttccaaaattaaaaataacacgcgctacaggatctaaacactttggctattatagagctaacattggattaactgaattggaagctggtttttacgaggataccgttagtgttacttatttccctaaagaacagtatgatttaaggataaaattgattgctaaccaaaaaacgggccatttattgggggctcaattaatctcaaaggaaaattgtttggctactgccaatcagcttgttcaagctatatcgtgtgatatgacagattttgatctggcttttcaagatttcatttatacagctagagaatctgagatggcttatatgttgcatcaagcagctatcaacctttatgaaaagaggattgggctatgcgaatagaagctctaatggaaaaagaaaggcgtgttcaatatcggctactttcttttttaagaggctctcctcaggcaatagcactgaagttagctttattagaaactggtttaagtcgagcaacttttcttaaatatatcaataatcttaatagctactttgaacaagaaaaagttaattgtcgaatcgtttattataaggataagttatttttagaagaggattataacttatccaatcaagaagtgttgaaagctctgatgaaagatagtattaaatacactatcttaatatctttatttaatcagcgtcagttcacaatcgttggtctttctcaagaattgatggttagtgaggctactttaaatcgtcatcttgctcatctcaatgaattgttagcggaatttgatattgctatttcacaaggaaaacagattggtgatgaattgcaatggcgttatttttattatgaattattcaagcaactatggtcttatgacaagtgccaaaatatgataaagaaattagacttagactcattaattctattaatagagcgcttggctcaacatactttaactcgagaagctcatcaaaatctgggactttggtttagtatttgtcatcatcgtctccttgctatggaaaaaatatctgataatctcaagcctattgtgaaacattatcaatgtaatgctttttataaacggttagacgcagccttagttttgtatatgagtcgttttgctcttgagtatagggaaggagaagttctggcaacttttgcttttctacattcacaaaatattttaccaatcaatacaatggaatacatcatgggatttggaggcccgattattgattgtgtaaccgaaacaatcatctactttaaaaaggagagtattttagctgacgagacatcagatcaggttatttaccaacttggtcagttatatagccattattatttctttaaaggtcatattttagttgaacaacctgatttagaacaaacgtatcgacttattgatcataatatgagggataagttgcatcatatttcaaagaagattattgcaaatgttaatcgaattagacctttaacagaagatggttgttctttgctgactttacatttgttggaattgcttattttctcgaaaaatagtcaaaaaatgccctttaggattggtctagatatgacaggtaatgctgtggaacagtcattgttggaatatcgcattcgacaacatttctctggtaataattctattcaagtcgaaccttatgacgaaggaaagggatttgatatggttatttatcagagtcactcaagaccttataaagccaaactaacctattgccttaataaaggtgcttcagagcgagaactacaggaaatagattcacttatttatgacaattaatcccattacttaattgaatggttttaatccctccagaaattgttaaaacgtttacgtattttatgttataatatcaaagacgaacaattttaaatttagttgttaaaaacagaaaggttttatcatgacatttgacaccattgatcaattagcggttaatacagtccgcacgctttctattgatgctatccaagcagcaaattctgggcacccaggtcttcctatgggagctgcgcctatggcttatgtgctttggaataaattcttaaatgtaaacccaaaaacaagtcgcaattggacaaaccgtgaccgttttgtgctatcagctgggcatggttcagctcttctttatagcctacttcatttagctggctatgatttatcaattgatgatttaaaacaatttcgccaatggggatcaaaaacacctggacatccagaagttaaccatactgatggtgtagaagcaacaactggacctttagggcaaggtattgctaatgctgttggtatggcaatggctgaagctcatttggctgctaaatttaataaaccaggctttgatttagttgatcattacacttatacacttcatggtgatggttgtttgatggagggtgttagccaagaagctgccagtcttgctggacacttaaaacttggtaaattggtccttctttatgattcaaatgatatctcacttgatggtccaacatctcaatcatttacagaagatgttaaaggacgttttgaatcatatggttggcaacatatcttagttaaagatggtaatgatttagaagcgattgctgcagcaattgaagctgctaaagctgaaactgataaaccaaccattattgaagttaaaactattattggatttggcgcagagaaacagggaacatcttcagttcatggagcgccacttggtgcagaaggtattacttttgccaagaaggcttatgtatgggaatatccagactttactgttcctgctgaagttgcagatcgatttgcctcagatcttcaagcgcgtggtgcgaaggcagaagaggcatggaatgatctttttgctaaatatgaagttgagtatccagaattagcaactgaatacaaagaagcttttgctggccaagctgagacagttgaactgaaagctcatgacctaggttcatcagtggctagtcgtgtttcaagccaacaagctattcaacaattatcgactcaattaccgaacctctggggagggtcagcagacctctcagcttctaataacacaatggtagcagcagaaacagatttccaagcaagtaactacgctgggcgtaatatttggtttggtgtacgtgaatttgcaatggctgctgcaatgaatggaattgcgcttcacggtgggactcgtgtttatgggggtacgttctttgtcttctcaaactacttgttaccagcagtacgtatggctgcacttcaaaacttgccaactgtctatgttatgacacatgattctattgctgttggagaagatgggccaactcatgagccaatagaacaattagcatcagtgcgctcaatgcctaatttgaacgttatccgtcccgcagacggtaatgaaacaaacgctgcatggcaacgagctgtatcagagacagatcgaccaacgatgcttgttttaacacgtcaaaacttaccagttcttgaaggaacatcagaattagcccaagaaggggttaataaaggtgcttatattttatcagaagctaaaggtgaacttgatggtatcatcattgcaacaggttcagaagttaaattagctttagatactcaagacaaacttgagtcagagggcatccatgttcgcgtcgtatctatgccagcacaaaacatttttgatgaacaagaggcttcatatcaagagcaagtgcttccatcagctgttacaaaacgtcttgctattgaggcaggatcaagcttcggttggggtaaatatgttggtttaaatgggctaacacttactattgatacttggggagcatcagcaccaggtaacagaattttcgaagagtatggctttacagttgagaatgctgtatcgctatataaagaactttaagagcatgaagaagttgggaaagatacctcaacttcttttttgtaagatataggatggatttgagaatagttttgatagactgataagtgatggaaagcactcttttttgaaaacgtttgacaaacattccatagcgcagtataattgataaaactattgtatatataaaataatacaactattattaattatctttttagaaaggtttgtttatgaagaaggagtgtcgtgatttttatcggcagatacagcatacttacaatgatatatctgtccgtgaagatgcagtgctatcatcaatactattatcagcatcgaatggtttgataaaaactagcgatgtacctcgtgttgcttatgagttaactcagcaattggaaaataatgagatagaaaaatctttcgagtcattagctacagttaaggaattgaaaaaatctgctaaaaaattgtctgagagatatgagcaaaataaggtaacaacgggattgctttctaaagtatttggaaatcattaggagataaaaggagatttttatgattaagtttgaacatgtttcgaaagtatacggagaaaaagaagctctcagtgatttaaccctctctgttaaagatggtgagatttttggattaataggtcacaatggagcaggaaaaacaacgacaattagtattctaacatctattattgatgcaacttatggccaagtctatattgatgacctacttttgacagaacatcgtgaccaaattaagaaaaaaataggttatgtaccggactcgccagatattttcttaaatttaaccgcagaggaatactggtactttttagctaaaatttatgacgttgccccagaagatattgaagcacgtatcacaaaattggtagacatatttgaactagaggagcaacgctataatcctattgaaagtttttcacatggtatgcgtcaaaaagtcattgttataggtgcccttcttccaaatcctgacatttggattctagatgagccgttaactggtttagaccctcaagcttcttttgatttgaaagaaatgatgaaagaacatgctaaaaatggaaaaacagttattttttcaacacatgtcttagcagttgcagaacagttatgcgacagaataggtattttgaaacaagggaaattaatctttgtcggtagcttaggtgagttaaaaatgaaatatccagataaagatttggaaactatctatttggaattagcaggacgtcaagctagtagggagggataaagtatgaattggtcacgtatctgggaactcgtaaaaattaatatcctttattcaaaccctcagactctatcggcactaagaaaaaagcaagaaaaacatcctaaaaaagaattttcagcttataaatccatgtttagaaatcagttatttcagattttgctcttttcaataatttatgtatttctctttgtatcacttgattttaaagaatatccgggctacttcacgttctacattggtatctttacactagtatccattatctactcttttattgcgatgtacagtgttttctatgagagtgacgatgttaaacaatatgcttatttgcctattaaatctgaagagctctatgttgctaaaatttttgcaacatttgggatgtctgtaacttttctaatgccaatcctaaccttaatgattgtggcttattggcgtataataggtggcccacttgcggtcctcctagcaatcataaattttgctattttatttttatcggtaacggtgatttcattgtatattaatagtttaataggccgtgccattattcgaagtgctaatcggaaacttatttctactatattaatttcactagctacatttggagcaatagttcccttattatttgtgaatatgacgagtcaaaagatggtacaagggaaattacaagatatcgctccaatcccttatgtcagaggttattatgatattgttacagcgccatttagtatggagagtctcctcaactattatctcccgctcttaatcattttattcttgataggtgctatttataaatgggttatgccacgctactatcaggagttgttgtatggacaggtcaagcagagaaaagtccatcgtcaaatcgattttagtaaacgtgagtcaattaataaaactcttgttaaacaccatttatcaagtttacaaaatgcgacattattgacaaatacatttttaatgccactattatatctagcaatgttcattgttccaattttgaataatggtaaagagattggtcgattttttaatgaaaattattttgggatagcttttctagcaggaatattaataggtagtttatgtgtgatgccagctagcattgtaggggtaggtatttctttagaaaaaagtaatttctactttataaaaagtttgcctatatcattttcgtatttcttgaagcataaatttgtaactttgataaccttacaacttgcagttcctacttttatttatttcttggtaggattctttctacttaaactatcaatcctcgttttattgagcttcattttaggtctagtcttcatgggacttatcgaaggccagtttatttatagacgtgactataaacatttgttcttgaattggcaagaggttacgcaactatttaatagagggttaggccaatggctgttagttggttcattgtttggaatgatgataataggtagttttcttattggaataagtattttttggtcaatggtatggaatactgtagctgtcaatatcataatccttatcattgggttgctcatattatcaatttgccaatacttactgctaaaaaatttttggaagaagcttgtttagtaaaaaggttttagaaaaatcatacagtaagaataatgcttaataactgagatagttatagcggataaaataaaggcttgttgtggactttacggttggaaggcagccactgtaatcctttgtttaataacgctagttttagctctaaaatatttgatttttattgctatctattatatcttatcagacaaagagactagggataacctagtctctttgtctgatgctaacttgtttttcgtaatattgtgctagaatgaatgtcaatatagcagttgtgcttacagtaatgataactgcaataagcatggtaataaaaagatgtgttgaagtatgactgatataaagaaacagacctggtagaccagaagagcctacagcgaagcggtgagcgttcattataccggcatagagtcctccaagaccaccaccaataagtgaggctattagaggataacgtttcggaaggttgacaccatataagataggttcggtgattcccatataagctgttatggcagcaggtccagcaatttctttaagttttttttcttttgttataagagtcaccactgtacctgcagttgcttgtgcgatatttgagcagagcatgcctggtccaaaaatagaatcaacccctaatttcgctagttgtgtgattcctaatgcagcaattccactatgaacaccaaacatgattaggataggagcaaatgctcctactagaaaagcaggtgcccaactggcgtatttggataaaaaagtaaaaataacagctaaatattggccagcgatagtacccattggtcccaatatagagaacgacaaaattcccatgctgagaaatattaacataggaacaagcactaaacgcagtgatttaggaataatttgctttaaatatttttctatataagcctgaacacaaataattagaataatgggaatgacacttgatgcatagttagtaagtgtgaatgggatcgtatggaataaggatactggtttaccagaagctactaaattagcccaattagggtgaaggagcatgacaacagttcccaaagctaaaataggattagctttcaatttttgagcagctgtgatggcgattaagataggtaaaaaatagaaaacaccatctgcaaaaagatttagtaatatatatgtttgagatgacggtgtcaagattttgaatactagtaataaagctagcaatgccttaatcataccagcgcctgataaagcaggtaaaatcggttggaaagtcccagaaacaaaatcaataattcgactaactgctttggcttttttggtttgttctattttagtcgttgagttagtttcaatgagggagttaatttcttcaaacacttttgcgacatgagtccctatcactatctgatgttgccctccgctgataacgacagtttttacctcttttaaagtttttaattgctcaaggtttactttcgtcggatcattgagactaaagcgaaggcgtgtttgacaatggtaaacattgttaatattattttgtccaccaaggtgtttgatgatattttttgacaaggtgatgtattctctagacataatatctccttaatacttataaaacgttttccgattctagattatagcatagtaataaaagaaaacacttggaaatgcttgtgaattttcaatgatgttttcagatagcatttctaaagggcctatgatataatttttttatgaaaagacattttgagacaactagaagaattgttattaaagtaggaaccagttccctcgtacagacaagcgggaaaattaatttaagtaaaatagaccatttagcatttgttatttctagtcttatgaatagaggcatggaggtgattttagtatcatctggtgctatggggtttggtttagacattttgaaaatggataagcgtcctcaagaaatatcacaacaacaagcagtttctagcgtaggacaagtagccatgatgagtctttattctcagatattttcgcactatcaaactcatgtttcccaaattttattaacacgtgacgttgtggtttttccagagagtttgcaaaatgtaacaaactcttttgagagtctgctctctatgggaattttgccaatcgtcaatgagaatgatgctgtcagcgtggatgagatggatcataaaacgaagtttggggataatgaccgtctctctgctgtcgttgctaaaattactaaagcagatttattaattatgctgtcagatattgatggtctttttgataaaaatcctaatatttatgatgatgctgttttacgtagtcatgtttctgaaatcaccgatgacatcatcaagtcagctggaggagcaggaagtaaatttggtactgggggcatgcttagtaaaattaaaagtgcacaaatggtgtttgataacaatggacaaatgatattgatgaatggcgccaatcctcgtgatattttaaaggtgttagatgggcataatattggaacttattttgctcaaggaaagtgagattgagttatgacgtatattgaaatattagggcaaaatgctaaaaaagctagtcaatcagtagcacgattaagtacagctagtaaaaatgagatactcagggacttagcgagaaacatagtggctgatactgaaaccattttgactgagaatgctcgcgatgttgttaaggcaaaagataatggtatctcagaaattatggtggaccgtctacgactaaacaaagaccgcatacaggcgatagcaaacggtatttatcaggtagcagatttggcagatccgattggtcaagttgttagtggttatacaaatttagatggtttaaaaatccttaaaaaaagagtgcctttaggggttattgcaatgatatttgaaagtcgtcccaatgtatcggtggatgcctttagtttagcttttaaaacagggaacgctattattttgcgtggtggtaaagatgctattttttcaaatactgccttggttaattgtatgcgccaaacattgcaagatacaggccacaacccagatatagtacaattagttgaagatactagtcacgttgtagcagaggagttaatgcaggcaacagactacgtggacgtcttaattccaagaggtggtgcaaaattaattcaaacggtgaaggaaaagtcaaagattcctgttatcgaaacaggtgttggaaatgttcatatctatattgatgaatttgcagatttagatatggcagctaagattgttattaatgctaaaacccaacgccctagtgtctgtaatgctgccgaagggttagttgttcatcaagctattgctaagggatttttatctcaattggagaaaatgctcaaagaatcgaaccagtcagttgaatttcgtgccgatgaggaagctttgcaacttttagaaaatgctgttgctgcaagtgagtctgattatgctactgaatttttagactatattatgtcagtaaaagtagtagattcttttgaacaagcaattagctggattaataaatacagtagtcatcactcagaagctatcattactaataatatcagtagggcagaaatttttcaggatatggtagatgcagcggcagtttatgttaatgcttcaacacgttttacagatggtttcgtttttggactcggagcagagattggtatttcgactcaaaaattacacgcgcgtggaccgatgggattagaagctttaacaagtacaaaatactatattaatggaactggtcaagtaagggaatagttgacctataataggagagattgcatttatcggtctctcttttacttttctaaagtttaggatttatggtacaattaaagttatgacaaacgattttcatcatattactgtgcttttgcacgagactgtggatatgcttgatattaagccggatggtatctatgtagatgctactttaggtggggcaggacacagcgaatatcttctttcacaattaggcccagatgggcacctttacgcatttgaccaagaccagaaggctattgacaatgctcatatacgtttaaagaaatatgtggataccggtcaagtaacctttatcaaagataatttcagaaatctatcttctaacttaaaagcattaggagtgtcggaaattaatggtatttgttatgatttaggtgtatcaagcccacagctggacgagcgtgaacgcggtttctcatataaacaagacgccccccttgatatgcgaatgaatagagagcagagtcttacagcttatgacgttgtgaacacttatagttatcatgatttagtaaggattttctttaagtatggcgaagataaattttcaaaacaaattgctcgaaaaattgagcaagtacgagctgaaaaaacaatatctacaacaacagaattggctgagattatcaaatcgtctaaatctgccaaagaactgaagaaaaaaggtcatccagctaaacaaatttttcaagctattcgtattgaagtcaatgacgaactaggagctgcagatgaatctatacaacaagcaatggacttattagctgttgatggtcgtatatctgtcatcacttttcattctttagaagatcgtcttactaagcaactttttaaagaagcatcaacagtagaagtacctaaaggtcttccttttataccagatgatttacaacctaagatggagctcgttaatcgtaaacccatcttaccaagtcaagaagaactagaagcgaacaatcgtgcccattcagcgaaattgagagtagcgcgtcgtattcgataataagaaagaaacttatgacaaatgaaaaacgaactgaagcagtaacacaaactttacaacgtcacatcaagactttctctcgtattgagaaagctttttatggtgctattgtaattactgctattatcatggcagtcggtattatttacttgcaaagtaatagtttacaagttaaacaagaagtaaatcaattaaatagtaaaatcaacgataaacagacagaatttgacaatgctaaacaagaagtaaatgagctttctaatcgtgatcgaattactaaaattgctaaagatgctggtttaacaattcaaaacgacaatatttatcggaaggtggactagtctgtgactttttttaaaaagctaaaaaaaatcttccttgattatgtgatccatataagagataggcgttcgccgcagaaaaatagggaaagagtaggtcaaaatctgatgattttaaccattttcctatttttcatttttatcatcaactttgtcatcatcgttggtacagatagtaaatttggggttaatttatccaaggaagccaagaaagtctatcaacaaagtatgacagtacaggcgaagcgtgggacaatttacgaccgtaatggaaatcctatcgctgaggatgctacgacctatagtctctacgctattatctcaaagaactatacgacagctacaggtcaaaaactatatgtacaaccttctcagtatgaaaaagtagctagtatcttagagaataaattgggcatgaagaaaaatcttgtcctaaaacaactcaatcaaaagaaattgtttcaagtttcctttggaagttcaggttcaggattgtcttataccaagatggctgacatcaagaaaacgatggaaaagtcagatatcaaaggaattggtttttctaccagtccggggcgtatttatccaaatgggatatttgcttcacaatttataggatttactcttcctcaggatgatggagatggaaaaaaattagttggtaatacaggccttgaagcggcacttaacaaggtattatcaggtactgatggtaaagtaacatacgaaaaagaccgtagtgggaatgttcttttaggtactgcaacaacagaacgtagggcggttaatggtaaggatatctacacaactttatcagagcctattcagactgttttagagactcagatggatgttttcgcagaaaaaaccaaaggaaaatttgcgagtgctacagttgtcaacgctaaaacgggtgaaattctagcaacgagtcagcgtcctacttataatccttctacccttaaaggttacgataagaaaaatttgggtacctataacacactactatatgataacttttttgaacctggttcaacaatgaaggtaatgactctagcctctgcaattgattctaagcattttaactctactgaagtgtataacagtgcacaatataaaattgcagatgcgattattcgagattgggatgtcaatgaagggttatcatctggtagttatatgacttttccacaagggtttgcacattccagtaacgttggtatggtaaccttggaacaaaaaatgggacgagataaatggttaaactatctttctaagtttaaatttggttacccaacacgttttgggatgcttcatgaaagtggaggtttgttcccatctgacaatgaagtaactatcgctatgagctcatttggtcaaggtattggtgtaacgcaagttcaaatgttgcgcgcatttacgtctatctcgaatgatggtgttatgttacaaccacagtttattagcagtatttatgatccaaatacagggacttctcgtacagcacgaaaagaagtcgttggaaaaccagtttccaaagaagcagctagtaaaacacgtgattatatggttactgttgggacagatccttattatggtacattatacgcagcaggtgccccagttattcaggtggggaatcaatcagttgcagtaaaatctggtactgcccaaatcgcccaggaaggtggtggtggttatctgcaaggaaaaaatgatactattaactcagttgtggctatggtgccatcggaaaatcctgacttcatcatgtatgttaccatccaacaacccgaaaaatttagtatcacattctggaaagatgttgttaatcctgttttagaacaagcaacagcaatgaaagaaacgatattaaaaccgggattgaatgactcagaacatcagacaaaatataaactatcaaaaatagttggtgaaaatccaggtcatgtagcggaagaattacgtcgtaatctggttcagccaattattttaggaaatggtagtaaagtttctaaagtatctaaaagaccaggagctaatcttgctgagaatgaacagctactagtattaacaaataaactgactgaattacctgatatgtatggttggtctaaagcaaacgttgaacagtttgctaaatggacaggtataaaagtgacctataaaggttcaacctcaggtaaagtaagaaaacaaagtattgatgttggaaaatccatcaataaaattaaaaaaatcaaaattacaataggagattaacatgtttttaagtataatggcaggtgtcatagcatttgtcctgacagttattgccattccgcgcttcattaagttttaccaattgaagaaaattggcgggcaacaaatgcatgaagatgtcaaacaacatctagccaaagcaggtacgccgacaatgggaggaacggtatttttgattgttgctcttcttgtctcacttatttttagtattattttatctaaagaaaatagtggtaatttaggtgcaacttttggtattttatctgttgttctcatctatggaattattggttttttagatgattttttgaaaatttttaaacaaatcaatgagggcttgactccaaagcaaaaaatgtcgctccaactaattgcgggtctaattttttattttgtccatgtgttaccaagtggcacatctgcgataaatatttttggtttttaccttgaagtaggatacttatacgctttttttgttcttttctgggttgttggtttttcaaatgctgtgaacctaacagatggaattgatggtctagcttctatttcggttgttatcagtttgattacttatggaatcattgcttataatcaaacgcaatttgatattttattgattatcgttatcatgattggtgctttacttggcttttttgtctttaatcataaaccagctaaagtctttatgggagatgttggttcacttgcattgggtgctatgttagcagccatttcaattgccttacgtcaggaatggaccttgctttttatcggctttgtctatgtttttgagacgtcttcagtgatgttgcaagtagcatactttaagtatactaagaagaaaactggtgttgggaaacgtatcttccgcatgacaccatttcatcaccatttagaattaggtggtgtgtctggcaaaggtaataaatggagcgaatggaaagtagatgcttttttatgggctattggtattttcatgagcgctattacacttgctattttatatctttaaactttattaggggatgtggtatggactgccagattcccttttgctttcttgtagcctttaatggtataatgaacataataatagtaaggaaatagacatgtcatttaaagattttaattttaaaccatacattcagagggctctcgatgagttaaaattcgtcgatccaactgatgttcaagctaaattgattccagttgttcgttcaggccgcgatcttgtgggggaatcgaaaactggttctggtaaaacccacacctttttacttcctatttttgagaagctagatgaaagtagtgatgatgttcaagttgttattactgcaccaagtagagagttgggaacacaaatttatcaggcaactaaacaaattgctgagcattcagagcaagaaatacgggtggttaactatgttggtggtactgacaaattacgtcaaattgaaaagttgaaagtaagccaacctcatattgtcattggaaccccaggacgaatttatgatttggtgaagtcaggtgatttagctattcataaggcgcatacttttgttgttgatgaagcagatatgactctagatatgggatttcttgataccgttgataagattgcagggtctttacccaaggatgtccaaattttagtcttttcagcaacgattccacaaaaattacagccatttttaaagaaatatttgaccaatcctgtaatggaaaaaatcaaaacagcaacagttatcgctgataccatcgataactggcttttgtccactaaaggacgtgataaaaatgcacaaattttggaactctctaaactaatgcagccctatcttgcaatgatatttgttaatacgaaagagcgtgcagacgaattacattcgtacctttctagtaatggcttaaaagtagctaaaattcatggtgggattgcacctcgtgaacgtaaacgtattatgaatcaggttaaaaacctcgaatttgaatatatcgttgcaacagatttagcagcgcgtggtattgatattgaaggtgttagccatgttatcaatgatgccatacctcaagacctatctttctttgtccaccgtgtcggtcgcacaggccgtaatggcttatctggtactgctataactttatatcagccaagtgacgattctgatattcgtgaacttgaaaaactaggtattaattttattcctaaagtcattaaaaacggtgaatttcaagatacatacgaccgtgatcgtcgtaataaccgtgaaaagtcctatcaaaaattagatacagaaatgattggacttgtgaaaaagaaaaagaaaaaaataaaaccaggttacaagaaaaaaattcaatggaaagttgatgaaaagcgtcgcaaagagcgtagagcaagtaatcgtgctaaggggcgtgcggagcgcaaagctaaaaaacaaagtttttaaaattattaaagtctgaaatcagctcgtttcaggcttttttattgatataaaatctttatcacctgataaggaaatactattatacagatagattttagagtgttagactagtaatatgatattttaggagaattcttatgtttaaaaaaataatattatctattgcaactatagccgcaaccgccagcctagcagtatcagttcaggcgtcagagaaagtagaacttaaagtagctacagattctgacacggcaccatttacttatcaaaaagacgggaaattcaaaggttatgatgttgatgttgtcaaagctgtttttaaaggtagtaagtacaaagtaaccttcaagacagttccttttgatactatttcaacaggtattgatgcagggaaatttgatttatcagctaatgatttttcatacaataaagaaagagcagaaaaatatctcttctcagatcctatatcccgttcaaattatgccgtagtagggaagaaggggagccattacaaatcattaagtgacctctctggaaaatcaaccgaagttttatctggcgttaactatgcacaggttctagaaaattggaataaaaatcatcctaataaaaaaccaataaaaatcaaatatgtttctgggacaactggtgttactagcagattaaaaaatattgagagtgggaaaattgactttatcctatatgatgccatttcatccgactatattgtaaaagaccaatcattaaacttaagcgtttctcctttgaaaggtaaaattggtaataataaggatggactagaatacctccttttaccaaaagataaaaaaggtaaaactctacagaaatttataaataagcgtattaaagttttgaaagaaaatggtactttggcacgtttaagtaaacaatatttcggtggagattacgtttcaaacattgataaataaatcagtgagactataagttttatctttttacatgtgagagtttgcgtgatagaataacggagataagaaagtttagaaaaggaaagtagaaggaatgaatcaatttatcttgacgggtggatggtcttggtataataatttggttagtcaggttccagcggggaaattatttagttggaaggctgttttagatgcaataccctcaattttagagcgattacccataacactattattgacagtagcaggagccttatttggactcattttagctttgatttttgcagtagtgaaaattaaccgtgtcaaaattttatatccgattcaagctttatttgttagttttttacgtgggactccaatacttgttcaattaatgctgagttattatggaattccacttttcttgaaatttttaaaccaaaaatatggttttgattggaacattaatgctataccggcttctgtatttgctattactgcatttgcttttaatgaagcggcttatacaagtgaaactatacgagcggcgattttgtcggttgatcaaggtgaaattgaggcagcacgtagtttagggatgacctcagcgcaagtttatcgtcgtgttattattccaaacgcagcagtagtcgcaacacctactttgataaacacgttaattggtctaactaagggaacctctttagcttttaatgctggtattgttgaaatgtttgcccaagcacaaattatgggtggtagcgattatcgctattttgaacgttatatctctgtggcacttgtttactgggcggttagtttcttaattgaacaattgggaaatgctattgaacgaaaaatggcaattaaggctccacgccatttaactgatgagattccaggaggagtacgctaatgataaaattgagacaattgactaaatcattttctggtcaaaaagtgttagacaaacttgatttagatattgaaaaaggtcaagttgttgctctagtaggtgcttcaggtgcaggaaaatcaacctttcttcgtagtatgaattatttagaagagcctgattatggaacaattgaaattgatgattttaaagttgattttaaatcaatcagtaaagatgacatactaacattacgccgtaagttagccatggtttttcaacaattcaatctatttgagcgtcgtacagctttggataatgtaaaagaaggtttgaaaattgtcaaaaagatgtcagatcaagaggcaacacggattgcaagagacgaactggcaaaggtcggacttgcagatcgtgaaaaatattatccaagacatttatcaggtggacagaaacaacgtgttgctttggcacgcgcattagccatgaaacctgatgttcttcttttagacgaaccgacatcagcacttgatccagaattagttggagaagttgaaaaatctattgcagatgctgctaagcaggggcaaaccatggtacttgttagtcatgatatgaattttgtttaccaagtagcagataaagttttatttttggaaaaaggtcgtattttagagtctgggacgcctgaacaattatttaaccatcctttagaagaacgtacaaaagaattcttcgctagttataacaaatcgtacctataagctaaaatattttgatataatgaaggttagaatgtctaatcttcatttttaattattcttgagttaggctaagtatataagaaagctgcgatatgttttgacaatcgcttgttggatagagatgtttttagaaatagcaaaagtttatttacaaggtttagggcttgccagcataactgttattttagttggtataatttgggtcttttggcgtgccaagaaaaacatagataaaacagctagagaacgccaatctgttctttatgatgtccttctgatagctcttatgacagctccaatacttgcctttgcatttgtagctatcattttaatgataaaagcttagtcagattagttggaaatatagacgctttgctatagaataaaaccataagattcaaaggagaaatagtaatgtatgatactttaataataggttcaggtcctggtggtatgacagcagcgctttacgctgcacgttcaaaccttaaagttgggttaattgaacaaggtgctccaggtggacagatgaataatactgctgaaattgagaactatccaggctacgatcatatctcaggtccagaattatcaatgaagatgtatgagccgttggaaaaatttgaagtagagcatatttatggtatagttcaaagagttgagaacgatggtgatgtaaagcgtgttatcaccgaagatgaatcgtatgaagccaaaacagtaatccttgctaccggagctaaaaacagccttttaggagttccgggtgaagaggaatatactagtcgtggcgtttcttactgtgcggtttgtgatggtgcatttttccgtgatcaggatcttttagttgtgggtggcggtgattctgctgttgaagaagctgtcttcttaactcaatttgctaaaagtgttactattattcaccgacgtgatcaattgagagctcaaaaagtacttcaagaccgagcttttgctaacgaaaaaataaaatttgtatgggattcagtggtcaaagagattaaaggaaatgagattaaagtatctggtgtaactgttgaaaatctaaagactggagaaatctcagagatgactttcggaggtgttttcatttacgttggtttgaaaccacattctagcatggtctcagaattaggtattacggacgagactggctgggtcttaactgatacaaatatgaaaacatcaattccaggactatatgctattggggatgttcgtcaaaaagatctacgtcagattgcgactgctgttggtgaaggtgctatcgctggacagggtgtctataactatataactgagcatttctaagaaatactaaaagtagaaaagactatcgaaaaacgattagtctttctttttattttcatgaaagtaaggtgataaactgaactaccgagatagaaatatgctataatgttagacatatagccttatcctaggctcatgattaaaaggagattgtctgatgtataaagacgatagtttaacactacatactgatttatatcaaatcaatatgatgcaagtttattttaataaaggtattcacaataaaagagcggtgtttgaagcttactttcgcaaggttccatttgaaaatggttatgctgtttttgcaggtttagagcgtattgttcgttatttagaaaatctgagcttttctgatagtgatttatcctatttagaagagttaggttatcctgaagaatttttagattacttaaaaaatttaaaaatggaactgactgtcaaatcagccaaggaaggtgaccttgtatttgctaatgaaccattagttcaaattgaaggtcctttagcacaatgtcagttagtagagacagcgattttaaatatcatcaactaccagacacttgttgctacaaaagcagctcgtattcgttctgttattgaagatgaaccgctattagagtttgggacacgacgtgctcaagaaatggatgcagccatttggggtactagggcagcgattattggtggtgctaacgcaacgagcaatgttcgtgctggtaaaatctttaatattccagtatcaggaacgcatgcacatgctttagttcaaacttatggcgatgattaccaggcatttaaagcttacgcagaaactcataaagattgcgtctttttagtggatacttatgatacccttcgtgtaggtgtgcctaatgctattcgagttgcaaaagagatgggcgaaaagattaatttcttgggagttcgccttgattcaggtgatttagcttatttgtctaagaaagttcgtcagcagttagatgacgccggttttcctaatgcaaagatttatgcttcgaatgatctagatgaaaatacaatcctcaacctaaaaatgcaaaaagctaaaattgatgtttggggtgtcggaacaaaattaattacagcctatgatcagcctgcgctaggtgctgtttataaaattgtttctattgagactgacgccggtagtatgcgagatacaattaaactatcaaacaatgctgaaaaagtatcaacacctgggaaaaagcaagtttggcgtatcaccagtcgagctaaagggaaatctgagggtgattacatcacatttgcagacactgatgtgacacaattagatgaaattgaaatgtttcatccaacttatacttatatcaataaaacagtccgtgattttgacgcagtacccttactggtagatatctttgacaaagggaaattagtttatcaattaccaagtcttcaagaaattcaagagtacggacgcaaagaatttgatcagctttgggatgagtataaacgtgttctgaatccacaggattacccagttgatttggcacgcgatgtttggcaaaataaaatggacctgattgatcgtatccgtaaagaagctttggcaaaaggagaagtaagatgactttgcaagatcaaattatcaaagaactcggtgtaaaacctgttattaatccaagtcaagaaatccgtcgttccgtagaatttttaaaagactatctattaaaacatagttttctaaagacctatgtactgggtatttcaggggggcaagattcaactttagcaggacgtctagctcaactagcagttgaagagttgcgtgctgatacaggggaaaactatcaatttatagctattcgtttaccatatggtattcaggccgatgaagaagatgcacaaaaagcattagattttatcaagccagatattgctttgaccattaatattaaagaagctgttgatggccaagttagagctcttaatgcagcaggagtagagattacagactttaataaaggaaatattaaagctcgtcaaagaatgattagtcaatatgcagttgcaggtcaatatgctggagcggttattggtactgatcatgctgcagaaaatattacaggttttttcaccaaatttggtgatggaggtgctgacttattacctctctttagacttaataaaagtcaggggaaacagttattagctgaacttggtgctgataaagccttgtacgaaaagattccaaccgcagatttagaagaaaataaaccaggaatcgctgatgaaatagcccttggagtaacctaccaagaaattgatgcttatcttgaagggaaggtggtttcggacaagtctcgaggtatcattgaaaattggtggtataagggtcaacataaacgtcatcttccaatcacaatttttgatgatttctggaaataagaaaaatagctagaatattctagctatttttgtttctctaataaattactttcagacttgcagaaatattcagaatgtttataatagtagctaagtataaaaggaggaatttatgtcaaaattaactcaaacatttacagataagttatttgctgattaccaagcaaatacaaaatttagcgctattgaaaatgcagtaactcacaatggtttattgaagtctctagagactcgtcaaagtgagattgagaacgactatgtcttttcaattgatttgaccaaagatgaagtttctaatcagaaacaatcaggacgttgctggatgtttgctgcactgaatacatttcgtcataaactgatttcagattttaaacttgagaattttgaattatctcaggcacatacatttttctgggataagtatgaaaaatcaaattggtttatggaacaaattattgcgactgcaaatcaggaattgagtagtcgtaaggtgaaattcctattagatgtacctcaacaagatggaggacaatgggacatggtggttgctctgtttgagaaatatggtgtcgttcctaaaacagtttatcctgaatctgtttcatcaagtgctagtcgtgaactaaatcaatatttgaataaactcttacgccaagatgcacagattctacgagaattaatagcacagggagcagatggggcaactgttcaaaataaaaaggaagaattgcttcaagaaatttttaactttttagcaatgaaccttggcttgccaccgcaatcttttgattttgcttatcgtgataaagacaatcattatcagtctgataaaaatattacaccgaaagcattttatcaaaaatatgttaatcttgacctatcagattatgtttctattatcaatgctccaactgtagataagccttatggacaatcctatacagttgagatgcttggaaatgttgtcggagggccagctgttaaatatttaaaccttgatatgaaacggtttaaagagttagcgattgcgcaaatgaaatcaggagaaactgtgtggtttggttcagacgtaggtcaagtatcaaatcgtcaaaagggtatcctagcaactacgacttatgattttaattcatctatggatattaaacttagccaagacaaagcgggccgcctagattatagtgaaagtttaatgacacatgctatggtcttaacgggagtagaccttgatgaatctggacaacctttaaaatggaaagttgagaactcttggggagagaaagttggtaaggatggttattttgtagcttcagatgcttggatggatgaatatacttaccaaatagtcgttcgtaaagaattgcttactaaagaagaattagaggcttacaacgcagagccaattactttagcgccgtgggatccgatgggagcattagctaattagtaatagtaattataaattaaaaaactggataatatatccagttttttaattaccgttaggtactgtattgttgttaccattaccattaccattaccatgtccagttcctggcacagtttgattggaattattaggggtagtagcattaccattattaggtgtttcgacttgtggggatgatgaattggcatcatttgctgtattcttatcctctttttgtttctcagaggatgttgaactactgctttgacttgactgtccagaattttgatagatattcttatagacagaagaagagtaagtgccggttgtagttgtcccattgatatacaagtagcttccgcttcgatagagcccttctggcattgtccaatctgcactgtatccgccagttaggtaggacatcattgcacgataaacctcagtagcaatatccagttggctaccataaagtggtgtaaggcgatttttataaccagtccaaattgccattgtgtacttagaagtatagccgacaaagttttcatcaggagccattgtaccaacggcgctattgtagataccagtagttgcttcaattttagctaactcatcttccgtatagttggaagtaccagtcttaccagcttgtgcaacaccagggatagctgctttagtaccagtaccaaatgttagtactgttttcagcatatccgtcatcatgtaggcagtagtctctttcatcgcacggctaccagacgctgcataagtatcattggttccatcgctaaattcaattttattaacatattgcggtttatagtaagttccgccgtttgcaaaagccgagtaagccgctgccattttctcactacttgcaccatattttgcatcactgctactgttgttacttgaaatagcatttgaatagttcatttctggatagtatatgcctaatttttcaaggaaagattttgcttcgtctaatccagcggcttcaagtgctctgacagcagggacgttacgtgattgttgaatagcggtctgcatactcatccaacccatatattgacgatcccagtcatatagttgagtagaagtaccaggccagtagtaaactgagtcgtttaatgattgacctgttgaattatagacaccactatcaatagcaggtgcataagctgagataggtttcattgtagaaccccaatcgcggtctgttaagacagattgatttgtcccaaatgaaatattttcattctgatgacgcccgcctaattgtgcaatgactttaccattagtcgcatccatgatggtagatgctatttgtaattcattgtttggataagcgatgtaagtgtcactgttgtagatgtcatatagttgtttttgtgcatcagtgttgatattagtatacacttttagcccagcagtaaagatatctttaccagttttttgtttaacttcactaataacttgttttaagtagttatccatatattttggataagtagatttttgctttaattcttttaagccatcagttactggagttgcaacagcttggtcgtattcctttttagaaatgtttttatcttgatacatctgctgaagaacggtattacgtcttgtttgagcagattctgggtttttataagggtcatattgtgtaggtgcttgaggaataccagcgagcaaagcaagttgtgcaatagataattcctttaggtctttaccaaagtatgatttagctgttgttctcataccataattcccatttcccatataaactttattaatatagaaagtaagaatttcttctttggtgtatttacgctccatttgaagcgcaagccaaacttcctgtgatttacgttttaacgtttggtcagatttattggtagaaaagtaagccagtttaatcaactgttgatcaagggttgaaccaccttgcgtattactactaacaagattatgccaagctgcacctaaaatacgataaatatcgacacctctatgtttaaagaaacgtttatcttcgatagaagtgatagcgttaaccaaatttagtggaatgctatccgcactaacactttcacgcttttctgagcctaaatcggcaataagtttattattaccatcataaaccaaactagagttaacggattttaaagcttgatcggttaatttcggagaacgactaacgtagtatgcaaataggagcccacctattacaatagctaagataataaatcccattataatgccaaaagcatacttcaatagtttgataacagattcctttttaattgtaatcaccgcctaataatttttcttcaataatatctaagtaagggacttgaggaaaggcactctcctttacgaaaaatccattttttctgatataatcaataggcattgatttattgcctttatcaatctgataaaatgaaattaactcattagcagggagtagataggtttccttaagtgtggaaaaatgaagcaagacaaagcaaatccctttttgctgtaatacatttgccatgtgctctatttggtgagcatgaaaatttttcataggcatagcagttttctgccgggtttctttggcttcaaagtcaatatagtaacctttgtaaacaccagaataatcagtagtagaagcttgtctaaaataagcttctacaatcttagcacgactacgtttaggataatctaccttgacgatttgtactggcgttggtttcttatgaatgacagctaattcgtgagacaaatagtagtcattggttgcattgatagcagcttcaaatgacataccacggttggcaaaatcgattttctttttctttgattttgtaactgttgttttccgaataagctgatgtggatagttaaccatttttctccttgcattacaaataaaatgctaagataagcaaaactattataccataaaattaggatggacaacaaatgaagtcaactattcttgtaacaggttacaaaaattttgaattagggattttccaggataaggatcctcggattactattataaaaaaggctattgataaggattttagacgcttcttggaaaatggagcagactggtttatttttatgggaaatttagggtttgagtactgggctttggaagttgctcttgatttacaaaaagaatatgattttcaaattgcgacaatttttacctttgagaaccatggccaaaattggaatgaggctaataaagctaagttggcactctttaagcaagttgactttgttaaatatactttcccaagctatgaaaacccgggtcaatttaaacaatacaatcattttctcattaacaacacacaaggtgcatatcttttttatgattctgaaaatgaaactaatttaaaatttttgctagaaatgatggagaaaaaggaagcttatgatatttctttcctaacttttgatcgcttaaatgaaatatatgaggaatgatcgttttttcggatatgagaacgttttacgcttgatttttccatttaatttaggtattatttactttgatataaaggataggacttatattaaaacgatttgactggtttggagaatagaatggcaagtattatttatagcccaaaagatatttttgagcaagattttaaagttagtatgcggggatatgacaagaaagaagtcgatgtatttctggatgatgtcatcaaagattacgaaaattatcttgagcaaattgagaagctccaaatggaaaatagacgtctacaacaagctttagacaaaaaagaaagcgaagcttcaaatgtaagaaattcagggacagctatgtataatcaaaaaccgattgcccaatctgcaaccaattttgatattttaaaacgcattagccgccttgagaaagaagtttttggaagacaaattagagaataaggatttctcaaatatgcaatttttggataatcgcgtagtattgagatactatgaggaaagtccatgctagcactggctgtgatgccagtagtgtttgtgctaggcgaaaaaataagcctagggagatagctagctatcttacggcaagcaaaagggctaagtctttggatatgcctgaatagctttgaaagtgccacagtgacgtagtttctagggaaatctagaaagtggaacgcggtaaacccctcaagctagcaacccaaactttggtaggggcatgggatagttggaatgagaacaatctatcctgactgctttgcagtagacagatgattatcgaaagaaacaattcctagttgtttctggaacaaaacatggcttatagaaaattgcataataggttagtggctgagataacatctcagccaatttttaactgtgatgaatacgatagtgtaaaagaggaaaaatgaaagaatcattcaaattaatagcaactgctgctgctggtttagaagccattgttggtagagaaatcagaaacctaggaattgactgccaagttgagaacggtagagtccgtttccacggagatatcaaaacaatcattgaaacgaacctatggctacgagctgccgatcgtataaagattattgtaggagagtttccagcacctacttttgaggaactttttcagggtgtatatggccttgactgggaaaattatttaccgttaggggcaaaatttcctattgctaaagcaaagtgtgtcaagtcaaaattgcacaatgaacctagtgtacaagccatttctaaaaaagctgttgctaagaaacttcaaaaagtctttcaccgtcctgaaggagttcccttacaagaaaatggagctgaatttaaaatagaagtttctattttaaaagataaagcgactgtcatgattgatacgactggatcaagtctcttcaaacgtggctaccgtgcagaaaaaggtggtgcaccaattaaagaaaacatggcagcagctattattcaattatctaattggttccctgataagccattgattgatccaacttgtggttcaggtactttttgtattgaagctgctatgattggaatgaatatagctcctggttttaatcgtgattttgcctttgaggcgtggccatgggtagatcaaagtcaagtacaaaaggttcgtgatgaagctgagagtaaagcaaactatgatattgatttagatatttcaggttttgatttagacggtcgtatggtagaaattgctagaaaaaatgcagaagaagcaggacttggagatgttatcaaattgaaacaaatgcgtcttcaagatttaaaaacagataaaattaacggtgttattatctccaacccaccatatggtgaacgactcctggatgacaaagcagtggacattttgtataatgagatgggacaaacatttgcgcctttaaaaacttggagcaagtttatcctaactagtgacgaaggatttgaaaaaaaatacggctcacaagctgataaaaaacgtaagctttacaatggtactttaaaagttgatttgtaccaatattacggtgaacgtgtgagacgtcaagtaaaataacggggagaactcatgtcagaagatcaaaaacacccattttttgaaccaaaaaaagaaactgatggtcttgaatttaaagatgctaaagaaatgacagtagaagaggctgttagaaaagattctgaaattaaggctggtattaccgaagaagatagtattcttgataaatacatcaaacaacatcgtgatgaagtagcttcacaaaagtttgagacaaaatcaagcgattttgcaaaccttgatacggcatctttagatgattttatcaagaaacagcgcgaagaattatcagcgatgttagctgcagaagagctttctaaaaagttggataattcagtctctcaagaacaagatacagaagctaatgctgtctcacctaaagaagaatcttcacaagaacaagaaaatagtgtaaccccagttcctcctctgaatacggaagcagaaccaactgcaacagaaccagattcgactattgctgattcagaggagtataaatcctcttctaagaagcgtggaggtatcgtaggaacattgattgctcttattttacttctaatagtagcaatctttggttacaactatttcaagaataataattcgacaaattctcaaactgcaacaagtcaaagttctagttctaaggctacgacgacttcatcagaagaagataaaaaagctagtcagaacttagataatttcaacaaatcttatgctaacttttttgttgatgataagaaaacccaactcaaaaatagcgaatttgataaattgtcagaattagaaaagaaagttgatgctttaaaaggaactaaatactacggtaaagtaaaagttaaatttgatagtctaaaacgtcaaattgatgctgttaaagctgttaacgacaagtttaagtcgcctgctgtagttgatggtaagaagagtgaaaaattagaggtaaaagatggagcgaattttgactctttagatagtaaaactcttaatactggtaatgctagtctagatagtttacttcactccatcgtttcaactggtcgtaatcaggtaaaacaatccgaagaacaggcttcgtctaataaggtttcagacactcaaataactgaacaaccaaacgtaactaacggtcaatcttcctcatcagctgctacaataaataatcaggcagctggcactgcatcaggtaatttggaacgtaaccgtagtcgagtaccgtataataatgctgctattgcggatacaggaaatcctgcctggatatttaacccaggagtattagagaaaatcgtggccacttcacaggcgcgaggctatttctctggaaataactatattcttgaacctgtaaatattatcaatggtaatggttattacaatatgtttaaattagatggcacttatttgttctctatcaatgccaagacaggttactttgtaggtaacgctcctggaagagctgatagtttagattattaatataaagaacaaaaccagttttttgtctacaccctaaaagttagaaaatcagtctaacgattagggtgttttttgtattcgcatttagatgtctacgactgctatgaggatattagggaaaaattaaaaggattttgctctctatgatacagaacaaaatcctttgtttaaattaataagtcaacttttggaattccaaaagttgacttttattttttattagatcagacaatgtggcgctcaaaagcattgtcagaaatcccttgggaaagaattaatttcgcccattcttgagcagagtggagactgtggtctttataatttccacaagattcaatggttgttccaggaacgtcttcccaagtgaccccaccagcaatagcctctagactagatttgatgactttagcaatttcagtagcatcctgttttccccacataatcatgtgaaaaccagttctacaaccaaaaggagaacaatcaatcaaaccattaattcgttggcggattaacttcgccagaaggtgctcgatagtatgtaaaccagcagtatcaatagcattttcattaggctgaataaggcggatatcaaagttagtaatgatgtctccgaccggtccaacttcttctgaaattaaacgaacgtagggtgctttaacgatggtgtgatctaattcaaaactctctacgacaacttcttttgtcataagttttctccttttgtattacattctagagactaaaggagatgttgaaaatttctcctaatccctttaaataacattctaatcatatcataaatgtctataattttaaattgtgaaaacgccttttttatgataaacttaaaagtggactttctatatgaaatctagaaaaaaattgaggtataaacatgtttaatattatattagcaatggtttgtgcactcattggtttgattattggttatgtggctatttcaatgaaaatgaaatcatcaaaagaagctgcagaactaactcttttaaatgcagaacaagatgccgttgatttacgtggtaaagcagaaattgaagcagaacacatccgtaaagcagcggaacgtgaaagtaaagctcaccaaaaagaattacttttagaagcaaaagaagaggctagaaaatatcgtgaagagatcgaaaaggaatttaaatctgatagacaagagttgaaacagatggaggcacgtttaacagatcgtgcatcatctcttgatcgtaaagatgaaaatctatctaacaaagaaaaaatgttagatagcaaagaacaaagtctaaccgataaatctagacatattaatgagcgcgaacaggaaattgctactttagaaacaaaaaaagtagaagaattgtcacgcatcgcagagcttagtcaagaagaagctaaagatatcattttagctgataccgaaaaagatttagctcatgatattgcgacacgtattaaagaagcagaacgtgaagtaaaagatcgatcaaacaagatagcaaaagacttgctagcccaagctatgcaacgtttagctggtgaatatgttactgaacaaacaattacaactgttcatctccctgatgataatatgaagggacgtatcattggtcgtgaaggacgtaatattcgtactctggaaagtttgacaggtattgatgttatcatagatgatacgccagaagtcgttgtcttatcaggtttcgaccccattcgtcgtgaaattgctcgtatgactttagaatctttgattcaagatggacgtatccatccagctcgtattgaagagttggttgaaaaaaatcgtttggaaatggatcaacgtatccgtgagtatggtgaggcagcagcttatgagattggtgcaccaaatctgcatcctgatttgataaaaattatgggacgtttgcagttccgtacatcatatggtcaaaatgtacttcgtcattcagttgaagttggtaaacttgcaggtattttggctggagaactaggagaaaatgttgatttagctcgtcgggctggattcctccatgatatggggaaagctattgatcgcgaagttgaaggcagtcacgttgaaattggtatggaatttgctcgtaagtacaaagagcatccgattgttgttaatactattgcaagccaccatggtgatgtagaacctgacagcgttattgcagtaattgttgctgctgcagacgcccttagttcagcacgaccaggtgcgcgtaatgagtcaatggaaaattatatcaaacgtctgcgtgatttagaagaaattgctaatggctttgagggagtgcaaaatgcctttgcacttcaagccggacgtgaaattcgtatcatggtacaacctggtaaagtttctgatgatcaagtagttattatgtcgcataaggtacgtgaaaaaatcgaacaaaacttggattatccaggtaatattaaggtaacagttattcgtgaaatgcgagctgttgattttgcaaaatagtcaaaaggagagcttgttagctctccttttgttatagagttgacatttgtcatattttgaaatgacaaaaatatctaaaaagtttacttctgattttttatactatgattatagtaaaggagaaccaaatggcaaaagatataattaaggttgatcatatatttaaaagcatcgggcaaaaaacgattttagaagatatatcatttagtatagcttctaaccaatgtgtagcattgattggacctaatggtgcagggaaaacaactctgatgtcaactttgttaggtgatattagtatttcttcaggatcattgacgatttttaatctgcctgcacaccacaataggttaaaatataaggtggccatcttaccacaagaaaatgtattgccctcaaagtttacagtgagagaactcattgatttccaaaggtgtttatttccagaagtgctgccaatgtctctgattttagactatctacagtggagtgatacgcacttgcaacaatttacagagactttatctggagggcaaaaacgacttttagcttttgttttaactttggttggtaagccccaattactatttttagatgaacctacttccggaatggatacttccacacgtcaacgattttgggagctgattgcgacactaaaaaaagaaggtgtcacaattgtctattctagtcattatatcgaagaggtagaacatacagctgataggattttagtacttcataaaggaaagttattacgcgatacaacccccctttgccatgaagcaagaaaaaaccgaaaagttattcaccgttccgcttagttatcaaaaattattacctacctatttgattacagagtgtgaagccaagagtgatagtataacgtttgttactggggaggctgaagctgtatggaaaatactggcagataatggttgtcctattgaagctattgagatgaccaatagaactttgttaaatcgtatttttgagactactaaggaggtaaaacatgagaatctttaaagcattattgaaaatggaatttcttttgacaaaacgtcaacttgccaatctcattatggctataggtatgccagtggctttttttctatttttttcaggatttatgggcgaaggactcactaaagccatcgaagctatctacgttcgtaattatatgataacgatggcaggattctcaagtcttagctttgctttttttacttttccattttctatgaaagatgatcaactctcaaaccgaatgcaattattaagacactcaccagtaccaatgtggcaatattatctagcaaaaattattcgtattttattttactattgcctagcaataactgttgttttcctaactgggcatattttaaggcaagttagtatgccaatagaacaatggatgcagagctttttattgctattaggaggagcaacatgttttattccttttggattgctcgtctcctactttaaaaatactgaactaatgtcaatggtagccaatatttgttatatgtcattagctgttcttggtggcatgtggatgccaattacaatgttcccaaaatggttgcaagctttatcaaagttaacccctacttaccatttgactcaagttatccttagtccgtttgctaatagttttgctggtttttctcttattattctgataggctatggtattataatgttagttatcgcttatctactatctcagaagaggcattcaatttgaaaaataaaaaaaataactatgatttaatgtattttattccgttagtatttttgatttaccccataggagggattctctattatcactaccctttttggactttattttttacgctagcttttgtaggagcatatttatactctgttattatcaggggcgaatcaaagtatcacatgattgcctggtctacaatgttgacatatattttctacatgacaatttttataaatagtggtttcatctggtatatttactttctgagtaatttactcgtctatcgctttagagataaattgaagtcttttagattcattagttttgcttgtactctagccacagtggtatttttatgcttctttaaggcatcagactttggtgatagaatcatgtttctaattgttcctattttttgtatcggttacatgtggattgctattgaaaatagaaatagcgaagaacaaagagaaaaaattgcagagcaaaatcagtatatcaatattttgtcagctgaaaatgaacgtaaccgtatagggcgtgatttgcatgatagtttaggacatacatttgctatgatgacactaaagacagaactagcgttaaagttgttagaaaaaaggaactatgataaggtacaaaaagaactatcagaattaaatcatattagtcatcaatcgatgagtgaggtccgtcaaattgtttctaacctcaagtatcgtacagtagtggaagaaattgatgagttgtaccgcttgtttcaattatctaacattaagttaacagttgttaataagttagagacgtcacaactaagtccagtaacacaatctacaatcacaatgatattaaaggaattatccaataatattgttaagcatgctgaagctgatagcgtggagttgagtttagtaaggcaaggtgctactataaatattgagatgattgataatggttgtggttttacaaaccttgacggagatgagttgcatagtattcaagagagattaactatcgttgaagggacactaacgattttgtcccgaagtaaaccaactcatattcaggtggtattgaaagaggtataagatgaaattacttgttgctgaggatcagtccatgctacgagatgctatgtgccaattacttttgatggaagaaagtgtttctactattgatcaagctggaaatggtggagaagctattgccattttatccaataaagccatagatgttgcaatattggatgttgagatgccgatattatcaggtttagatgtcttagagtgggttagaaaataccagaatgttaaggtcataattgtaacaacctttaagcggtcaggttatttccaaagggctattcgttcaaatgtagatgcttatgttttgaaagaccgctcagtagctgatttgatgaaaacgattcaaaaagttttatctgggggtaaagaatattcgcctgaattaatggaaaacgttatatctaatcctttgagtgagcaagaaataaaaattctttccctaattgctcaagggaagaccagcaaataaattgcatgcactttatttttatcgaatggtacagttcgtaattacacgtcaaatatttttgataaattaggagttaataatcgtttggaggcacttaaaatagcacgagaaaaggattggctgtgatagtttttttccagtcgagatgccataatgtattaagagggatgtatgtatgcaaaaatttaaagaacgttttgatacgcttagtgatgcaattttggccattgctatgacgattttagttttggagataaaaactccggctacgatgggtgatattggtgactttacacggaacataggtttatttattgttagctttgttgttgtttttaatttttggtacgaaagggcacaaaatagcctagatgctcaaaagactaatgatgaaattatagctcttgatatcattgaacacctaggtatttgtttgattcctctctttactaaatttatgatttcttttgagaatcataattttgctgttatggcttatggactcttaacgttattagttggtctcacatcagacattattcggattcgtttggcaagttatgatttagtgaccattcctagtgaattgaaagagcgggttataaaagtcatgacaacttttgccattcgttcagttgtggttcgctttatcatcattatcctcgcttattttctacctgaggtagggatatttgcatatttagtcataccgctctttatgttttggcgtcgctctagagcaggaaaatactatgctaaaaagggcattgaggcaccatcttatatcaagctttttatccaaattggagagagagctcctgaggattttactaattcaagtagtggaataggtggggtaaaaagactctataaaaaataataggagaccttgaaaaaaaggtttctttttgttaaactaatgagaagaaactttatttagggagcaatttatgaattgctataaaagttaatagttaaggtaagaaccagattgttctggtctttttaacacttaacacccgatctattaatttgaggagtgtgtaatgtctgaacgtggtttgctaattgttttctcaggaccatctggtgttggtaaggggacagttaggcaagaaattttttcaacccctgaccataaatttgattattccgtttcaatgactactcgtccacaacgcccaggcgaagttgatggagttgattatttcttccgtacacgtgaagagtttgaagcgttgattaaagaaggtcaaatgcttgagtatgcggagtatgttggtaactactatggaactcctttaagttatgtcaacgagactttagacaaagggattgatgtttttcttgaaatagaagttcagggagcgcttcaagttaaatcgaaggttccggacggtgttttcattttcttaacaccaccagatttagaggaattagaagagcgtttagtaggacgtgggacagatagtccagaagtgattgcccaacgtattgaacgtgccaaagaagaaattgctttgatgagggagtatgactatgctgttgtcaatgatcaagtgtcattagcagcagaacgtgttaaacgtgtcattgaagcagaacattatcgtgtggatcgtgttattgggcgttataccaacatggtcaaagaaactgataaaaaattaagttaaaaatagaaaagagaattgccttatgatgttaaaaccttctatcgacactttgttggataaagttccttcaaaatattctttagttattttacaagctaagcgtgctcatgaattggaagctggtgagaaagccactcaagattttaaatctgtgaaatcaacacttcgcgctttagaagaaatcgagtcaggtaatgttgtaattcacccagatccatcagcaaaacgtgcctcagttcgcgctcgtatcgaagctgaacgccttgctaaagaagaagaagaacgtaaaatcaaagagcaaattgctaaagaaaaagaagacggcgaaaaaatttaagcaagtcaaaagtgagaggttgaaacattctgtatcagcctcttttcatattttagagaattagggagggtttatggcaagaaaattagcacaggttattgttgatattcctctgatgcagacagataaaccattttcgtatgccattcctaaagatttggaagatttggtacaagtaggagtacgcgttcatgttccttttggaagaggaaatcgtcttttgcaaggctttgttgtcggtttcagagatgatgatgaattagagactaaggatattgcggaggtcctagattttgaacctgttttaaatcaggaacaactagacttagctgatcagatgcgccatactgtcttttcttataaaatatctattttgaaatcaatgttaccaagtcttttgaattcgcaatatgataaactcttgttagcaacagacacattaccatcagaagatagagaagatctatttggtcataaaacggaaattgtcttttcaagtttgtcttctcaagatgccaaaaaagcaggcagattaattcaaaaaggtttcatagaagttcaatatttagccaaagataagaaaacaataaaaacagaaaagatttacaaaatcaacagaactctgttagaaaagagccaaatagcagcaagagcgaaaaagagactggagttgaaagaattcctgttagaaaatcctcaaccagggcgcctcacagctttaaacaaacaattttcatctcctgtggttaattttttcagagaagaaggaatcattgaagtcattgaaaaagaagctagtagatctgataattattttaaaggaatcctaaaaacggattttttggatttaaatcaggaacaagctaaagtagttaaaatagttgttgaccaaattggtaaggaacagaataaacccttcttgttggaggggattacagggtctggtaagacagaggtatatcttcatatcattgataacgttttaaagttgggaaaaacagcgattgttctcgttccagaaatttctttaactccccagatgacgaatcgttttatttctcgttttggaaagcaagttgctattatgcactcgggcttgtcagaaggtgaaaaatttgatgagtggcgaaagataaaatcaggtcaagctaaagttgtcgttggagctcgttcagcaatttttgctcctttggaaaatatcggagccatcattatagatgaggaacatgaatcaacttataagcaagaatctaacccaaggtatcatgcgcgcgatgtggccttgctacgtgcagaatattataaagctgtgttactaatgggatcagcaactccaagtatcgaaagccgagctagagctagtcgggatgtttataaatttttagaattaaaacatcgtgctaatcctaaagcacgtattcctcaggttgaaattattgattttagaaattttattggtcaacaagaagttagtaatttcacatcatatttactagataaaatccgagatagattagataagaaagagcaagtggttcttatgctcaatcgtagaggttattctagttttattatgtgtcgagactgcggctacgttgatcaatgtcctaattgtgacatttctctgactttacatatggctacaaagaccatgaattgtcattattgtgggtttgaaaagcctattccaagaacatgtccaaattgcaatagtaaaagtatctcttactatggtactggaacccaaaaagcttatgaagaacttttgaaagttatcccagacgcaaagattttacggatggatgttgatacgacaaggcaaaaaggcggtcatgagtctattttgaagcgtttcggaaatcatgaagctgatattttattgggaacacagatgattgctaagggattggattttccaaatgttactttagttggagtactaaatgcagatacttctctgaatttacctgattttcgatcatcagagcgaacttttcagctattaactcaagtggctggacgtgctgggcgtgctgaaaaagaaggagaggttgtcattcaaacttataatcctaatcattatgctattcaattagcccaaaagcaagattttgaagctttttatcaatatgaaatgaatatccgtcgacaacttggttatcctccttattattttacagttggtttaacattatcgcataaagatgaagagtggttaatacgaaaatcttatgaagtattaagtttattgaagcaaggctttagtgataaagtaaagttgttaggtccaacgccaaaaccaattgcaagaacacataacctttatcactaccaaattattatcaagtatcgatttgaggacaaccttgaacttgttttgaatcgcttattagacatgactcaagacaaggagaatagagatcttcgcttagcaatagaccacgaaccgcaaaatatgatgtagaatagtgctatgatataattgagaaaagaaagacgaggaaaaagcaatgacaaaattattattcatggggacccctgatttttcagcgacggttttaaaaggtattttagcagatggtaagtatgatgttttagctgttgtgacgcaaccagatcgtgctgtaggtcgtaaaaaagaaattaaaatgacccctgtaaaagaagtggccttggaaaacaacattcctgtgtatcagccggaaaaactatctggaagtccagaattagaacaactaatgaccctaggtgcagatggtattgtaacagctgcttttggtcaattcttaccaacaaagcttttggaatcggtaggttttgcaattaatgtacatgcttctctattgccaaaatatcgtggtggggcaccaattcattatgccattattaatggcgaaaaagaagctggggttaccatcatggaaatggttgcaaagatggatgcaggggatatggtatcaaaagcttccgttgagataactgatgaagacaatgtagggacaatgtttgatagactcgccgttgttggtcgtgaccttttattagatacgcttccaggttatctatcaggtgatattaagccgataccacaaaatgaagaagaggtaagtttttctcctaatattagtccagatgaagagagaattgattggaataaatcatcgcgcgacatttttaaccatgttcgagggatgtatccatggccagttgcacatacccttttggagggaaatcgttttaaactttatgaagtaacaatgtcagaaggaaagggctcaccgggtcaagtgatcgctaagacaaagaactcattgacagtagcaactggtgacggagctattgaactcaaatcagttcaaccagcagggaaacctcgtatggatataaaagactttttaaatggtgttggtcgtaatttagaaataggagataaatttggcgaatgattggaaaaagagtgcgcgtggtttagctttaatgactttagaggaagtttttgataaaggagcttattctaatatcgcacttaataagagtttaaaaaaatctagactatcagataaagatcgtgccttagtaacagaaattgtctatggaactgtggctagaaaaataacgctagaatggtatctatcacactttatagttgatcgtgataagcttgaattatgggtatatcatctcttgctactgagcctttatcaactactctatctggacaacatcccagatcacgctattgttaatgatgctgtcactattgctaagaatcgaggcaataaaaagggtgctgaaaagttaattaatgccgttttacgaagagtaagttcggagacgctccctgaaattgcatcaataaaacgccaaaacaaacgttactctgttgcttattccatgccagtgtggctcgtaaaaaaattaattgaccaatatggtgagacaagagctttagctattatggagagtttatttgagcgaaataaagccagtcttcgtgtgactgacttatcgcaaaaacaaactatcaaagaaactttaaatgttagagattcacatattgcagagacagctttagttgcagactcaggaaattttgcatcgacatcatttttccaagatggcctcattactatccaagatgaatctagtcaattagttgctccaacactcaaagtctcaggtaatgaccaagtattggatgcatgtagtgcaccaggaggaaaaacaagtcatatcgcctcatatttgactacaggggcagtaactgctttagatttgtatgatcataaattggaattggttatggaaaatgcaaaacgcctaggtctgtcagataagataaaaactaaaaagttagatgcaagtaaagctcatgagtattttcttgaggatacttttgacaaaattttagtagacgcaccttgttcaggtatcgggctaattcgccgtaaaccagatattaagtacaataaagctaatcaagactttgaagcactccaagagattcaattgtctatcctatctagcgtttgtcaaacgctacgtaaaggtggtataataacctatagcacttgtaccatttttgaggaagaaaattttcaagttattgaaaaattcttagaaaaccaccccaattttgagcaagtagaactgagtcatacacaagaggatattgtaaagagaggctgtattagtataagccctgaacaatatcatacagatggcttttttattggacaagtcaaacgtatcttgtagtgtctaggaggaaactgacatcgtcagaaaaaaatatatggaaatatctcttttaacagatattgggcaacgtcgttccaataatcaagattttattaatcaatttgaaaataaagccggcgtcccactaatcatcttagcagatggtatgggaggacatcgtgcaggaaatattgctagcgagatgactgtaactgatctaggaagtgattgggcggagacagatttttctgagttatcagaaattcgtgattggatgcttgtctctattgaaacagagaatcgcaaaatatatgaattaggtcagtcagatgattacaaaggtatgggaactaccattgaagcagttgccattgtaggagataatattattttcgcacatgtaggagattcacgtatcggtatcgttcgtcaaggagagtatcatttattgacgagtgatcattctcttgttaatgaattggtaaaagctggccaattaacagaagaagaagctgctagtcatcctcaaaaaaatattattacgcaatcaattggtcaagccaatccagtcgaacctgatttaggagttcatctacttgaagaaggtgactaccttgtagttaatagtgatggactaactaatatgttgagtaatgccgatattgctacagtactaacacaagaaaaaaccttagatgataagaatcaagatttaatcactctagcaaaccatagaggaggtcttgataatatcactgtggcactagtttacgttgaaagtgaggcggtttaatgattcagattggcaaattatttgctggtcgttatcggatccttaaatcaatcggacgaggtggaatggcggatgtttatctagctcgagatctaattttagataatgaagaggtcgcaataaaagtattgcgaaccaattatcaaacagatcagattgcggttgctcgcttccagagagaagcacgagcaatggctgagctgacacatcctaatattgtcgctattcgtgatataggtgaagaagacggacagcagttcttagtaatggaatatgttgatggattcgatttaaaaaagtatattcaagacaatgcacccctatcaaataatgaagttgttcgaatcatgaatgaagtcctttcagccatgtcactggcacatcagaaaggtatcgtacaccgtgatttaaaacctcaaaatattttattaactaaaaaagggactgtaaaagttacagatttcggtattgcggtagcgtttgctgaaactagtttaacgcaaacgaattctatgttaggtagtgttcattatttatcgccagagcaggcgcgtggttcaaaagcgactgttcagagtgatatttatgccatgggaatcatgctttttgaaatgttaactggccatattccttatgatggggatagtgcagttactattgccctacagcacttccaaaaaccactaccatcaatccttgcagaaaataaaagcgttccacaagctttggaaaacattgtcattaaagcaacagctaaaaagctaacagatcgctataagacaacttatgagatgggacgtgatttatcaactgctctaagctcgacacgtcaccgtgaaccaaaacttgtttttaatgatactgagagtactaagacactacccaaagtaacatctacagtatcatctctaacgacagaacaactgttgcgtaatcaaaaacaggccaaaacaacagaaaaaataactcctgattctgcgagtaacgataaaacgaagtctaaaaagaaggcttctcatcgacttcttggtacaatcatgaaattattctttgcactctgtgttgtaggaataattgtatttgcttataaaattttagtaagtcctacgactattcgtgttccagatgttagcaacaaaacagtagctcaagcaaaaatgacattggaaaattctggattgaaagtaggagctattcgtaatattgagagtgatagtgtttcagaaggacttgtcgtaaaaacagaccctgctgcaggacgttctcgcagagaaggggctaaagttaatctttatattgccactccaaacaagagtttcactctaggtaattataaggaacataattacaaagatatcctcaaagatcttcaaggcaaaggtgttaaaaaatctttaatcaaggttaagcgtaaaattaataatgattatactactggtacaatcttagcacagtcgcttccagaaggaacatcttttaatcctgatggtaataagaaattaacacttacggttgctgttaatgatccaatgattatgcctgatgtaacaggtatgactgttggagaagtaatagaaaccttgacagacctcggattagatgcagataatcttgtcttctatcaaatgcaaaatggcgtttatcaaacagtagtaacacctccatcttcaagtaagatagcaagtcaggatccttattacggaggagaagttggattaaggagaggagataaagttaagctgtatcttcttggttctaaaacaacgaataactcatcatctacgccaatagattcttcggcttcaagctcaacaggaacaactacctcggattctgtaagctcatcaacggatgctagcacttctgatagtagtagcacttctacaagtagttcaacactaccaagtgatagtacaactaatacaggaacagctaacaatccattaactcaataaaattaaaaagaagatgttaaagtcttctttttaatttgctatggcagagaccatgcctagaaaggttctctgccaatatgccaaatttttctctcaataatggtgcaaagtatagggctttttgataaaatacgtcatatagagtaatggaaggattattatgaaaaaatttcagttttttctacttgttgaagccgttgtcttagttatgggattaatgaaaattttatctgatgactggacaagttttatttttattctcgctttgattcttttagccttaagattttataacaacgatagtcgtcataattttctgttaacgacaagtttgttattactatttttaatctttatgcttaacccttacattattgcagccgttgtttttgcagttttgtatgttctaatcaatcatttctcgcaagttaagaaaaaaaatcgttatgctttgattcaatttaagaatcatcaattagatgttaagacaacacgaaaccaatggttaggtactgatcaacacgaaagtgacttttatgcttttgaagatattaatattataagaatctctgggactgatacaattgatttaacaaatgttattgtatctgggcaggataatgttattataattcaaaaagtttttggtgatactaaagtattggttcctttagacgttgccgtaaaggctgatattagttctgtttacggtagtgtacagtactttgattttgaggagtatgatctaagaaatgaatctataaaattgtcacaagaggaagaatattaccttttgaaacgtgtcaaattagttgtaaacactatcgctgggaaagttgaggttagtcgtaaatgaaaaagcaccactactttttagctttcttctatggaagtgtcattatatttgccatttgttttgtcattattgatagtttgggtgttaatttggtgcacctctatcaaacgtctcgtttgtggctgattgaacaattgattttctctattttctttctatctttagcggtaactatccttttattgctaacttggtttttattagatgataatagtaaacgtcaaattaaccataatttacgtcgcattttaaataaccaatcaataaatgttaccgatgatggtactgaaatatcgaccaatattcaacggctctctaaaaaaatgaatttaatgacagcaagtctacaatctaaggaaaatagtcgtattttaaaaagccaagaaattgtgaaacaagaacgtaagcgtattgcacgtgatttacacgacacagttagtcaggatttgttcgctgcttccatggttttgtcagggatagcacagaatgtttctcagctagacgttgatcaggttggctcgcaattattagcagtagaagaaatgcttcagcatgcacaaaatgatttgagaattctgctacttcatttgaggccagttgaattagaaaataagaccctatctgaaggattcagaatgatattgaaagaattgaccgataagagcgacattgaagttgtttatcatgaatcaattctaaccttacccaaaaagattgaagacaatatttttagaattggtcaagaatttatcagtaatactttaaagcattcacaagccagtcgtctcgaagtttaccttaatcaaacagagaatgaattgcagttaaaaatgattgataatggtattggatttgatatggattctgtctatgatttaagttatgggttaaaaaatattgaagatcgagtagaagatttagcaggaaatttacagcttctcagtcagcctggtaaaggagttgctatggatataagattacctttagtaaatcagagtgaggataaaaatggataaaataaaaattgtacttgttgatgaccatgagatggttcgtctcggtttaaaaagttttttaaacttacaagctgatgttgaagtaataggtgaggcctcaaatggtttagaaggcataaaaaaagcactggagttacgtccagacgttgttgttatggacttagtaatgcctgaaatggacggtgtagaagcaaccttagcattattgaaggattggccagaagctgccattttagtcttaacatcttacttggataatgaaaaaatttaccctgttattgaagcaggtgccaaaggctatatgttaaagacctcaagcgcagcagagattcttaatgccattcgtaaagtttcaaggggagaacaagctattgaaaatgaagtagataagaaaattaaggctcatgataaatgtccagctttacatgagggcttaacagcaagggaacgtgatatccttaatttattagccaaaggttatgacaatcaaaggattgctgatgaattatttatctcgttaaagactgttaaaactcatgtttctaatattttgggaaaactaaatgtagcagatcgaactcaagcagttgtctatgctttccaacaccatttggtaccacaagatgatgaataagtgatataatagaggcactatgttaatgaaagtggttagtcatggacgcaaaaactaaatataaagcaaaaaaaataaaggcagtgttttttgatattgatgacacgcttcgtgttaaagatacaggttatatgccaccatcaatcttaaaagtttttaaagctttgaaagataaaggaatcgttgtaggtattgcttcaggaagagcacgatatggcgttccaaaagaagttcaagatttaaatgccgattattgtgtaaaattaaatggagcttacgttaaggacaaggataagaatattatcttccatcgtcctattccagctgaatatgtagagcaatataagaaatgggcggacactgttggtattaagtacggtttagctggtcgtcatgaggcagttttatcagatcgtgatgatttggtaaatgatgcgattgatattgtgtattctgatctcgaagttaatccagatttcaataaagaacatgatatttatcagatgtggacatttgaagataaaggagatagccttcatctacctgaaccgttagctgaacatcttcgcttgatacgttggcatgatcattcttcagatgttgtgttaaaaggaacatcgaaggctttaggtgtttctaaagttgttgaacatttgggcttaaagccagagaatatcttggttttcggagatgagctcaatgatttagaactctttgattatgctggactagctgtggcgatgggagtgtcacacccagaagctcaaaaaaaagcagattttatcacaaaaaaagtagaagaagatggcattttgtatgccctggaggaactaggtttgatagaaaaagaattaacatttccacaagtagatattgaaaatacagaaggtcctgtggctgtcattaaaacaaatcacggggatatgactgtaaaactcttcccggatcatgctcctaaaacggtagcaaactttattggtttagctaaacaaggttattatgatggtattatcttccatcgtattattccagattttatgattcagggtggtgatccaactggtacaggtatgggtggtgaatctatctatggggaaagttttgaagacgaattttccgaggaattatataatgttcgcggagctctttcaatggctaatgctggaccaaatacgaatggcagccaatttttcatcgtccaaaatacaaaaattccttatgcgaaaaaggaattagagcgaggtggttggccaacaccaattgctgagttgtatgctggacaaggtggtacaccgcatctagatcgtcgccacagtgtatttggacaattagtagaccaaagttcttttgaggtacttgatgagattgcggcagtagagactggttctcaagacaaaccattggaagatgttgttattttaacgattgaggttaaagaataaaatgaagattggcgataagttaaagggaacagtcactggcattaggccttatggagcctttgtttctcttgaggatggtaggactggacttatccatatttctgaaattaaaacaggttacattgataatatttatgatgttcttagtgtaggtgatgaagtctatgttcaggttatagatgtagatgaatttacacaaaaagcaagtttatcgcttcggacccttgaagaagagagacatcatattcagcatcgtcatcgattttctaacaatcgtcttaagataggtttcaaaccacttgaggaaaatttacctagttgggttgaggaaggtctagcctacttgaataataaataaacaaaaaacctagatttgattaatgacaagtctaggttttaaatatttaaaagtagcagtgaatattatacttgctaaaaatagcttgataatcgagtagatcctctgggtgtagtgcagcgatctcttccatttcatattgacgattaagtaattgatatttgttttgcccaaattggtggaaaggtaagagttgcacttgacggatatctaggcgatcaaataaacaagcaaattcttcagcatcttctaatgaatcgttaaaattaggtatgacaggaatacgtagcacaatcgttttaccgttggcaaaagcataatgaatgtttttgatgattgaagcattcttaaccatcgtcttttcttggtgtttgaggctattgtaatgttttaaatcggtgtaaataaaatcaacgtattggataagatctatgaattgttcatgtctagtataagcagttgtttcaatagccgtgtggattcccagtgatttagcacgttttaaaattgccttggcaaattcaaattgtgcaaatatttcaccgccagatagcgttatgcccccaccagattcttcgtaaaaatcaatatcttttaaaacttcttcaataatatcatcaaccgatttttcttcgcccacgatgacgctttcattagtaatggcatctctcattgtttctggaaccattttttgcgactcgggattagcacaccaaggacatctaagaggacaaccctttaagaaaacggttgttcgaatacctggaccatcgtgaatactaaaatgttgaatgttgaatacaatacctttttcatttgtcatattattttcctcaatttcattttaagtataccttttatacgtaacaaagtcaattacgaatgaaagtttattgaacttgtttaataaataaaaaatgataaaatagaaaggaggtgtttcatgaatagattagaaaatattattagtttagtatcccagtaccaaaaaatagatgttaatacactctcggagttgttgcaagtttctaaagtaacgatacgtaaagatttagataaactagaaggcaaagggcttttgcatagagagcacggttatgcagttttaaacagtggggatgaccttaatgttaggttatcttttaaccataaaactaaaaaagaaattgctgccttagctgcaaatatggtgtctgacaatgacactatcttaatagaatcaggctctacttgtgctcttttagcagaaaatatctgtcagacaaagcgaaatgtcactattttgaccaactcttgctttattgctaactatttacgagagtatgattcatgccaaattgtcttacttggtggtgagtatcaatcaagttcacaggttacggtaggtcctctcttgaaaaagatgatttcactttttcatgtctcgttagcttttgttgggactgatggttttgatccaaaactaggatttatgggtagagatttaatgcgttctgaagttgcacaagagatggcgaatgctgccgatgaagtcattattttaacagattctagtaagtttaatcagactgcattggtggaacagcttccgttgtcaactgtatcacaagttattacagataaacatccaaattcggaaattgctaatttgttccaagaagcagagattaccattcaatctttattacaagtaccataaaagaggctatttttcttacattttgcacatttgtggcgataatagataaagtgtcatgtcaaattgcacagatgtaacctttttgttaaactgaagcaaatgctgaaaggttatgagtatgaaattagagcgtcaaaaattgttagctaaagtagcttacctttactatatggaagggaaaagccaatctgagattgccaatgaattaggaatttatcgtacaacaataagtcgtatgttagccaaagcgagagaagaaggtcttgttagaatcgaaatttcagattttaatccagaaatttttcagttagaatcctattttaaaagtaaatatcaccttaaagatattgagattgtttcttcgcgaaaagatagcgatacttcagagatagagaaggatttagcacatgtagctgcagctatgattcgaaaaaaaattaaagagaatgacaaggtggggattgcttgggggaggacacttagtaaagtagttgaagcaatgcgtcctcatccggtttctcaagtttcttttgttcctttggccggaggtccaagtcatattaatgcacgctatcacgttaatactctggtttacgaaatgtcaaggcgtttccaaggaagttgtactttcattaatgcaactctagttcaagaaaacgctaatttagcgaaaggaatattaacttcaaaatattttgaggggctaatggataattgggaaaaacttgatgtggcaattgtgggcgttggtggtaaacctaaaagcaatgaacaacagtggcttgaccttttaaatcaagatgattttcaatgcttggatgaagaagcagctgtaggtgaaattacttgtcgtttttttaatcattcaggtgatcctgtgaatcaacatttagctaaaaggacaataggaattaccttagaacaactacagaaagttcctaatagaatagcggttgctcatggcaattataaggctgcggcactcttagccgttttaaaaaaggggtatattaatcatttagttactgatttttccacagccttaaatattttaagattagataaagacacctttgtggatactatatatcaaaagagctaggaataaatcctagctcttttgataatgtttctattaccaagtgaattgttatagaataagcacaaaggtgcgctattgtcataaagggcacaaagtctattgacgatgattaagggacatgttacatttgttttgcgaaagaaaactagaaccttttgtaagaaagtttaaacttataaaaaatcattaaagcggaggtgcttatggaaatcatagtcgcagaccaaattattatggggctcattttgaatgctggggatgctaaacaacatatctatcaagccttaaaacttgcaaaagaaggaaattttgcagaaagtaagattgaaatagaactagcagatagtgcactcctagaagctcataatcttcaaacacaattccttgcacaagaagcaggagggacaaggacagatatctcagcactctttattcattctcaggatcatttgatgacaagtattactgagattaacttgattaaagaaattattgatttacgccaggaattacatattcaaaaataagtaaaggggatcaaatatgataaaaattggtttattctgtgcagcaggtttttcaacaggtatgttagtaaacaatatgaaaatcgcagcggataaagaagggatagaggcacatattgaagcttattcacaaggaaaaattgcagattatgctaaagatttagatgttgcattacttggtccacaagttagctatactctagataaatcaaaatcaatctgtgatgaatacggtgtaccgatagcagttattccaatggcagattatggtatgttggatggtgtaaaagttttgaaacttgctttgagtttattggaaacaagaaaagaggcttgatatgtcaaagtttgatagtcagaaaataattactccgattatgaagtttgtcaatatgcgagggattattgcactcaaagatggcatgctagcaattctaccactaacagttgttgggagtctctttttaatattagggcagcttccatttaaaggtcttaatcaagccatagctaatgtttttggaccagaatggacagaaccatttatgcaagtttattcaggaacttttgcgattatgggcttgatttcctgttttgcaattgcttatgcttatgctaaaaatagtagtgtagaaccgttacctgctggcgttttatcactttcgtctttctttattttaatgaaatcatcttatattcctgtaaaaggagaagcaatagcggatgctatttctaaggtttggtttggcggtcaggggattattggagcaattattattggcttagtagttggtgctatctatacatggtttatccaacatcatattgttataaaaatgccagagcaagtaccacaggcaatagcaaaacaatttgaagctatgattccagcttttgttatctttcttttatcgatgattgtttatttgattgctaaggtaacaactggaggtacctttattgagatgatttatgatatcattcaagtaccgttgcaaggcttaacaggctcactttatggagcaattgggattgctttctttatttcattcttatggtggtttggtgtccatggccaatctgtggtgaatggtattgtgactgctttgttactatccaatttagatgccaataagtctttattagcagcaaatcgcttaacattagataatggcgctcacattgtaacacagcagtttttggatagtttcttgattttatcgggctcaggaataacttttggactagttattgcgatgctttttgcagcaaaatcaaaacaatacaaggcacttgggaaagtggccgcttttcccgcaattttcaatgttaacgagccaatcgtctttggctttccaatcgtaatgaatcctgtgatgtttctgccttttattttagtaccagttttggcagctttaattgtttatggagctattgcggttggttttatgcaaccattctcaggtgttactttaccatggagtactccagcaattatttctggattcatggtaggtggttggcaaggtgcactcgtccaaatagtcattttagctatctcaactgctgtttacttcccattctttaaaatccaagataatattacttacaaaaatgaatgtgaaatggaaaggggatagctagcagataagaggttgaggtgtgtaatgcaccttaacctttttctaaaaatgcacatttgtgcaactttagatgtagcattctattctttattttcttcttgttattttaggatttaggtgctattatatttacgaagaaaaactttttagtttcgaaagaaacaagcggaggctgttatgaccaaacaattactcactcaaaaatatacaaatgatgttcaacaaaattctcaaaagcattttggctatttgacagagcgcatgtattcttatcgcgataaggttcttgataagaaaccattcatagatgcagaacgtgctatcttggtaactgaagcctatcaaaagcatcaggaaaaacctaatgttttaaagagagcttacatgttgcaaaatattttggaaaaaatgacaatctatattgacgatgagacaatgattgtcggtaaccaagcttcatctgataaagatgctcctatttttccagaatacactctagaatttgttgtaaatgaactagacctttttgaaaaacgagatggtgatgtcttttacattacagaagaaaccaaagaacaaattagaaatattgcacctttctgggaaaataataatttacgggctcgtgcgggcgttatgcttccagaagaagttcaagtttatatggagacaggcttctttgggatggaaggtaagatgaattctggggatgctcacttagctgtcaactatcagaagttactagaagaagggcttattggctttgaaaaaaaagcaagaaaagctaaagctgacttagatttaacaaagcctgagagtattgacaaatatcatttctatgattctattttaattacaatagaagctgttaaaacctatgcagagcgttttgctatcctagcaaaaaaacaagctaaaacagcaaatgctaagagacgtcaggaattgttagatatcgctagtatttgtgaacgagtgccctattacccagctgaaacgtttgcagaagccgttcaatcggtttggtttattcagtgtattcttcaaatagaatcaaacggtcattctctatcttatggacgctttgatcaatacatgtatccatatgttaaatctgacttagaagctggacgtgagactgaggattcgatcgttgagcgcctaactaacctatggattaaaacaataactattaataaggttcgtagccaagctcatacgttttcgtctgctggtagtcctctttaccaaaatgtaacgattggaggacaaacacgacataaggaagatgctgttaatcctttatcatttctagtactaaaatcagtcgctcagacacacttaccacagcctaatctaacggttcgttatcatgctaacctagacaagtcattcatgaatgaagctattgaagttatgaaattaggctttggtatgccagcttttaataatgatgaaattattattccatcatttattaaaaaaggagtttccgaagaagatgcctatgattattcagcgattggttgtgtcgaaacagcagttcctgggaaatggggttatcgttgtaccggcatgagctatatcaacttccctaaagtgttattaattacaatgaatgacggtattgacccggcttctgggaagagatttgcgccttcttatgggcatttcacccagatgacctcatataaagaacttaaagaagcttgggacaaaacacttcgttacttaactcgaatgagcgttattgttgaaaatgctattgatattagtctcgaaagagaagtacctgatattctttgttcagctttaactgatgattgtattggacgaggtaagcacttaaaagaaggtggtgcagtatatgactacatatctggtctacaagttggaatcgctaatctttcagactcacttgctgcgcttaaaaaattagtatttgaagaaaaacgcctaaccacattagaagtatggcaagcattgcagagtgattacgcaggtccgcgtggtgaagaaattcgtcaaatgttgatcaatgaagcaccaaaatatggaaatgatgatgactacgcggatagtttagtacgtgagtgttatgatgtttatgttgaagaaattgctaaatatcccaacacacgctatggacgtggaccaatcggtggtattcgctattcaggaacgtcctctatttcagcaaatgtaggccaaggacgaggtactttagcaactccagatggtaggcatgcaggaactccattagctgaaggttgttcaccatctcataatatggacaaaaagggacctacctctgttttgaaatcagtttcgaagttaccaactgatgagattgtcggcggtgtactccttaaccaaaaagtcaaccctcaaaccttggcaaaagaagaagataaacaaaaattaattgccttacttagaacattcttcaatcgccttcatggttaccatatccagtataatgttgtctcacgtgagactttgattgatgctcagaagcaccctgaaaaacaccgcgatttgattgtgcgtgtagcaggttattctgcattctttaatgtcctatctaaggcaactcaagatgatattattgcacgtacagaacatgctctttaggagattattatggaatttttacttgacactttaaatttagaagctataaaaaaatggcatcatatactgccactagcaggtgtaacttcaaatcccaccattgctaagaaagaaggagatatacattttttccaacgcattcgtgatgttcgagaaattattggacgtgaagcaagtttgcatgttcaagtagtggccaaagattatcaaggaatattggatgatgctgctaaaatacgccaagaaacggacgatgacatttatatcaaagtcccagttacgccagatggattagcagcaattaaaacgttaaaagcagaaggttataatattacagccacagcaatatacaccagtatgcaaggtcttttggctatatcagctggagcagactacctagcaccttactttaaccgaatggagaaccttgatattgatgcgacacaagttattaaggaattagcgcaagcaatagagcggacaggttcttctagcaaaattttagcagctagttttaaaaacgcttcacaagtaacgaaggccttatcacagggtgctcaatcaatcaccgcgggaccagatatttttgaatcagtctttgcgatgccatctattgcaaaagctgttaacgactttgcagatgattggaaagccagtcaacactcagaacatatttaacagagaacgccaacttttgaggctgtatctttaacataaaattttttaaagaagaaagaggttgagaatgaaagttttcgcaagtccatcgcgctatatacaaggaaaggatgctttattccaaagtattgaacatatcaaatctttaggtcagactccacttatcctttgtgatgatgttgtttataatatcgttggagaaaggtttttatcttatctacaagacgatttgttaccacatcgtgtttcctttaacggagaagcatctgataatgaaatcaatcgtgtcgttgctgttgcgaaagaaaagaatagtgaccttattattggacttggtggtggaaaaactattgactctgcaaaggcaattgcagataaagttaatttaccagtggtcattgcaccaacagtagcttcaacagatgccccaacatcagcgttatcagtaatctatacagatgaaggagcttttgaaaaatatattttttattcaaagaatccagacttagttttagttgatactcaagtaattgcccaagcgccaaaacgtttactagcttctgggatagcagatggcttagctacttgggttgaagcgagagcagtcttacaaaaaaatgggatagcgatggctggcggtagacagactttagcgggcgtggcaattgcccaagcatgtgagcgtactttatttaatgatagtttacaagctttagcggcttgtgatgccaaagtggttacaaaagctttagaaaatgttattgaagctaataccttacttagtggtttaggttttgaaagtgcaggattagctgcagctcatgctattcataatggttttactgccttgagtggagatattcatcacttaacccatggtgaaaaagttgcctatggaacgttgacgcaacttttcctcgaaaatagaccaaaggaagaaattgatcgctacattaatctttaccaagcgattggaatgccaactacacttgcagaactccatttgggtgatgcaacatatgaagaacttttaaaagttggtcagcaagcaacaattgaaggtgaaacaatacatgaaatgccattcaaaattagtgcagaggatgtcgctgcagccctgttaacggttgaccgttatgtttcaaatcatcaataaaaacaatagaaccaagtgaaattgcttggttctatttgtcgttttaatattttaactaaatagggcttactagtatttaaagagatataaactaaaaaagatcagacaacatatctaatcttttttagttatcgtttactgaagattaaagttattcaaaatcatacaggcttgttgataagtaacgttcgccattatcagggagaagagctaaaacctttttcccttttcctagttgtttggccacttcaatagcagcataaatagcagctgaagcagaaattcctgcgaggaaaccttctagtccgccgatgatacgtcctgtttcaatagcatcgtcagatgtaacgcgaatgatatgatcataagaatctgtagccaatgtttctggaatgaaacctgcagaaatcccttgtattttatgaggcccaggttgctcaccagaaaggattgcagattcatcagcttctacagcataaatagcgacatcaggattgactttttttaatgcacgagagacaccagtaattgtcccaccagttcccacacctgcgataaaagcatctaaacctttttcaccaaaagtctcgataatttccctaccagtcgttttttcgtggatttctggattggcttgattattaaattgcaggggtagccaagcattttgctctgcagaaatttcttttgccttagcaatagctcccttcatcccttcactaccaggtgttagtactaattgagcaccataggcttgaatgattttacgacgttcaattgacatggtttctggcataacaataataacattataccctttagcttttcctacccaagccaaaccgatacctgtattaccagatgtaggttctacgattgtatctccggctttaagaatccctttttgctctgcatcttcaatcatagctagagcgatacgatctttgacagatgaacctgggttaaaggattctaacttaacgtacacctctgcagctccttctggaacaatatgatgtaattgaataatgggtgtatttccgattaagtctgtaatagaattataaatttttgacataagctatacctcttcatgatattggttaagaatattataaaactcacattgattaaagtaaaatatcaattctttatcaagtgatagctattatttatcggtttcagccttaaagggaatttcaacaatttgactcccttcttcagttaacaaagcttttccttggtagaactctgtcaaattagttattgtgtgttcaaattccttagggtcaacgtatattttacaggttacagcttctaaaaattctgtttcaaactcctgaaggtggtgctcttttaggaagttgtcaaaagtttgatattgaggataagttaattgaatacgaataccaatttgttctttaacttctactaccccgatctctttgatggtattagctacgctaccagagtaggcacgaataagcccccctgcgcctaatttgatacctccaaaataccgtgtaacgacggcaacaacatttgtcaggccttgcttttcaagtacggttagcatagggatacctgctgtaccactaggttctccatcatcactagatcgttttatatcccctttttcgccaataaccatagctgaacacgaatgattggctttgtagtgcgctttcttgatttgcgtaatataattacgcccctcctcttcggactctactcgctttagatgacaaataaatcgcgattttttaatttcttcttcgacaattccgtctgattttatcgttttatagttcatagagaaattctacaaaaattcttcaaatttagcaaaaaaatccgaatgaaataatatggaaaattatttaggtaggctttggacaaaagcacaattatctgagcaacttagaaaaattgcaattagcttgccatcttttataaagaaaggaagcgactatatttgtacccgatgctctagttctgttgctaaaaattgccaattaccaactggaaattattattgtagagaatgtatagtttttggaagagttactagtaatgaaaatttatattatttcccacaaaaaacattttctaaaacgaattctttaaaatggaaaggggaactgacaccttatcaaaatgaggtttcagaagagttgttgaaaggtatttcaagtaaggaaaatcttcttgttcatgctgtgacaggggctggtaaaacagaaatgatataccactctgtcgccaaagtaattgatactggaggaagcgtttgtattgccagtcctagaattgatgtttgtttagaattgtataagcgactttcaaacgattttagatgtgccataacattaatgcatggagaatctccttcttatcagagatcccctttaactattgccacaacacatcaattgttaaaattttatcatgcttttgatttgctaattgttgatgaagttgatgcttttccgtatgtcgacaacccgatactataccagggtgtaaaacaggccttaaaggaaaacggaacaagtatttttctgactgcaacttcaacgactgagttagaaagaaaagttgcaagaaaagaactaaaaaaattgcatctagctaggagatttcatgccaatccgttagtgatacccgagatggtttgggtaagtggtatccagaaaagcttgcagacacaaaaactacctcccaaattatatcagttgataaataaacagcgacaaacgagatatcctttgttattatttttcccccatatttcagaaggtcaggtattcaccgaaattttaagacaagcctttcctatggaaaaaattggttttgtttcaagtaagagcacatctaggttaaagttagtgcaagattttcgagataacaaattgtctatcctagtgtcaactaccattctagagagaggagtaactttccctagcgtcgacgtttttgttatacaagcaaatcatcatttgtttacgaaaagttccttggtacaaatttcaggaagagttggaagagcattagaaaggcccgaagggctcctttacttccttcatgatgggaaaagtaaatcgatgcaccaagctataaaggagattaaaaacatgaatcatataggaggattttaatgacttgtttgttatgtcatgaaatagatttatcgcaattaacttttgtggaacttatgcttctaaaaccaaagcaaaacgtaatttgtcaaacgtgcaagggtagttttgaagcacttagtagggagatgggttgccaaacatgttgcaagcaaattccccaaaaacaatgtcaagattgtatttattggggtaaaaaaggtatagaggtaaatcatttttccctttatagatacaatgaagcaatgaaaaaaaatttttctctttttaaatttcaaggggattatttgttgaaagatgtttttacaaaagaaataaaagctgctctaaaaaagtataagggctacactatagtgccagttcccttgagtcatgaaggataccaaaataggcaatttaatcaagtgattgcttttctacaatcggcaaatataccttacaaaaatattctttctaaaaaagatggaggtaagcaatcggctaataataaagaagaaagactcaaacaagttcagcaatttacattaaaaaatgaggctgagttaggggacaaccttttaattgttgatgatatttatacaacaggcgcaacaatagcacaaatcaggaaactattagaagaaaaaggtataaaaaatataaaaagtttttcattagcacgctaaaatcttgcaaattttcatgaaagcggttataataagagtatagaaagcgttaacaacgcaagaaagaggtactcatatgattaaatacagtattcgtggtgaaaacatcgaagtaacagaagctattcgtgagtatgttgagaccaaactctctaaagttgaaaaatactttaatgaagcacaagaattagatactagagtcaacctcaaagtatacagagagaagaccgcaaaagttgaagtaacaatcttaatagattctattactttacgagcagaagatgtttcacaagatatgtatgggtcaattgacttagttgttgataaaattgagcgtcaaattcgtaaaaataaaactaaaattgcgaaaaaatatcgtgaaaagattccagcaagtcaagttttcacaacagaatttgaggctgagccagatgaagaagcagtaagccaaagaattgtacgtactaagaatgttaatctaaaaccaatggatgttgaggaagcattgttgcaaatggaacttttaggtcatgatttctttatctatacagatgcagaagataatacgacaaatgtcctttacaagcgtgaagatggcgaactaggtttaattgaagctaaaggaaattaactttgtaacataatttaaaaaatctcagggttttctctgagatttttttaaaacctattgacaacaaataaaaaattatagtatactaaatgagttcttaagcgaacctaatattgtattatcattttataaacaacttaaaaaaagtagttgacaaagcagaataagtttgctagaatatagaagttgtctcaagagaggcaaagacctttgaaaactgaacaagatgaacgaatgtgcagggtggatttacattgtaaatccgtcaatgacaaaaaacaataaatctgtcagcgagacagaaaagagcaaagctcaaacttttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggataaggaaacctgccatttgcgtcttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattgtagaaagtaacaagaaaataaaccgaaaacgctgtgaatatttaatgagttttctagttttaaagaaactaggttaataaggttaagttaataagggcgcacggtggatgccttggcactagaagccgaagaaggacgtgactaacgacgaaatgctttggggagctgtaagtaagcgctgatccagagatgtccgaatgggggaacccactagttaatgactagtatccatatctgttaaggatatgagaaggaagacgcagtgaactgaaacatctaagtagctgcaggaagagaaagcaaaagcgattgccttagtagcggcgagcgaaacggcaggagggcaaaccgaagtgtttacacttcggggttgtaggactgcgatataggattaatcattatagaagaattacctgggaaggtaagccaaagagagtaacagcctcgtatttaaaatgatagattaaccttagcagtatcctgagtacggcgagacacgcgaaatctcgtcggaatctgggaggaccatctcccaaccctaaatactctctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcgtcatagtatcatgttgtagacccgaaaccatgtgacctacccatgagcaggttgaaggtgaggtaaaactcactggaggaccgaaccagggcacgttgaaaagtgcttggatgacttgtgggtagcggagaaattccaaacgaacttggagatagctggttctctccgaaatagctttagggctagcgtcgatgttaagtctcttggaggtagagcactgtttgggtgaggggtccatcccggattaccaatctcagataaactccgaatgccaacgagatataatcggcagtcagactgcgagtgctaagatccgtagtcgaaagggaaacagcccagaccaccagctaaggtcccaaaatatatgttaagtggaaaaggatgtggggttgcacagacaactaggatgttagcttagaagcagctattcattcaaagagtgcgtaatagctcactagtcgagtgaccctgcgccgaaaatgtaccggggctaaaacatattaccgaagctgtggatgacacaaaagtgtcatggtaggagagcgttctatgtgtgaagaaggtgtaccgtgaggagcgctggaacgcatagaagtgagaatgccggtatgagtagcgcaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatatagtgatggagggacgcagtaggctaactaaaccagacgattggaagtgtctggtcaaacagtgaggtgtgatatgagtcaaatgcttatatctttaacattgagctgtgacgaggagcgaagtttagtagcgaagttagtgatgtcacactgccaagaaaagcttctagcgatacatatactctacccgtaccgcaaaccgacacaggtagtcgaggcgagtagcctcaggtgagcgagagaactctcgttaaggaactcggcaaaatggccccgtaacttcgggagaaggggcgctgattttagatcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctatgataacgggacgccagtttcgtttgaggcgttgttgggatactacccttgtgttatggctactctaacccagataggcaatccctatcggagacagtgtctgacgggcagtttgactggggcggtcgcctcctaaaaggtaacggaggcgcccaaaggttccctcagactggttggaaatcagtcgtagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataagcgctgaaagcatctaagtgcgaagcccacctcaagatgagatttcccatgattttatatcagtaagagccctgagagatgatcaggtagataggttaggagtgtaattgtggtgacacatttagcggactaatactaatagctcgaggacttatccaaaaagagatattgacaacgttacggtttcttgttagactatagatattcaattttgagtgaataaggctcaatagttaagtgataattgcctaggagatacacctgttctcatgccgaacacagaagttaagccctagaacgccggaagtagttgggggttgccccctgtgagataaggtagtcgcttagctataatccgccatagctcagttggtagtagcgcatgactgttaatcatgatgtcgtaggttcgagtcctactggcggagtagataaagggagactaactttggttagcctttttttattggaattattatccttaagattggctaacatcttaattgtccgaatttgtcactgataccaagtggttacgattaaaagtggaaaaactatcctatgttctaaataaaatcgtcctaagtaagcttacttaggacgatttgttatctatctaatagtgtaagtagtgtaataggtactatttttggaagaatgtttcatatagtgctttaatagctcttttttcatccttactgtttataacgaacataatggagacttcgcttgaaccttgtgatatcatggtgatattgattttttctcttgataaggcttgtgtcgctgttgcagtgactccaatctgacttttcatattttcacctacaattacgattgtagatagattgtgttggatgtcaacgtaatctacttctagtttacgagttaggtaatttaagatttcttgttctttgattggtgtcaattctttttcacgtaagacaatggatagatcatctatgccagttggcatatgttcaaaactaatatttaaatcctctaaaatttgtagtacttttcggccgaaacctacttctctattcattaagtatttagatacgtttatgctagcaaaacggctatcagaagcgatcccagttactgctatgttactacgagtatgctttaaaactatttttgtaccaggctgttggggattatttgtatttttaataacaagagggattctgccacgataggcaggaagtaaagcttcatcatgtaaaaccgaaaaacccgcataggctaattcacgcatttctttataagtaagctcagggatagcgtgagggttcttaactacacctggatgtgctgcaaatataccatcaacatctgtgaagttctcataaaggtctgcttttatgcctgctgcaattagggatccagtaatgtcagatccccctcttgaaaaggtacaaatttggttatcttctgtgactccaaaaaatccagggataacaagaacctcattgtatagacataagttctcaatcttatcataacttcctggaataattcgtgcattacatggttctttagttacaataattcctgcttcgtttggatgaacatatcttgcaggaatgtcattttgattaaaaaacgttgcaactaactttgcgttgttatcttcaccggctgctaaaaaacaatcatataaaaactgattattttctatgggaagtgaagctagctgctctatagagcgagtaatttcttctgcaatagtgcttcctaaagacaaatcactaataatttcttgataacgattgataatccaagtttggtctttaacaatatctttaccgttaatataattttgataatattgtatcaaagcatctgtcatttttaagtcttcttcgtagcgtttccctggagctgaaacgacaacaaaccgtctagtgtagtctgatttgataatatttagtactttgtataattgttgggaagatgctaaagaacttcctccaaatttgactactttcataggttacctcaagaatgaattttagataaattataacaaaagtcagaaaatttgtcattacctctaaatttaaaagaatgatataatagttacatgtgtaaatataaagcaataatatttgatatggatggtgttctatttgacactgaattattttattataaaaggcgagagcgttttttaaaacaacatggaattacaattgaccatttaccaatgaatttttttattggaggaaatatgaagcaggtttggaaatctgttttaggtgatcaatatgatacctgggatattgataagctccaacaagattatagtcgctataaagaggataatcccttgccatacaaagatttaatttttcaggattgtaaaagagtcattgaaaagcttcatcacaaaggctatcttttgggtctagcttcaagttctactagacatgatatcatgttagcattagaaagttttaatctggatacatattttaaggtaattctgtctggtgaggaattttcagaaagtaaacctaatccagctatttataatagagcagcagaacttttagatattcctaaacagcaaattcttattgtagaagacagtgagaaggggattacagctggtattgcagccggtattgatgtgtgggctattgaagataaatactttggaatgaatcagtcgcaggctaatgtattagtgagcgatctgagtcaattttttgtgaaattagataactattaaaaacgggaagtttaattccgtttttttattttttatcttgccatgaaagctaggtttatgataaaatacaaagcatgataatttgataatcaaattattttttatttttctttcactcttaaagagaggagacattttgaagttcgaaaatataatatatggtattgatggcaacgtggccactattatgcttaatcgaccagatatttcaaatggttttaacatcccaatgtgtcaagaaattattgatgcaataaggcttgtgtctgaaaataaagatgtcatgtttttagtgattgaagcacaaggaccaatcttttcaatcggaggagatttaaaagtgatgaaagctgctgttgagagcgatgatattagctcattaactaaaattgctgagttagttaatcagatatcgtatgatttactacagctagagaaacctgttgttatgtgtgtagatggggctgtagctggtgccgcagctaatattgcattagcagctgattttgttatcgcaagcaagaagagtaaatttatccaggcttttgtgggtgtcggtttagctccagatgcaggaggtttattgttacttagtaaatcaatcggtataactcgtgcagtgcaactagctttaactggagaaagcttatctgctgaaaaagctgaagctttgggaattgtttataaactttgtgaatcagataaaataggtaaaattaaggatcaactattaaagcgtttaagtagacattctataaactcatatcaagccataaaatcattagcttgggaagctgcttttaaagattgggaacaatataaaaagcttgaattacaactgcaagaatcattagcctttaagcaagattttaaagaaggtgttcgggcacacgctgatagaaggcgtcctaattttttaggcaaatagtttgaaaatcaaattatttaagattaaagtcttgcaaataagtttgaactttgatataatttgattatcaaagtttaatgtgaggtggtgatatcttggaatacgatcagattaatagttatttagttgacatttttaatagaatcatgattattgaggaaatgagtttaaagactagccaatttagcgatgtatctttaaaagaaatgcatactattgaaattattgggaaacattctgaggtaactcctagcgatgtcgctcgagaattaatgttaactttgggaactgtaacaaccagccttaataagttagaaaaaaaaggctacattgagcgtaaacggtcaagtattgatcgtcgagttgttcacttgagtcttactaagagaggtaggttattagatcgattgcatagtaaatttcataaatctatggtatctcatattattgaagacctaggtgaagaagacataaaaatgttgacgagcgctttagggaatcttcataaatttttggaggacttagtctagtggtttttgctaaaattagtcaacttgcacattatgcaccttctcaaattattaaaaatgaggatttatcattaatcatggataccagtgatgactggatttcgtcacgtactggtataaaacaacgtcatattagtaaaaatgaaacaacagctgatttggcaaataaggtcgcagaacaacttattgaaaaatccggttattccgctagtcaaattgactttattattgttgcaacgatgacaccagactctatgatgccttctactgctgcaagagtgcaagctcatattggagcgagtaatgcttttgcctttgacttgagtgcagcatgtagtggttttgtttttgccttgtctaccgccgaaaaattgatatcatcaggtagctatcaaaaaggtttagtaataggagcagaaactgtttctaaagtattagactggactgatagagggacagcagttttatttggagatggagctggaggtgtcttgctagaagcttctaaggaaaaacattttcttgcagagtctctcaatacagatggtagtcgtcagggacttcaatccagtcaagtcgggttaaattcacctttctcagatgaagtacttgatgataaatttttgaaaatggatggtagagcaatctttgattttgctatcaaagaagtttcaaaaagtatcaatcatcttatagaaacatcttatttggaaaaagaagatattgattatcttttcttacaccaagcgaatcgaaggattttagataagatgtctcgaaaaattgatatagcacgtgataaatttccagagaatatgatggattatggtaatactagtgcagctagtatccctattttactttcagaatcttatgagaacggtttgttgaaactagatggtaaccaaacaatcctcttatcgggtttcggtggaggtttgacatggggaagtctaattgttaaaatttagttatatatagtgcatagcacatttataaaagattatttaaaatttaaggagctaaaaatggcagtatttgaaaaagtacaagaaattattgttgaagaacttggtaaagatgcagaagaagtaacgttgaacactacttttgacgatcttgatgctgattcgcttgatgttttccaagtgatttcagaaattgaagatgcatttgatatccaaattgagacagaagaaggactaaatactgttggtgatttagttgcttatgttgaagaaaaagtaaaataattaagtcgtaagaaaaaaagaagcaagtgataataaaagatattcttaccaaatcacttattagagtgagtattcaatcaatcgttgatcggtactcactcttcttcttatcaatatagtttgattgtcaaattattaattttaggaaagaaaaatgaaaacacgtataacagaattactaaatataaaatatccaatttttcaagggggtatggcgtgggtcgctgatggagatcttgcaggagcagtttctaaggcaggtggtctaggtattattggtggaggaaatgcccctaaagaggttgtcaaagcaaatattgataaaataaaatctatgactgataaaccctttggtgtgaatattatgcttttatcaccttttgtagatgatattgttgatttggttattgaagaaggtgtaaaagttgtaacgacgggtgcaggtaatcctggtaagtacatggagcgctttcatgaagcaggtataacagtaatccctgttgttcctagtgttgcattagcaaaacgtatggagaaattaggggctgatgctatcattacagaaggaatggaagcgggtggtcacatcggaaaactgaccacgatgacattagtacgacaggttgttgatgctgttacaattccagtcattgccgcaggtggtatagcagatgggcgtggggctgctgcgggtttcatgttaggagctgatgctgttcaggtaggaactcgttttgttgttgctaaagaatctaatgctcaccctaattacaaagcaaaaatcttaaaagcaaaagatatcgacactgctgtttctgctcaggtagtaggtcatccagttcgtgccttaaaaaataaactagtaacaacctatagccaagcagaaaaagattatttagctggccgtatttcaatcaatgagattgaagaattaggagcgggagctcttcgcaatgcagttgttgatggggatgttattaatggttcagttatggcaggacaaattgcaggattaattaaatcagaagagacttgtcaagagattcttgaagatatttattcaggagcgcgtcaagttattctttctgaggcaagccgctggtcagatttataaatacaaataaggagacactatgaataaagtttcatttctatttgctggtcaaggtgctcaaaagttaggaatggctagagatttatatgaaactttcccgattgttaaagaaacttttgataaggcaagtcatgttttaggatatgatttgagagaattgattgataaagacttagacaaattaaatcagacgaaatatacgcaaccagctattctaacgacttcgactgctatttatcgtttaattcttaaagaaattgaacttagaccagatatggttgcaggactttctttgggagaatacagtgctttagttgcttcaggtgctataagatttgaagatgctgtagtacttgttgctagacgaggccaactaatggaagcagcagcacctgctggtagtggcaaaatggtagcagttttaaatgctgatcgtcaaataattgaagatgcttgtaagaaggcttctcagtttggtattgttagtcctgcaaattataatactccaaagcaaattgttatagggggagagtcaatcgctgtaaatgcagctgtagaagaattaaaacaacaaggagtaaaacgtttaattcctctgaatgtttcaggtccttttcacactgctttattgaaacctgcaagtcagaaattgagcgatgttttagataaagttcatttttcagtttctgaaatccctgtaattggaaatacagaggcgcagataatgaaaaaagacgatatcaaatctttattggcacgccaagttatggaacctgtacgctttgatgagtctattgaaaccatgaaaaaaatgggaatgacacaggttgttgaaattggtccagggaaggtactctcaggtttcttgaaaaaaatagatagctcattatcagtacattctgttgaagataaaattggatttaataatcttaaggaattaaactaggggaaaatatgcaattaaaagataagaacatttttattacgggttcaagtagaggaatcggccttgcaattgcccatcaatttgcacaattaggtgctaatattgttttaaatggacgttctgaaatatcagaagacttaatagctgaatttgctgattatggtgtaaaagttattgctatttcaggagatgtttcttcttttgaagatgctaatcgcatgattaaagaagctattgcaagtctaggtagcgtggatgtgctcgttaacaacgctggtattactaatgataaattgatgcttaaaatgactgttgaagattttgagagcgttcttaaaattaatttaacaggtgcatttaatatgacacaatcagtcttgaaaccgatgacaaaagcgcgtcaaggtgctattattaatatctctagcgtcgttggattaactggaaatgtagggcaagctaattacgcagcctctaaagcaggtttaattggctttacaaaatcagttgccagagaagtagcagcacgaggcattcgtgtcaatgccattgctccaggctttatcgaatctgatatgacagatgttatcccagaaaaaatgcaagaagctattttagctcaaattccaatgaaacgtattggaaaaggtaaagaagtagcgcaggtagcgtctttcttagcagaacaagaataccttacaggacaagttattgccattgatggcggtatgacgatgcaatgataaagaggaaataatatgacattacagcgagtagtagtaacaggttacggtgtaacctcacctattggaaacacaccagaagaattttggaatagtcttaaagaaggaaatgttggtattggacctatcactaaatttgattcaagtgatttcatggtcaaaaatgctgctgaaattcatgattttccatttgataaatattttgtcaaaaaagatctgaacagatttgatatgtattccctttatgccttatatgcttcaagtgaagctattcaacatgctaatttaaatttagatgaaattgatgcagatcgatttggtgtcatcgttgcatcaggtattggagggattcaagagattgaagaacaagtgattcgtcttcatgaaaaagggccaaaacgcgtaaaaccaatgacgcttccaaaagctctaccaaatatggcagctggaaatgttgcgatgaggttaggcgctcatggtgtatgtaaatcaattaatacagcttgtgcttcttctaatgatgctattggagatgctttccgtaatataaaatttggtattcaagatattatggtagtcggtggtgcagaagctgctattacaaaatttgccattgctggattccaaagtcttacagcattatcaacaactgaagatccatcaagagcatctattccatttgataaagatcgcaatggatttatcatgggagaaggttctggaatgttggtcttagaaagtttagaacacgctgaaaaacgaggagctactattcttgcagaagttgttggttatggtaacacttgtgacgcatatcatatgacttcaccacatccagaaggtttaggagccactaaagctattcaacttgcactggttgaagctaatattaaacctgaagaagttaactatgtaaatgctcatggaacttcaacacctgctaacgaaaaaggagagagtcaagctattgttgctgcacttgggacagacgttccagtttcttcgactaaatcttttactggtcatcttttgggtgccgcgggagctgttgaggcaattgcaactattgaagcgatacgtcatagttatgttccaatgactgctggaacgacagaattatcagaagatattacagcgaatgttatttttggtcaagggcaagacgctgatattcgttatgccatttcaaatacatttggttttggaggacacaatgcagttctggccttcaaacgctgggaggattaaattggatattcaagagattaaggatttaatgactcaatttgatgagtcaagtctgagagaattttcattcaaaacaagtgacggtgagctgtcttttagtaaaaatgagggaaaagctccacttgtcccaactatgtctcctatgagtcatcaacctgaagcgactccaactatagcaactcctgtctctaatgaagcaggtgagcaaacgaaacaagctactgaagtagtttcagaaatcccagagtcgactgtgactgttgcagaaggtgacgttgtcgaaagtcctttagttggggttgcttatttagcttctggaccagataaacctaactttgtttcagtaggtgatagcgtgaagaagggacaaactttgatgattattgaggcaatgaaggtgatgaatgaagtgcctgccccccatgatggtgtagttactgaaattcttgtagccaatgaagaagttattgaatttggtaaaggattggtacgaatcaaatgattgatataaaagaaattcgtgaggctttacctcaccgctatccaatgttattagtggatcgtgttttagaggtatcagaagatgagatagtcgctatcaaaaatgttagtatcaatgagccttttttcaatggtcattttccagaatatcctgtaatgccaggcgttttaattatggaagctttggctcaaactgcaggtgttttagaattatctaaagaagaaaacaaaggaaagcttgttttttatgcaggtatggataaagtgaaatttaaaaagcaagttgttccaggagatcaattagttatgactgctaagtttgtcaaacgtagaggaactatagccgttgttgaagcaatagcagaagttgatgggaaattagctgccagtggaacgttaacatttgcaataggcaattgaagatagtattgaatttagagggagagaagcatcaaaaatgtttaagaaaatattgattgctaatcgcggagaaattgcagtacgtatcattcgtgcagcccgtgaaatgggaatttcgacagttgctatctattcggaggctgacaaggaatcattgcacacaattttagcagatgaagctatttgtgttggaccagccaaatcagcagaatcttatttaaacgttaatgctatattatctgctgctattgtgactggagcggaagctgttcatccaggttttgggtttttgagtgaaaattctaaatttgctactatgtgtgaagagatgaacttaaaattcattggtccatctggagaagttatggataaaatgggtgataaaatcaatgctcgtacagagatgataaaagctgatgttccggttatcccaggatcagatggtcaagttacaagtgtagaagaagctgtatcaattgctgaggaaatcggctatccattgatgttaaaagcctcagccggtggcggtggaaaaggaattaggaaggtcaaatcagcagatgaattgaagcctgcttttgagtctgcttcacaggaggctttggctgcgttcggtaatggtgctatgtatattgaaaaagttatatacccagctagacatattgaagtacaaatacttggagatagctttggtaagatagttcacctaggagaacgtgattgttctctgcagcgtaacaatcagaaggtattggaagaaagtccgtctgtggcaataggtaacactctgcgtcaacaaattggtgaagcagctgttcgtgcagctgaggctgtatcttatgaaaatgcaggaacaattgagtttttgttagatgagaatagcggacagttctatttcatggaaatgaatactcgtgttcaagtagaacaccctgttacagaatttgtaacgggtgttgacatcgttaaagagcagattcgtatcgctgctggaattcctttatcagtttctcaaaatgatattaagttaactggtcatgcgattgaatgtcgtattaacgcagagaatccacaatttaattttgcgccatgtccaggtaccattaatgggttacatctacctgctggcggtatgggcttacgtgtcgattcagcggtttacacaggctacactattcctccttattacgatagtatgattgcgaaagtaattgttcacggagaaaatcgttttgatgcacttatgaaaatgcaacgtgccttatatgagcttgaaattgatggtattgtaacaaatacagaatttcaaatggatctcatttctgataaaaaagtcttggctggggattatgatacttcattcctgatggaagactttttaccaaggtattatggtaacaatcaataggagggaagatggctttatttagtaaaaaggataaatatatccgtattagtccaaacaaagcattagggtcttctgataaacgtagtcttcctgaggttcctgatgaactctttgctaagtgtccttcttgtaaacatatgatttatcagaaagatttaggattagcaaagatttgtccagcttgttcttacaactttagaatttcagcgcaagaacgtctgttgctaacagttgacgaagatagttttgaggaattatttacaggaattgaaactaaggatcctttgaattttccaaactaccgtgaaaaactggctgctacacgtcaaaagactaacttagatgaagcggtggtgacaggtttagctaaaataaaaggacaaactacggccttagctattatggattctcattttataatggcgtctatgggaacggtcgtaggcgaaaagttgacaagattatttgagctagcaactgaaaagaaattacctattgttatttttacagcgtcagggggcgccagaatgcaagaaggtattatgagtttgatgcaaatggcaaaagtatcggcagcagttaaacgccattctaaccagggattgttttatttaacaattttaacagacccaacaaccggcggcgttactgcgagttttgctatggaaggtgatattattctggctgagccacaagcgttggttggttttgctggtcgtcgtgttatcgaaacaacagtgagagaagatttacctgaaggctttcaaaaggcagagtttttgttagaacatggttttgtcgatgctattataaatcgaacagaattacgcgactgcattgctcaactaattgctttccatggaaatgaggttggtcatgaataatgatgtgacaagaattttaaaagatgcgcgtgatcaagggaggctaactgctcttgactacgctgaattgatttttgataattttatggaacttcatggtgatcgccagttcgcagatgacaaatcaattataggaggtttggggtacttggcagggcgtcctgtgacgattgtcggtattcaaaaaggtaagaaccttcaagataatttagaccgtcattttggtcaaccacatcctgaaggttatcgtaaggctttacgtttaatgaaacaagctgagaagtttggaagacctgttataaccttcatcaatactgctggagcatatcctggggtaggtgctgaggagcgaggtcagggtgaagcaattgctagaaacctcttagaaatgagtgatttaaaagtccctattatagctattattattggtgaagggggttctggaggagcattagctttagctgttgccgataaggtttggatgttggaacatactgtttattctattttaagtcctgagggctttgcctctattttatggaaagatggtacaagaacaacagaagcagcacaattaatgaagatgactgctggagaactttaccatatggaagttgtagacaaagtaatccctgaacatggttatttttcaagtgagattgtcgatatgattaagacaagtttaatttcagagttagaagtgctctcacaattatctcttgaggatttattggaacaacgttaccaacgttttagaaaatattaatagaaaaaggctgagttatttactcagcctatatttagtttttcaaggtattatcatagttatagtttcatattttgttataattgataaaaaggagatatatcaatgacactagcattagccaatttttagattgtagtctaatccaaaattttcagaaagagtcatttcgaacactttattctaagtaccattatttaggctctccttaacttgagactctatctgttattgaagagaaattttctagaaaaaatagctattattagattttagaaggctatgaaaagattggtttttaaagagttccattaagtgatgaagaaagtaaagcttggttagttataattgcgattagaccttgtttctagcaacgaggcttcgctagaaatactttaaaagaacttgaaagtatgtatagatatatataatcgtgaaaacttaactattgtttacatggagaaaaagaatgtatcaagaattaaatgattatttagaattccaatcaatgaagtatattatgcctgagaaggcaggcgctttaaaggacgatatgcaaacttttaaggcaaagggccaacttgctaggaatagctttacagagttatcaagagccttagaacaacgtatggatggctttaaaatgcaaagagtgagtaattgggctaatcaagctcaagtagggcgtccacatttttgggtttattatcgaaaggatacagaccaattagatgatgtggctgttgcgctaagggtttatggtgtaaaagatagttttggggttagccttgaggtaagctttgtagagaggcaaaaatctgataagacactcgagaagcaggctagagtgttatcgattccgattgcctctccattgtattttatggtccaaaggcaaggtgaaactcatcgagaagaaggcaatgaggaaaatcgtcaacgtttaatgcaagaaattaagtcagggaaggtaaggaaagtattggtaaaatatgacgttcttttgactgaaaaccagagcttagaaaatattctgcaacgattgttagaaggctttgagaaagtgttaccttactatcaagtttgtcaaactattagctaagttcatagaaaaaatgagttggtataccaactcattttagagtgcctaatttggtttaataatatcgatattacccatatatggacgaagaacttctgggatagtcacagaaccatcttcattttgataattttcgaggattgctgctacagtacgtccaactgcaagtcctgaaccatttaaagtatgaagcaacctaactttgccatcaacttcgtcacggtaacgaatttgagcacgacgtgcttggaaatcttcagtattagaacatgaagaaatttctcgataagtattttgagcgggaatccatacctctaagtcatacgttttagctgctgagaatcccatatctcctgtacacaaggtaatgacacggtatgggagattaagtttttgaagaatattttcagcatttgctgtcattttttctaattcttggtatgattcctcaggcttggcaaatttcaccatttctactttatggaattgatgaaggcgaattaatccacgtgtgtcacgtcctgcagagcctgcttctgaacggaatgatggactcatggcagtaaagtatataggtaattctttcccatcgataatttcatcacgataatagtttgttaaaggaacttcagctgttgggataagtacgaatgggctatctgctaattcgaaagtatcttccttgaactttggatattgtcccgtaccgaacattgaatcgtggttaaccatataaggagggatcacttcagtgtacccctccttagcgtgttcatccagcatgaagctgtagatagcacgctctaaacgagcacctagacctttgtagaagaggaagcgagagccagtaacttttgcaccacgttcccaatcgagaattccaaggctttcacctaaatcccagtgagctttggtctcaaaatcaaattcacgaggagttccccagcgacgaacttcaacattttcatcctcgtctgctccaagcggcacatcatcagctggtgtattaggaagtacggtcaccattgattgtaaattagcatccacatctgccaattccgcatcaattgctttgatatcagcggaaagtgtttgcatagctgcgatttgctcgtctgcattctctttatttcgttttgcttgagcaatggcagcagaagcaacattacgttgcgctttcgcctcttcagctttgataagtagttcacggcgttttatatcaagttctttaagggttgttaatgtttcttggtcaacaccacgcgtggccaattttttagcgacaacatcaaaatctgtacgaatacgttttaagtctaacatataggaatctcctttatactaaaaaacaccctgtcatgctggagcgcaaaggcgcggttccatccagcttcacagaagtgcacttgattgattgattaaattatttcccataaatggaacacggtagaatttcataaaacaatcttatctgctcgcaacgaccgcagactctctgaaaagaactattatactacttatccgttaaggttattatatccaaaaataagtaaaatgtaaaccttaactttataagcctgctctttgttttagtgaaatagctatgctaaaatatgattatggaaaagtatacaagtattaaacaatcaggtcgtcattacggcttagaccttttaaggattatttccatgttcatgattgttattacgcatgttcttggaaaaggtggtctgagatcttcggttgagggacacgcagactcctattttatagtaacgtggattatccaagtcttagtttatggggccgttaactgttacgcactaataagtggttatgtgggaattaattcgcgttatcgttactcaaaattactgtctatctgggcacaggtttttttctacacctttacaataacagcactttttgcaatcacaggtcatgaagtgaccttgcttaattggagagatgcttttttccctattgtcagtgggcagtattggtacattactgcttactttggtctattggtttttatgcctgttattaataatggattaaatgccttgactgataaacaattaaaacaattggttttgttaatgtttattattttttcaattttaccagctgttttaaataatcgtgttccagaattttcattgagcaagggttttgaaatgacttggctactgattttatatattattggtgcctatttgaaacgtattgatttaaatatatttaaaacgtcatatttacttataatttatctattatcattggttgctacttatgccatgaagtttagcgttggtgatatttggtattggtatgtttcgcctactttaactttaggggcggtaagtttgtttatattatttgctagagcaagcattaagccctcgggattcttaaagaaaataattgttgtattagccccttcaaccttgggagtttatctctgtcatctccacccactaatagtaaaatattttgtaagagattttgcagagacgtttgtttatgagtccatttatctttacccatttttaattttaggagcagggattttaatttatttgttggcttttattgtagaacgtattagattacgaatatttaaagcaatccatttttctaactttttgagatggtttgatgacaagttcccatattaatattagagttaaaaaataagatagactatagtctatcttattttttaaacttgaatatttttaaaatggtctggatgagggtaggaagcttaacaactttatcgtctccaatatgtcgtctcgcatgctttaatatcgttccagagtctttagaggcgaataaaaattttccttggtctgtaaagacctcaaagtgacgactaattttttttcgactaacattagctccaatttgattgattgatgtccatggaatttgaatatagtcgttgacatttttatcgttatagaattctaatgcctggtcaccaactaaaaattttccaactttattccccatacctaaatacgaaactcctgttgtttgaaattcaacagttttgtttaatgattgtgccatgactaatccctttttaatttatagtagtttgattatatcataatagtgggactctaagtggattttatgtaataaaatataagagatggaatactattgtaaccatctcttagttttattacatcacacctgcaaggcgagctagaataccaacgataaacaaaccgatgataattgtaattggtgatactttcttcttaagtaaccacatacagaagaatgtaagaagtaatccagctaaaccaggaataagtgagtcaagttgtccttgaagtgtttgtggttgcattttatcaaggcttaagccactctgaacttgtcctaggatatcatgcaattgttgtccactaacatggtctttagggaaattgatgtatgccccttctgacaatgtctttttaggaaggtctacagtaaagttaattgctacccaacgcttaacaaggacagcaaggatgaacataccaaggattgaagcacctttagtaatatcttggaggataccaccagacatatctttagtaatttctttacctgatttgtaacctaactcttgtgtgtaccataagaatgacatacgaatgaggttccaaccaacaaagaagatgattggtccgaggatattaccagcagaggcaagtgaagcaccaagagcacctaagataggacgtacagtaaaccagaatactggatcaccaataccagcaagaggtcccatcataccgattttaaccccttgaattgctttgtcttcgacaggtgtaccgcttgctttttcttcctcaagagcaagggttacaccgataattggagcagcaacgtatggatgtgtgttaaagaattccatatggcgctcaagcgcagcagcacgatcttctttagtagtgtaaagttttttcaatgctgggataagagcataggcccaccccatattttgcatacgctcatagttccaagaaccttgaaggaattgtgaacgccaccaaactttttgacgatctgattttgataatttaatttgttcagtcattgtttagctcctttctagtagtcctctaagatatcgccgataggatcgttagaacctgcgttagaagtacctttgcttccacccatttttgataaactgatgtagatgagggcgatagcaacaccaatagtacccattgcaataagagttaactggttcaaagctgctagagcaaatccaagagcaaagaaaggccaaacttcgcgagtagccatcatattgataaccatagcgtaaccaacggcaacaaccatggcaccaccaacttgcataccaccatttaaccaatcaggcattgcttcaagaatactttgtactgaagaagatggaatagctaaaagaagcgcagctgggaatgcaatacgtaatccttggagaaggagggcgataaagtgaaaacgttcaattgctgcgaagtttccttcagaagcagctttgtcaccagcgtgaacaagtgcagttgagattgtacgaacaatcattgtaaggaaaagtccagcaatagctagaggtacagcagtagagaaggcaaagttgatacctttttgagtgaagtcaccacttttaaccaaaataatagcagcagcaacagaggcaagtgcagcgtctggtgctacggcagctccgatatttgcccaagcaagagcaatcatttggagactaccaccaagaataatacccgcttcgaggtgaccagttacaagaccgattaaagtacaagcaacaagaggttgatggatttggaattggtcgaggataccttcaagaccagcaaagaaggcaacgataacgaccaaaatcattgagataattgaaatatccgccattttgatatcctttcgttttcagagataataagttattttacgtttgctttgttgattaaatcaaacaaattctttttagcgtcatttggtactttacgtacatcaaatgatacacctaagtcacgtaatttttcaaaggcagcaacatcgtctttatccattgaaagaacgttgtttaccattgttttaccagttgagtgagccattgaaccaacgttcaattcagggatttccacaccaccttcaattgcacggagtgcatcttgtacagtttcaaataagatcaaggcacgtgtgtttccgaaacgtgggtctttagctacttcaattaatttactaattgggacaacgtttgctttgactcctccaggagcagcttgcttaatcaattgtttacgaagttcatctttagaaacttcatcagaagcaacgataatacggtttgcttttgatgctggagtccatgcagttgcaacttgaccatgtaaaagacgtgtgtcaatacgagcaagattaattttaagcttgccatctccaataacagttccttcagggatagatccactttgtttaacttccgcaggaacatctgcaggaacacctgctacaggagtagcttctacaacaggattaagttcttctggaagggctttgataccttccttagactctttaataatatttgcggcaacttgttcaacacctgcattagcgtccatcatacgctcagtataggcttggataagcattggcaaattgagaccagtgatgatagccattttacgttcaggattttctcccataacacggcttgcttggttaaatggtgacccactccaaaggtcagctaacacaagcacctcatcatcagcatcaaattgtgcgatagcattgttgaagtgtccatacaaatcatctggtccttcatttggcatgaaagttacaacttgaactttttcttgttcaccaaagatcattgaacctgattgatgaataccttcagcaaatttaccatggctggcaataataataccgatacccattcttgttcttcctccttaaaaaattttttcgttgacataaagaagaataatctccttccaatcgtaaaattggccattctttttcatttcaacgaaattatagaacagatatattttaaaacgttttcagaaaaaaatcaatactatttctaataaaaattaaaaaaaaagatatttttttcacaaataccttttataataggggaagagagtggtaactttttttgttaataatatagtagaaaacctaaaaaacgatttctattagaattctgtttcaatagagatcatttttgaaaatactacaataataatttttctagagttttagcaacaccatcttcttcgtttgtccattggatttgttggtcggcatatggaagtagagttggattagcatttttcatagcatatcctgtatgtgcaaaggccagcatctcggtgtcattgtgttcatctccaaaggcaatcaaattttcttgtgaaagattgagtgattttaataaatgtttgagagcataagctttgttaacacctttaggtgaaaattcgagtatattcaatggaccaccccaagaatctacttctagttcgtgattaaaatgttgtcgtaactctttagctaactcatacttatctttatgacgtgtttgcatcaatagagcatttggattgcgtgtgattttagtaacatctaatgccattttatcagtaatttcattgacaccgaataattgtgggttaattttatcacgattatccatagtaatgtaaaaatttttacggtattcgctagcaataaaatcggcttggatagcatctgataaatttaaggtttcaaggagtaattttttatcaatcgttgcactacgctcaaacgcccactttttttcggggatatgagttaaagcaccattaaaatttatcattggtgtttttaaatctaggcgtaaataatgagcgagtgccatacggtatgggcgtccggttgtaataattactttgtgtccttgagcttgaacttttcgaagtgtatcagcggtgtagtcagaaatagtgttattattatgtaatagagtaccgtctaaatctacggcgataattttctttgtcatgctgacattatatcaaaaatagatttcaataaaaagagacagtagaaatatgatataataactgtggaaatatggaagttggtggattatgaaaaagttaatttggagtcatctttttgccatagtcagtattttagggatatggtattatcatgtaaaaattgatcatttgatggtaattctattggcatcagtcttgtcgttagagatgggattcattgcttattatagtcgtaatatttttattcgtcttttagcaagtttaggtcttttatttttttacccacagagtttagggatttttcttagtttggtgagcttagagtggtcaacaaaagacatttggcagtctaatcactttatgcaatatatggcataccttcttgcaattctttttattatctcttcagctttactaagcttgaagctattggtaaatgcatatgatattagtaaaaggtatcaattagcaactgttatacctgtaatgctttttagtagttttgccttttgcttagaaaaatcaggatcattaggtttagaaggaatcattttaaatccgtcagcattttttaatggaatacagactaatatggctaaccttgattttaaagccttgtcttgcctttttttagtacaattattactttggggaatattaatggaagactaaccacaacagggttagtcttttaggtttgaagtttatttaaccttaatttaataatatgttgtataatgagatattaattggaggttagaatgaaagtaaaactatttgcgatacatctattttttattgttatttcttttgggattaaatattatcatttgcagggaccaaatttgatttggaatatgactctagccctaatagcgttagattttgcataccttactagtttatttaagaaaaaaattcttatcggtctttttgcacttgcttggttttttttctatcctaataccttttatatgttgacggatatcattcatatgcattttgtcggagacgttctttataataagacaaatttaatactttatatcttgtatgtatctagtatcttgtttggttttttatcaggtatcgaaagtttttctgtgattatgcgtaaatttagaattagcaatatatttttaagatggggaattattggaattgtatcattagtttcaagttttggtattcatattggtcgttatgcccgtctaaattcatgggatatcttaacgaagccacaagtggtaattaacgaacttttagcggttccgagtagggattcattccactttattttaggatttacatttttacaggtattgtgtcttatttttatggattattctgcagggaaaaagcttgaaaagtgaattattttttgttaatatatattagtcgttcgtaaatataagaacgattattttttttaaaagtgtaaaatagcaaaaaataaaggagaatccgattttaaaatggaaaagttttttaagctaaaggaacacgggacgacaattcggactgaaatcactgctggtctaacgactttctttgcaatgtcgtacattttgtttgtaaatccagctattttatctcagactgggatgccagcacaaggagttttcttagcgacgattattggtgccgttgtagctacatctgttatggctttctatgctaaccttccctatgcacaagctcctgggatgggattaaatgctttctttacatatacagttgtctttgcattgggatatacatggcaagaagccttagctatggtatttatttgtggtttgatttctctgattattactttaacgaaagttagaaagatgattattgagtctatcccaacaactttaaaatcagccattacagcaggaatcggaacttttttagcatacgttgggattaaaaatgctggttttttgaaattttcaattgatcctgggacgtatgatgttgttggaaagggtgctgcgaaaggattggctactattacagcaaattcttcagcaacgccagggctagtgtcgtttgataatccagccattttattatctttgattggtttaagcattaccatcttctttattgtaaagggtatccgtggagggattattctatcgatattaacaacgaccctcttaggtattttaatgggagtggttaagttagatgctattaattgggaagcaactaacctctcggcctcttttagagatttgaagcaagtatttggagttgcattaggagagaaaggattaatttctttattttctaatccttcacgtctaccaagtgtattaatggccattcttgctttttcactgactgatatttttgataccattggaacgctcattggtaccggagaaaaagttggtatcttagcaacgactggtgataatcatgaatctaagagtttagacaaagcactctattcagacttaattgggacaacttttggtgctatttgtggaacatctaacgttacaacctatgttgagtcagcagcaggaatcggagctggtggtcgtacaggattgacagccttagtagttgctggtttgtttgctatatctagtttttttagtccactagtatctatcgttccgagtcaagctactgcaccaatattggttattgttggtattatgatgctttcaaatttaaaagatatcaaatgggatgatatgtcagaagctatcccagctttctttacttctctttttatggggtttacttatagcattacttatggtattgcagctggtttcttgacctatacactagctaaagtcatcaaaggacaagcaaaagatattcatgtggtactgtggattttagatatattatttattctaaactttatcagcttggctattttgtaatattatagtttgataaataagataaaaggaaatcagatttgtagcctggtttccttttttcttaagaaaagtgaagaaatatatgctatggggctgtcagaatcagcaaactgttggaagacagagatatttctggtataatatctctatgttttatactcaaaatgaagaagagcttattgccctagggcaaaaactgggtactgttttaaagtcaggagatatcgtattattgactggtaatttaggtgcaggcaaaacaactcttacaaaaggtattgcaaagggattagacataaaacaaatgattaagagcccaacttacactattgttagagaatatgaagggcgtgtaccactttaccatttggatgtttatcgtattggagatgatcctgattctattgacttagatgacttcttgtttggtcaaggagtaacagttattgaatggggagagttgcttagtgataaccttatcaataactacttagaaattgttattacgaggagcaatcaaggacgtcaggttcagttagaagcttatgggcatcgcgcaagagaaattattgaggcgattcaagatgtctaaacaatttgctgttgattttatagaagcttcgagagaggaagcatctgcgatccttgaatttttaaatactgttactgaggaaacagattttattttgcatacggtgagcaatcaactatctttgtcagaaatggaaacgtttattgaaaataccttaatgacgaaaaattgcatttgtttgattgctaaattaaaaaataaagtgatcggcttgataacaatcattagtcagtctgatattgaaattgaacacgttggggatctttttattgccgttcagaaggattattggggatatggtattggtcatattctcatggaagaagcaatagaatgggcgtcagataacgatattacacgccgcttagaactatcagtccaaggacgtaatgaacgtgctattcacctctaccaaaaattcggttttgaaatagatgggcttcaaacaagaggtattaaaagagaaaatggagaatttctagacatttacagaatgagtaagttgatagattaggaatatacatgaaaatttggaaaaaaataaccttaatgttttctgcaattattttaacaacagtaattgcattgggagtctatgttgcctcagcttataatttttcgactaatgaattgtctaagacttttaaagattttaagctagctaaatcaaaaagtcatgctattgaagaaacaaagccgttttcaatactattaatgggggtggacacaggttcagagcatcgaaaatctaagtggtcaggaaatagcgattctatgatcttagtcactataaatcctaaaactaataaaacaacgatgacaagcttagaacgtgacgtattgattaaattgagtggtcccaaaaataatggacagactggagtagaagcaaagctaaatgcagcctatgcttctggtggtgcggaaatggcattgatgactgttcaagacttattagatattaatgttgattactttatgcaaattaatatgcaaggattagttgatttagtcaatgctgttggtggtataacagtaactaataaatttgactttccaatatcaattgctgccaatgaaccagagtacaaggctgttgttgaaccagggacacataaaataaatggagaacaagcacttgtttattctcgtatgcgctatgatgatccagagggagattatgggcgtcaaaaaagacaacgtgaagtaattcaaaaagtccttaaaaaaatattggcgttaaatagtattagttcatacaaaaaaattctttccgcagtaagtaataacatgcaaactaatattgagatatcatcaaaaacgattcctaatttgttagcttataaagattcattggaacatattaaatcttatcagttgaagggtgaagacgctactttatcagatggtggctcttatcaaattttaactaagaaacatctacttgcagttcaaaatagaattaagaaagaactggataaaaagcgtagtaaaactctgaagacaagcgcgattctatatgaagattactatggtactactgctagtaatgattcttctacttattcatcaacacaagagaataattataatacaacaccttattcagaagcaccaccaagttacagtggtaatactacttatagttctgagactaatcaaacaactcatcaaaattactataatagtagcactcctgctagtaactatagcagtaacactaacacaggtcaggctgattcaagtggaagtgtcaataatcataacggggctgcaacgcctaatccaaacacaggaacgcaaccagtaccaggtcaaactaatccataaaatataaaaaagagcattatttgctctttttatatttagagtagatatttttataccgtcggcttattcgtctttctcttgatatttagccatgcgttgattaatttcttctaaacgaggttgaatatctttattaaacacttggaatttatgattgagttcttgagaaattaatctgattttttctttttcctgactaataatagcaagatcatttttgatacgttctaattttaatttagctgaatctgtctcattttttgtattttgataggaatccttgatagtttttctatttttgtaaagttcaagcgctcctaaactaactaaacctagtgcaattaaacgacctattttcataattgaatctcttttctaatttctttggctaattttgcaagtgcctcaaagtcgggttcatgagtagtgtagtgaattttgataccgtctgattcatcaaagcggggaacaaggtggacgtgtgcatgaaaaacagtttgtccagcaatttcctcattgttgttaataatattcattcctttggcttttgtagcagcttggacagcacgcgccactttaggcaagcgttcaaaggttatctgtgcagttttttcatccatctctaacacatttcgaacatgttttttaggaataagaagggtgtgcccggtcgtagtttgtgtaatgtcgagaaaagctaatacttcatcatcttcataaacttttgatgaagggatttctccactgatgattttacaaaaaatacaattatccataactaattcctttcatgttgaaaaatttattgggtagctattaaggaatggtaaatttttatcgtttgataggtcataagtcgtacagggaaatgaaagtagcccgtattgattgtgatatctatatttaccatcatacttatcttagcatgacctaaagggtattgcaatttttaatgatgtttattattgagtaagtacatttctagaattttggaagtatctaaaataaatttaaatataatgattgacatttttatctaattaaatgtataataaataatataaataaaataaaaatgataattgagatttatcatagaaggaaaactattttgaaattaaataaaataatattatctactgcagctcttactgctctctttttaggatataatagcgttactgcggatacatataataactatcagccacatagatcaaataatatggatttaactgaggaatataactataataaccagatagaacttcaggagcgtataaaaaaactaaatataccttttaaagaaaaacttgccttacttagaaaggttaaatcaagacaagattcttatgtattagacacattaagaaaagaagttgaaaataaaaacagtgagtattcagaactagagcaagaatatcaaagaatttcagctcttattgatgctaagtttccgcaagggaaatctagtttagcagaaaaattacataaagaactaatttgggacttggatggtgttaaatatgatgagggtatttctaagagaactgctctaaaaaaattagaaggtaaaatcaacgaatatactaaaaaatacagttatttattctgataattgagtttgatagttttatagcctaatattctgattactttgcatttattatattgatactaaaaagacacctttttgaggtgtctttttttgtccgatgagtgatggaggtgctttttgtaaacataatgggagcatggggtagcttggcatttcattagatgtaaaagcggacaaaataggtttaaagttattttcaaaactataagggaattctaaagtacaattatccataagaatagaccttccctttcttattttgttataatagttaataaagtatatcaaagatagagagaatgacaatgttaaaaattgaaaatgttacaggggggtatgttaatatcccagttttaaaaaatatttcttttgaagtaaatgatggagagttagttggattaattgggcttaatggtgcaggaaaatcaaccactattaacgagattattggtattttgagaccctatcaaggagatattacaattgatggtattagtcttgaagccgaccaagaactttatagaaagaaaataggctttattcctgagacaccaagtctctatgaggagctaactctcagggaacatttagaaacggtagctatggcgtatgatattgccaccgatgaagttatggcacgtgcgcaaaaactattagagatgtttcgtctaacagataaattagactggtttccaatgcatttttcaaagggaatgaaacaaaaggttatgattatttgtgcttttgttgtatctccaagtttatttattgttgatgaaccatttttaggtttggatccactagctatttcagatttgattaatcttctagcagaagaaaaagctaaagggaaatctattttgatgtcaacacacgtattagattctgccgaaaaaatgtgtgatcgttttgttattttacataaaggagaaatacgggcagttggaaccctagaggaattacgggctatttttggagacagtaatgctaatttaaatgacatctacatagctctgacaaaagaggtgtgatatgaaaaagttatttaataaacgtcgaagtctctttttaactcaaaatagtaaatatttgagatacgtctttaacgatcattttgtattagtattaatgtttttgtcaggttttttgttatatcagtatagccagttactaaaagactttccaaaaacacattggccaattatcgtgattgtgtcaatcattatcttaatgttactagcgatggggggaatagccagctatttagaaccggctgataaacaatttttacttataaaagaagaagcaataaaggaaattataaattctgctaaaaaacggacttatatcttttggttggttattcaaaccttatttttagtattaatatcaccaattttgataaagttaggcttgtcagtttttatgattacattgttaatttttggtctaggaataatcaaatggttggtaataacttacaaggtaaaggtcttttataacaatcaaaatttgaactgggatgcagctataaatcatgagcaggaaagaaaacagagtatattaaaatttttctctttgtttacaaatgttaaaggaatttcgacaagtgtaaaacgtcgttcatttttagatggtattttaaaacttatttctaaaacgccatcgcgtttatggactaacttatttgtgagggcatttctaagaagctcagattatcttggtttaacaataaggttggtaactttaaatatcttatcagtcatctttgttaacgaaacctacctcgcccttgctctggcatttgtatttaactacttattattgttccaactattagctttaggtcaccattttgattatcaatacatgaatcagctctatccagttagattaaatgctaaagcaagtcagctaaaaggttttctcagagtattatcatatgctgtgacagtaattgatagcatacttataagagaattgaaacctgttatattattgatagttttgatgttaattgtgacggaatattacatcccttacaaaataaagaagatgattgactaaagcctataaaacaagtaaaataagaggaaacgactaaatgaaaaggagggactgctggtgacaatatcaaatcaagaattgacgcttactcccttaagaggaaaaagtggcaaagcctatattggtacttatccaaatggtgaacgtgtctttgtcaaatataatacgacacctattttgccagccttagctaaggaacagattgcgccacaactactgtgggcacgccgtacaagtaatggcgatatgatgagtgctcaagaatggttagatggtcgaacattgactaaagaagatatgggtagtaaacagattattcatattttattgcgcctgcacaagtctcgtcccttagtaaatcagctgttacaattagggtataaaattgaaaacccttatgatttgttgatggattgggaaaaacaaactcctattcaaatccgggaaaacacttatttgcaatctattgtgactgagttaaagcgtagtttacctgagtttcgaacagaggttgcaacaatcgttcacggagatatcaaacatagcaactgggttattacaacaagtggtttaatttatttggttgattgggattctgttcgtttaacagatcgcatgtatgacgttgcatatattttaagtcattatattccacaaaaacactggaaagattggctgtcttactacggttataaagataatgagaaagtctggagcaaaattatctggtatgggcaattttcatatttatcacagataatcaaatgttttgataaacgagatatggagcatgtcaatcaagaaatttatgaattacgaaagtttagagagttaattaaaaagcataatgcgagttagaaaacgtaagggtgcagaggaacacttagaaaataatcctcactatgttatttcaaatccagaagaagccaaagggcgttggcatgagatttttggaaataataaccccattcacatagaagttggttccggaaaaggggcttttatcactggtatggcagagcaaaatccagatatcaattatattggaattgatattcaattgtcagtgctttcctatgctttggataaagttctagatagcggtgctaagaatatcaaattactattagttgatggttctagtctatcaaactactttgatactggcgaagttgatttgatgtatcttaactttagtgatccatggcctaagaaaaagcatgagaaacgtcgattgacctataagactttcttggatacctataaagacatacttcctgagcagggggaaattcattttaaaacagataatagaggtttatttgaatatagccttgctagcttttctcaatacggtatgactttaaaacaagtttggttagatttacatgcaagtgattaccagcaaaatatcatgactgagtacgaacgcaaattttcaaataaaggacaggttatctatcgtgtagaagcacgattttagaataagtaaatagtaagtgggtagttatttgctactcctttatggagaggtcgcatagtggctgagtgcgcacgcttggaaagcgtgtagtccctaatgggggctcgggggttcgaatcccctcctctcctttaatcttgttaatgtatcagtgtttattaagtgttcacctttttcactcgtcaaaagtccaagtttcgaaaaatttcttttattttatcatcgtttctctttgagcttgaagtattagcataaagttttctaagctcttacaaagaactgaggacaaaattttaattttttgatataagattagtgtacggtgatgctaatttaaagtaaatgattgcaataatcgtattttgtgctataatagtattaaataatacagaaaggggcggagttttacttcgcctcttatgtgtgtgattcatagaatttatagtcattataagttctaaagcaagttagaaagaagaggtagctgttatcgcaaatcaaactattgttgatattgttactcaagtcgtaactcctgctattcaagcaccgtttgaattagtagatgtagaatacgaaaaaatgggtggcgactatgtgctcagtattttaattgataaacccggaggcattacggttgaagatacagcacaattgacagacgttgtaagtcccttacttgacacaattcaaccagatccatttccagaacagtatatgcttgaagtctcaagtcctgggttggaaagaccacttaaaacagcagaagcattatcaaatgctgttgggtcttatatcaatgtaagtctgtataaatccattgataaagttaaaatatttgaaggtgacttattatcatttgatggtgaaaccttgacaattgattatatggacaaaacacgtcataaaactgtagatattccctatcagacggttgcaaaagcccgtcttgcggttaaactttaagaaaggatgattcttgcgaagcaagaatggacactatgagcaaagaaatgctagaagccttccgtattttggaagaagaaaaacacattaataaagaagatattattgatgcagttactgagtcactaaaatctgcctataagcgtcgttatggtcaatcagaatcatgcgttattgaatttaacgagaagaaagcagactttaccgtctatactgttcgtgaagttgttgatgaagtttttgatagccgtttggaaattagcctaaaagatgcccttgctattagctcagcgtatgaacttggtgataagattcgctttgaggaatctgttacagaatttggacgcgtggcagctcagtcagcaaaacaaactattatggaaaaaatgcgtcgtcaaatgcgtgaagtaaccttcaatgaatacaaacaacacgaaggtgaaattatgactggtactgttgaacgatttgaccaacgttttatttatgtcaatctcggttcacttgaggcgcaattatcgcatcaagatcagattcctggagagagctttaaatctcatgatatgattgatgtttatgtctataaagtggagaataatcctaaaggagtcaacgtttttgttagccgtagtcatccagagtttatcaaacgcattatggagcgagaaattccagaagtatttgatggaactgttgagattatgagcgtctctcgtgaggctggagatcgtactaaagttgctgtacgcagtcataattcaaacgttgatgcgattggaacaattgttggacgcggtggaagtaacattaaaaaagttatcagtaatttccatcctaaacgcgttgatgctaaaacaggattggagatcccggttgaagaaaacattgatgttattcaatgggttgaagatccagcggaattcatttacaatgctattgcaccagccgaagttgatatggtactttttgatgatgaagatacaaaacgtgctactgtagttgttccagatagcaagttatcgctagctattggtcgccgaggacaaaatgtgcgtttagcagctcatttgactggctatcgtattgatattaaatctgcaagtgaatacgaaaaaatggaagcgcaagaacttcaaactgaggaagtagctcaagaatctgaagttatttcagataaggcagaataatataaatgagagaggtgttttatggctaaaacaaaaaaaatacctttaagaaaatcagttgtttctggtgaagtgatcgataagcgagatcttttacgaattgttaaaaataaagaaggacaggtttttatagatcctaccggaaagcaaaatggtcgaggtgcctacataaaattggacaatgatgaagctatcctagcgaaaaagaaacgagtgtttgatcgcagtttttcgatggaagtttctgatgaattctatgatgaactattggcatatgtcgaccataaggtcaaaagaagagagttaggccttgaataattcagaaaaagtattaaatctcattgggttagcacagcgtgcggggcgccttattacaggtgaagaattggttattaaagcaattcaaaatcaacaagtatcgctaatctttctagcaaatgatgctggcccaaatttgacgaaaaaagtaactgataaaagtaattactacaaaacagaagtctccacagtgttttcaacactggaattaagtgatgcgttaggcaaaccaagaaaagtggttgctgtcgcagacgctggattttcaaagaaaatgaggactcttatggcataacagaataggaggacatcaattgtcaaagaaaagattacacgaaatcgctaaggaaattggaaaaacgagtaaggaagtggttgagcaagctcaatcgcttggcttacctgtaaaaagtcatgcttctagcgttgaagaaaatgatgctacacgtattgttgagagttttagctcttctaaaactaaagctccaacaaattctgttcaaactaatcaaggtgtgaaaacagaatctaaaactgttgaaaccaaacaaggcttgtccgatgataaaccttcaactcaacctgtagctaaaccgaaaccacaaagtcgtaactttaaggcggagcgcgaggctcgtgctaaagctgaagcggagaagcgtcaacataatggggatcaccgtaagaataatcgccataatgatacacgctctgacgacagacgccatcaaggtcaaaagcgttcaaatggtaatcgtaatgataaccgacaaggtcagcaaaataaccgtaataaaaatgatgggcgttatgctgatcataaacagaaaccccaaacgcgtcctcagcaacctgcaggcaatcgcattgactttaaagctcgagcagcagctttgaaagctgagcaaaatgctgaatactcacgtcatagtgagcagcgtttccgtgaagagcaagaagccaaacgtcaagcagctaaggagcaagaactagctaaagcagcagcgttaaaagcgcaagaagaagctcaaaaagctaaggaaaaacttgcttctaaacctgttgctaaggtaaaagaaattgtcaataaagtagccgctacgccatcacagacagcagatagtcgtcgtaaaaaacaaactcgttctgataagtctcgtcaattttcaaatgaaaatgaagatggacaaaagcaaacaagaaataagaaaaactggaataatcaaaaccaagtgagaaatcaaagaaatagtaactggaatcataataagaaaaataaaaaaggtaagactaatggagctccaaaaccagtaacagagcgtaaattccatgaattaccaaaagaatttgaatatactgagggcatgaccgttgcggaaattgcaaaacgtattaaacgcgaaccagcggaaattgttaaaaaactctttatgatgggagttatggcaacgcagaatcaatcattagatggagacactattgagctattgatggttgactacgggattgaagcacatgctaaggttgaagttgatgaagctgatattgaacgcttctttgcagatgaggattaccttaatcctgataacttaacggaacgtccgcctgttgttactatcatgggacacgttgatcatggtaaaacaactcttcttgatactctacgtaattcacgtgtcgctactggcgaagctggtggaattactcaacatattggtgcttatcagattgaagaagctggcaagaaaattactttcttggatacaccagggcatgcggcctttacttctatgcgtgcgcgtggtgcatcagtaactgatattactatccttatcgttgccgctgatgatggtgttatgccgcagacagttgaggcaattaatcactctaaagctgcgggtgtcccaattattgttgctatcaacaaaattgataaacctggtgcaaatccagaacgcgttatcagtgaattagctgagcatggtgtcatctctactgcatggggtggtgagtctgaatttgttgaaatttcagctaagtttggtaaaaatattcaagaattacttgagacagttcttttagttgctgaaatggaagaattaaaagcagatgcagatgttcgtgctattggtactgttattgaagcccgtcttgataaaggtaagggagccgttgcaacgcttcttgtccaacaaggtactttaaatgtacaagatccaatcgttgttggtaatacatttggacgtgttcgtgcgatgactaatgatcttgggcgtcgtgtcaaagttgcgggtccatctacaccagtttctattactggtttgaacgaagctccaatggctggtgatcattttgctgtttatgcagatgagaaagctgcgcgtgctgcaggtgaagaacgtgcaaaacgtgctctcttaaaacaacgccaaaacacgcaacgtgttagcctcgagaacttatttgatacccttaaagctggtgaagttaagtcagttaatgttattatcaaagctgatgtgcaaggttctgtagaagcacttgcagcttctctccttaagattgatgttgaaggagtaaaagttaacgttgttcactcagcagttggtgctattaatgagtctgatgtaacacttgctgaagcatcaaatgctgttattataggatttaacgtacgccctactccacaagctcgtcaacaagcagatgctgatgatgtcgaaattcgtcaacatagcattatctataaagttatcgaagaagttgaagaagcgatgaaaggtaaacttgatcctgaataccaagaaaaaatccttggtgaagccattattcgtgagacctttaaagtttcaaaagtgggaactattggtggatttatggttatcaatggtaaagttactcgtgattcaagtgttcgtgttatccgtgatggtgttgtcatttttgatggtaaattagcaagtcttaaacactataaagatgatgttaaagaagtcggcaatgctcaagaaggtggtctaatgattgagaattataacgatctcaaagaagatgacactattgaagcatacattatggaagaaattaaacgtaaataacccctatgagaaactcaacttgtatctttagttggtagggaaatacaaaattatggctaggctcgtcctagctttcaagttatgagcacaatgaagaaaggattaattatggctaatcatcgtattgatcgcgttggaatggaaattaaacgtgaagtcaatgagattttgcgtctccgagttaatgatccacgtgtacaagatgtcacaattactgatgttcagatgttgggtgacctttcaatggctaaagtattttatactattcattcgacacttgcttctgataatcaaaaagcacaaattggtttagaaaaagcaactggtactattaagcgtgaacttggcaaaaaccttactatgtataaaataccagatttacaatttgttaaagatgaatctattgaatacggaaataagattgatgaaatgttgcgcaatctagataaaaaagattagaatcaagattaagaataataaaaaataaaccatgtcaaaatcatggtttattttttatagctttagagttgagatagctagtattaaggagttttattgatgatatcaatcatttgatactgtgctgttttagcttcttcaatagggtaaattggataaacatgattcattccctcttgtgcaatatagttaacggggtgattagctgcttggagttgtgcagcataatcgcgaatatctgggaagaatatttctcgtgttccagtaaataacgtaataggagcgagtttagtagcaggggcatttttaggactaacatatgtatggttagtattattagaaccatttgcccaaatttcacctacacgtgcgagaccccaagcagataggataggatcagtatcttcgtatttgggaatttctggatgtttcattgtcacatctagccatggagataagaggataatatttttaggttgaggaatagcctcttgccctgattggtgagacaatgcatgcgctaatcctagtgctaatcctccgccagctgaatcacccatcaaagtgagattagcgtttttttcatgaaagtgtctataaaggttaaccaatctagggatagcataatcataggtataacgaggagtttttggataaattggtaaaataatttttgcatcaagactagttgagagcgtcttaagcatgctgatatggtaaggcgttggattatttaagtaagagccaccagctaaatagaaaatggtcttttgattagctttaccgttgtcattccaagaatagacttgcatatcaaaaagtctctcttgaacaagccctccattaacagagtttgggtctaagtaataacccttatcagattgttcacggctagcatttaagtacttttgaaatgagctttcatcttgaactttataataacttttatcgcgctttagccaaaagtattgttcgataaaccaacttttccatgaacgcccacttgcttttgcatgtggtgtacaggcgatggataaaatggtgataatactaaatagtagcaatagttttttgaaggacggtttcaaggtattctccttaatataatgttattttttgtgtaatattattataataaaaccaacatctttgtcaatagaataaagaaagatgagaaatgtttttcggtttacaaatgtagatttatttgctaaaattggtttacaaacgtaaatcgaaagaggtgagaaaatgactatttcaagcgcagaatgggaaattatgagagtggtttgggcacagcagaatacaaccagtaatgagatactagcagttttactagagaagtatgattggactccttcaactgtcaaaaccttattaagaaggctcttagataaaggctacgtgagcagagaaaaaatgggaaaaggatttagctattctcctttaattgatgaagatttagctatgatgtcagaggtagatagtgtatttcaaaaagtttgccagaccaaacatgttgctattgttagacacttattggaaagtataccaatgacagagaaggatcgattaaatttgcaatcatcactagaagctaagaaaggcaaaacacttgaacgtgtagcttgtaattgcattcctggtcagtgtcaatgccattagaaaggagaaaatatggctaatagaaaagaaacatttttgattgatgggatgacttgtgcatcttgtgctttaacgatagaaaaagctgtcaacaagttagaccatgtggatagtgcagtagtaaatttagcaacagagaaaatgacagttacgtttgatgatacaaccttatcgccaaatgtgattgaagagtgtgtttctgagagtggatacgaagcatcgcttttcaaagaggaaacttctaaaagccaatctgaacggcaccaattagccattgaaaagatgtggcatcgcttttggatgtcagcagttgcaactatacctcttctctatatttccatgggaccaatgattaacttatggttaccatcatttttgatgccagataagggacctctaaactatggtatgatacaattattgttaacactaccggtgatgtattttgggcgtatcttttaccaaaatggttttaaagcactttttaaaaggcatcccaatatggattcattagttgctatagccacaacagcggctttcatttatagcttatatggattgtacgaaatattacagggtgacatacactacgctcaccagctttatttcgaatctgttgcagttattttaacacttattactctaggaaaatattttgaaatattatccaaagggcgtacttcggcctcgattgaaaaattattaactttatcagcaaaagaagcaagagttatcaaagatggtgaagactatatggttcctttggataaagttaaaataggtgaaacaattcttgtcaaacctggagaaaaaattcctcttgatggccatgttgtagcaggagaatcaagtattgatgaatccatgttaacaggtgaaagtattccagttgaaaaaaaggttggtagtaaggtttacggtgccagcattaatgggcaaggtagcttaacgattttcgttgaaaaagaagctggcggttcccttctatcacaaattattaacttagtagaagctgcacagacaagtaaggctccaattgctaacttagcagacaaagtatcaggagtctttgtcccttttgttattgtcattgcaattttatcaggcttgagttggtacttaattctggggcaaagttttgccttctctctgaagattatgattgcagtcttagtgattgcttgtccatgtgctttagggttggcaactcctacagctattatggtggctagtggtaaagcagctgagaatggtattttatttaaaggtggtgaagtgttggaaaaggctcaccacattgatacaatagtttttgataaaacaggaaccttgaccaaagggaaaccagaagtagttgctatcaaaacatatgggggagataaagaggagtttttaggtcaggtagcatcagtagaaaaactttcaaatcatccacttagccaaacaattgttaataaagcaaaagagaaagaacttcccttaagggaagtcatggcttttaaaaatattttgggttacggtttgagtgcaactattaatggtaaaactatgcttgtaggtaatgctaacttaatgactaagaacgatgttaatttagatttagcaaaggctgatatagaaatagctcaagaagaagcacaaactgtggtttacgtttccgaaaatggagtgttgagcggtttaataactttaacggaccagctaaagacagatagccaagaaacagttaagcagttacaaagattaggatttaatttagttttacttactggtgataataaggctagtgcagatgccatagcacaaaaattgggtatcacgacagttgtttcagaagttttacctgatcagaaagcaaacgttattttagaacttaaagaaaaaggcggacagattgcgatggttggtgatggcatcaatgatgctcctgcgctagctagcagtgatgtaggtatctctatgagttctggaacagatattgctattgaatcagcagatatcgtgttgatgaaacctgagttaacagatctcttaaaagcaatgactatcagtaaacaaacgattcaaattattaaggaaaatttattttgggctttcttttataacgttttagcgattccagtggcaatgggtgttttacatctttttggtggtcccttactcaatcctatgttggcaggcttagctatggcgtttagttcagtttcagtagttttaaacgcacttcgcttaaaagtcttaaaataataaagataataagactgaatttttatgaagggagaagaatatgaaacatacctatcgagttagtggcatgaaatgtgatggttgtgccaaaacagtttctgataagttatcaagtgtgattggtgttgacgaggttaatgttgatttgactaaaaatcaagttgtcgtaagtggaaaaacattcaaatggcttttaaaacgttctttaaaagacacaaagtattcactagaagaggaaataaattaataactaaagaagtggttacagcttttaatttcttaatttgagcagtttctcacttcttttttattctaaaaatgataaactagaatagaattagttgtgaggagtgcagatgtcaattgatatttggaacattttaagtttggttggaaccgtagcttttgcaagttcgggagctattgtggcgattgaggaagaatttgatattctagggctttttatcttaggttttgtaacggcatttggtggtggagctattagaaatgtactaattggcttgcctattgaaacactttggagtcaaggaattgctttttatgcagcagcagcagctattttatttattatgattttccctaatttgttgagtggtaagggacgggatgccgaagttgtatcagatgctattgggttagcagcgtttagtgttcaaggagcactatatgcgactcaatctcatcaacctcttagtgctgtcattgtcgcagcagtactaactggtgcaggtggtggtattgtcagagatgttctggctggccgaaaacctggagtactaagaagtgaaatatatgcaggttggtcaatattagtggggatcattttatattttaaaattgctaaaacaacaactgactattatttgttagtgttagttgtaactagcctaaggatgttgggttataagaaacaatggcacttgccagttgtcagaccacgtaagaaatgatagaggagaaaaagatgataaaattaattgctattgatatggatggaacgcttttaaatgatgaaaagaaaattccaaaggaaaatatccaagctattaaagaagcaactcaagcaggtattaaaattgtactgtgtactgggcgaccgatgtcaggtatacttccttattttaatgaactaggtttaacaaaagaggagtatattatcatgaataatggttgtagcacttatagcacgaaagattggcaattgattgattctgcaactttaacacatgatgaactcatctttcttgaggaggttgttaaagaatttcccaacgtttgtttaacattaacagctgaaaatacattttacgctgttggagaggaagttcctgaaattgttgcttatgatgctgatttagtttttacaaaagcaaagtcaacaagtttagatgctcttcgcaatcaagaagaaattgtctttcaagcaatgtacatgggattagatgcagatgtaactgcttttcaagaagctgttgaagaagccttaatctcgaaatttagtggagttcgaagccaagactatatttatgagattatgcctcaaggagtaacaaaagcaagaggcttaaaatccttgatagcaaaattaggactggatattaatcaagttatggccatcggtgatgctcctaacgatattgaattattagatttagttcccaatagcgttgctatggggaatgcatcagatgagattaaatctagatgtaaatatataacggtggataataacaaagcaggggttgctaaagctatttatgactatgctttacgttaaaatagatatagaataataaagggaactttaaacactgtttgtttagggttcttttgtttaataaactaacaaaattcagaagtttacagatagcttatgctataatagacctatgacaaacaagaataaattacttttaattgatggctcatctgtagcctttcgtgctttttttgctctttataatcaaattgaccgctttaaaaacaattctggacttcatactaatgccatatatggtttccatttgatgttgaatcatattttaggtcgtgtccagcctagtcatattttagtggcttttgatgccggaaaaactactttccgtacggaaatgtatgcagattataaaggtgggcgtgctaaaactccggatgaatttcgtgaacaatttccttacattcgtcaacaattagatgtcttaggcatcaaacattatgaattggaacattatgaagccgatgatatcattggtactcttgcaaaacaagccgaagctagtaatgaacattttgatataacggtggtttctggggataaagatttaattcaattaacagacactaacacggtagtagaaatctctaaaaagggagttgctgagtttgaagaattcacgccagcttaccttatggaaaaaatgggaattacgccgagtcaatttattgatttaaaagctttgatgggagataaatcagataatattcctggggttactaaaatcggtgaaaaaactggcttgaagttgctatcagaatatggttccttagaagggatctatgaaaatattgaggctatgaaacagtctaagatgaaagaaaaccttatcaatgataaggagcaagctttcttatcaaagaccctagctacaatcaacatagcatcacctataacaatcggcttagaagatatcctttatagtggaccgcaagatataaaagccttgtctcaattttatgatgagatggattttaaacagtttaaagcagctctgggtgaggagacaagtcaggaagattttgaggttgactttactgaagtggagcaattaaaaacagaaatgttctccgataatgatttttattactttgagatgttgggtgataactaccatgtagaagatttaattgggatagcttggggaaatagcgatacaatctacgctactagtaatgtatcgttattgcaagaagctttatttaaaaaagctttatcaaaacctatcaaaacttatgattttaaaagaagtaaggtccttttaaatcgttttaatattgatttaccagagccagcctttgatactagattggccaagtaccttttgtctactactgaggataatctagtatcaacaattgctaggttatatacaaatctgccactggatactgatgatgctgtttatgggaaaggtgctaaacgcgctataccagaaaaaacacgatttcttgagcatctagctaaaaaagtaaaagttttagtggattctgaggctaatattatgcaacagcttaaagctaatgagcaagaagaattgctgtttgaaatggagcaacctttagcgaatgttttagctaaaatggaaattcgaggtattaaggttaagaaaaataccttgaatgaaatggccattgaaaatcaaaaagtcatcgaaacattaacacaagaaatctatgaattggctgggcaagagtttaatattaattctccaaaacagttaggaaagttgttgtttgaaacgttaggtcttcctgtagaaatgactaaaaaaacaaaaacaggttattcaactgcagtagatgtattagagcgcttagctccgatttctcctcttgtaactaaaattttagagtaccgtcaaatcactaaattgcaatcaacctatattattggtttacaagattatattttagaagatggtaaaattcatacacgttatgttcaagatttgactcagacaggtcgtctttcaagttctgacccaaaccttcaaaatataccagttagactagagcaaggacggcttatccgaaaagcttttgttccatcagaagacaatgctgttttattgagttcagattattctcaaatagaattgcgcgtgttagcacatatttcaaaagacgaacatttgatcgctgcctttaaagagggagctgatattcatacttcaacagctatgcgtgtttttggtatcgaaaaacctgagaatgtcactcccaatgatcgtcgaaatgctaaggctgttaattttggaattgtttatggtatttcagattttggtctatcgcataatttaggaatacctcgtaaactagcgaagcaatatattgacacctattttgagcgttatcctggaataaaaaactatatggaaacagttgttcgtgaagcaaaagataagggttacgttgaaacacttttccatcgtcgtcgttcattaccagatattaattctcgtaattttaacattcgccaatttgcagagcgcacagcaatcaattcaccaatccaaggaagtgcagctgatattcttaaaattgcaatgataaatttagatagggtacttgataaaggtggttataaatcaaaaatgctgttgcaagttcatgatgaaattgtacttgaagtccctaacgaggagataggagcaatcagggagttggttacaaaaacaatggagtcagcaattagtttatcggtacctttgattgcagatgagaacgcaggtgagacttggtatgaagcgaagtagtggacaacatacgtaaaggagtcattaatatggtttatcattttcaaaatccaagtgattttatgttaaaaaattatttaacaaaagcaaagaccatcgcagttgtaggactgtcagaccgtcaagaaactgcagcttatcaagtatcaaaaataatgcaagaagcaggttatcaaattattccagttaatcctaaaaatgcaggacagaaaatacttgggcaaatgacatatgcctcacttaaggatgtcactgaacatattgatattgttaatatttttcgacgtagcgagtatttacctgatattgcaagagaatttttagaagtagacgctgatattttctgggctcagcttggacttgaaagtcaagaagcagagacaattctaaagcaagcaggacacaaacagattgtcatgaataaatgtctgaaagttgaatgccaaaaattacactcagaaactaactaattaccgtgtttaataggcaaataatataaattatgctataataaccatgctaaattaaagttcgtgctggaaaggagtcctatggacagtcattcacatggtcatagacctctcgatgcttatgaaaacgtcctagagcatctccgtgaaaaacgtattcgaattactgagactcgaaaagctattatttcctatatggttaatagtcgtgagcatccgagtgcagaaaagatttacaatgatttattaccagaatatcctaacatgagcttggcaacagtttacaataaccttaaggtccttgtggatgaggggtttgtgacagagctaaaactttgcaattatagtacaacttattatgattttatggggcatcagcacctaaacattgcctgtgaagattgtgggaaaatcgttgattttgtcgatgttgacttattggatatttctagagaagcacaccaacaaacaggttttgaagtgactagagttcagttagtagcttatggtatctgtccggagtgtcagaggaagcgtaaggataaatataaaaaagattgaaacgtaattgttcaatctttttttgtttatagactaagagaaaaagtttaagttttactaagtaataattaagaaataatttataattgcttaaaaaatgatttattttttgttggtatactctcattaacaaaaagaaagaggaatcccttatgaaaatatcacaatacaataaatggtcaattcgccgattgaaagttggagctgcatctgtaatgattgctagtggaagcattgttgctttagggcaatctcatattgtttcagcagatgagatgtcccaacctaaaacaaccattacagctccaacagctaacacttctacaaatgtagaaagtagtactgataaggcattatcaaaagttactacgatggagacaagttcagaaatgcctaaaatgcaaaatatggcaaaagttgaaaaaacgagtgacaaacctatgatggtggctacctctgttagaaaaatgatggcaacgccgacacctgtagcgatgaccaaaacgactagtgtagatgaggtaaagaaatcaactgatactgcttttaaacagacagtagacgttccggctcattatgttaatgcagcaaaagggaatggcccatttctagcaggtgtaaatcaaacgattccatatgaagcgtttggtggagatggcatgttaacgcgtttaatccttaaatcttctgaaggagcaaaatggtcagataatggtgttgataaaaatagtccattattaccattgaaaggcttaactaaaggtaaatatttctatcaagtttctttaaatggtaatacgacaggtaaagagggacaagctctcttagatcaaattaaagctaatgataaacatagctaccaagccacaattagagtttatggtgctaaagatggtaaagttgatttaaaaaacatgattagcccaaaaatggtaaccattaacattcctcacattacaactgatatggaagtaaaaaattctctaaagatggcctttaaagaaaaagtagacgtcccagcaaaatatgttagtgctgcaaaagctaaaggtccatttttagcaggtgttaacgaaacgattccatatgaagcgtttggtggggatggcatgttaacgcgtttaatccttaaagcttcagagggagcaaaatggtcagacaatggtgttgataaaaatagtccattattaccgttaaaagatttaactaagggtaaatacttctaccaagtctctcttaatggcaatacagccggtaaaaaaggccaagctctcttagatcaaattaaggcaaatggaagccatacttatcaagcaactatcactatttatggtacgaaagatggcaaagttgatatgaatactattttaggacaaaagacagtgatgattcatattaatgtcgctaaaaaagatatgaatagcacatcaatgatgatgaaaaaagataagatgacaatgcctatgaagaaagaaatgacttcatctaaaataaataccggtatgatgatgtctaacaacaagatgtcagctaatatgcaaatgtcatcacaagccaaatcaaatgataaagctggtaaaaaaatgtctatgatgtctaaaaatttacctaatacaggtgaaacaaagcaacaaaatgtaggtgtgctaggtatgcttagtctagcctttgcgacaggtctaactgcgctaggtcttaaaaaatctaaacaaagatagggatagtatttaattcagaacaccaaatttgtttaaaattattgagggttatcgtggtaaaatagtgttatactagaggtatagcactattttgactcattaggagagtagaatgacacaaaaattattattagttgacgatgaatttgaaattattgatattaatagacgttatctagagcaagcaggatatgaagtgtcagtagctgcggatggcatagaagcactcaaagaggtagatgagaatcgttttgacctaattattagtgatattatgatgcctaaaatggatggctatgattttattagtgaagttctagttcgagaacccaaccaaccttttctctttataaccgctaaagtatctgaaccagataaaatttactctttgagtatgggtgcagatgactttatttccaagcctttcagtcctagggaattagttttacgtgttaaaaatattctaagacgtatctatgggaatcatcaacaatctgaagtgttgacgattggtgatttggttatcgaccaaaaacaacgtttggtaatggtggactgcaatacaatttccttaaccaataaatcatttgacttgctttggatattagcaaatcatttgaatcgtgttttttcaaaaacagagctttatgaacgtgtctggggcgaagaatttttagatgacactaatactttgaatgttcatatccatgccttacgcaatgaccttgctaaatttagtacagacaataccccaactatcaaaacagtttggggattagggtataaattagaggaataaaatgaaattaaaatattatattgttattggttaccttatttctatgttaataactgtagcaggtgttttctttgggcttaatcatatgctgattgagactcgaggtgtttactacatcctttcagttacaattattgcctgtattgtaggtggtatagttaatttgttcttattatcaagtgtatttacatctttgaaaaagttaaaacaaaaaatgaaggatatttctcaaagatgttttgatacaaaagcacaaatttgttcaccacaagaattcaaggatttagagacagcctttaaccaaatgtcttcggagttagagtcaacgtttaaatctctaaacgagagtgaacgcgaaaaaacaatgatgattgcacaactttcacatgatatcaagactccaattacttctatacaatcaacagtagaaggtattttagatggtattatatctgaagaagaagttaactattatctcaataccatttctcgtcaaacaaaccgtcttaaccatctggttgaagaattaagttttattacattagagactatgtcagacacggctgaacctcataaagaagaaacaatttatctggataaactactgattgatattttatctgaatttcaattggtgtttgaaaaagaaaatcgccaagtaatgattgatgttgcgccagatgtttcgaaattatctagtcaatatgataaattatcacgaattttattgaatttgattagcaatgcagtcaaatattctgatcctggaagtcccttgactatcaaggcctattcaaatcgtcaagatatcgttatcgatattattgaccaaggctatgggataaaagatgaagatcttgcttctatttttaatcgtctttatcgtgtagaatcttcacgaaatatgaagacaggaggacatggtctaggtctttatattgcgcgacaacttgcacatcaactgaatggggatattttggtcgaaagtcagtatcaaaaaggcagtaagttctctttagtacttaaattacaaaaatagctaggaattattcctagctattttttgtaatgtttctataaaagattaagcgcgcagtagtttggtaaggaaggagatagatatagactaatccgaaactgaagattgtaaggaactgccaaccaataaaacttaagtctaaaaggaagagtctaagtttattaccattcattagttctcgactagcaaccagtactttagacggtccctcatagtttccactttctaattgagtgtaaaatactaaagttgagatactataggagtaatattgttgaacgagttttataactgccttagtagtaattaggctactaacaactattaaaacaggggcaaggataaggttaccactcaaaagtagcctaaaacttgaaatgatgattagtagaccaaaagtacttagtagataaaagaaagataaaattagtccttttagaacaagtactgagagtaatttccagaaaatatggcttgaaaatacataagtattgtccgagaatctaacgtttagtttctgatttttgacgacatctaacattacaaaactgactgaaataataaaaagtgtgtaaaagaaataaactggaagaggtacaaaaaaatcaagtagtgtcatattattatattgataataaaatgatatatataacgtaataatactaaggagaatcgggagtaaaaaaagttgattcttaccttgaagattgcttaatatagtttttgcctcatttttaatttctgaattcgtcatatctcctccatacacaaaagtacaattcatttcattataacacattccttaagatgagcatgacaagagtacatttttttgataaaatcttaatggctaaaaaagaaattaatacaaagtattacatttagatattgattagcactaaagcccatgactgtttttcatggaagcaaggagaaaacgatgactgatcatccaataaaatatcgattaattaaacaggaaaaacacacaggagccagacttggtgaaataatcacaccacatggtacatttccgacaccaatgtttatgcctgttgggacacaagcaactgttaagacacaatctcctgaagaactaaaagaaatgggttcaggaattattctatcaaatacctaccatttatggttacgtccaggtgatgaattgattgctaaagctggaggtttacataaattcatgaactgggatcaggctattctaacagacagtggaggctttcaggtttattctttggctgatagtcgaaacatcactgaagaaggagtaacctttaaaaaccatttaaatggtgcgaaaatgtttttatcaccagaaaaagctatttcaattcaaaataaccttggttctgatattatgatgagttttgatgagtgtccacaattttaccagccttatgattatgtaaaaaaatcaattgagcgaacaagccgttgggcagaacgtggattaaatgcccaccgccgtcctcatgatcaaggactatttggtattgttcaaggggcagggtttgaggatttacgtcgtcaatcagcacgagatttagtatcgatggattttccaggttattcaattggagggcttgcggtcggagaaacacatgatgagatgaatgcagttcttgattttactgttccaatgcttccgaatgataagcctcgttatttgatgggagttggtgcaccagatagtttaatagacgccgttatccgaggagtagatatgtttgattgcgtcttacctactcgtattgctcgaaatgggacatgtatgacaagtcaaggtcgcttagttgttaagaatgctaaatttgcagaagattttacgcctcttgatccaaattgcgattgctatacttgtaaaaattatacacgcgcttatattcgtcacttattgaaagcagatgaaacttttggtattcgtttgactagttaccataatctttatttccttgtcaatcttatgaaagatgtcagacaagctattatggatgataatcttctagaattccgtcaagattttatggagcgctatggctatggcatgaataaccgtaatttttaaaaaagttcctggtaaaacagggcttttttttgaattgtttgttaaccgtttttttaaaaaagttgacaatagaaaaacttttgtataatatgttataggaggaatcatgatgcaagagtactttggtattggtcttgatagtagcagccgctgttaccactatcatactaaattggatattgtcgctttaaaatgtgctgtttgtcaaaaatattatgcttgttataaatgtcatgatgcactcgaggagcattgttttgcagcaacaaaatctgatgaaacgtttcctgtcttatgcggttcttgtcgtcagatgttgacattaaaagagtataaaactggtttttgtccttattgtcgtatgctttttaatccaaattgtcaacgccatgattctatttatttttcgaaggagtaatttttaatgtttcacacaaaaagcctaatccagatggctatgatggctactttattggtggtacttggtttcattcctgctctaccacttggtttcattccggtccctatcgtcttacaaaacctaggggttatgatggctggtgttattttgggcggaagaaaagggagtttatctattttgctcttctttcttgtcggtttagttattcctgtattctcaggtttacgttcgactatacctgtattgacaggaccaacagctggttatgttattgcttggttgtttgttcctttgcttatctcatatggtgtaaaattagtaaataaaaagaattttatagctattttccttattgtatggctagcaggggtcctttttgtagatgtagcaggagcagtttggctggcatcttatacgaacatcccattagataaatcacttcttcaaaacttagtatttatcccaggagatacaataaaagccattatagctgctgttgttgctgttaaatataaagatagttttttcttgactgaaaaataatcaagattgctatatattagatggactagtaaatctaaaaatttagatttactagtcttttttgtgcataaaatctaaaacagttattcttaataaaatttggtataatagcattaaatcagtaaggaggggattatcatgaaattaacaacgttaggttgttggggtggttatccttataaagatggaggaaccacaagttttctattaactggagaaaataattttcacttattaatagatgcgggaagtcgttcaatcaatgagctagaaaaagaaataagcccgttggatttggatgcagttatcatcagtcattatcatccagatcatgtagcagatttgggtgtgttgtatcattatcgtttgctataccctaaagataaatgggaacccaaagtattgccagtttatggacataatgaggatgattatgagttttctaaattgacattacctaacgttgctcaaggaattgcttatcataccaatggagttgagcaagttggtcccttcaatattacgtttatcaaaacagtccacccagtcgtctgctatgccatgaggattacagaaagagaaactggtcaagtattagtctttacaggagattctgggtattttgctgaccttgtaccttttacaaaaggcgcagatttatttttagcagacgtttatctttacgagggaaatgaaaatcatattgcacatttgactagtaaagaagcaggtgagattgcttataacgctaaagttaagaaattagttttaacacatgttccgcagtttccgggagaaggaataaaccccgaaaatcatttggaagaacttcgactacagtctgaaaagtatgcaggtggcatctctgttgatttagctcagccacataaatcttgggacttaggaaaactataatgcagaaatttacccaagaagaaaaagaatggtttatgacagaagctctaaaggaggcaaaatcctccttagagaaagaagaaattcctataggttgtgtcattgtaaaagatggtcatattattggaagaggacataatgctcgtgaagagtttaataaagctattttacatgctgaaatcatggctattaacaatgcaaatgagaaggtagggaattggcgcttattagatactactttatttgttactgtagaaccttgtgtaatgtgtagtggagctattggcttagctagaattccccacgttatatatggcgctaagaatacgaaatttggagcagcgggaagtctctatgatattttaagtgatagccgacttaatcatagagttgaggttgaaaccggcattttagaagatcaatgcgctaaaataatgcaggatttctttcgaaaaggacgacaacgcaagaaagaagctaaactaagtgaaaaaactaagatttgatagcttgcaataaaatattagttttgttataatatctttggagcaacatttactcgtgaagtgggtcaggggaggaatccagcagccctaagcgatgctaaatgtgtgctctttttattttcaaaagtcaaagtgtttttggaaataattatgaaagtttcataaaaattggtagcgtttcaaaaaatatgaaaatacagttaaaaaaccttgaaaaaaaactcacaaaagagtaagatgatagtgaaacataattgttaggagaaataaaatgacacatattacatttgactattcaaaagtcttgggtcaatttgtaggcgaacacgagttagactacctacaaccacaagtaagtgcagcagatgctttccttcgtcaagggactggtcctggctcagattttctcggatggatggacctcccagaaaactatgacaaagaagaattttctcgcattcaaaaagccgctgaaaagattaaatcagatagcgaagtactcgtggttattggtattggtggttcgtaccttggcgcaaaagcagcaattgactttttgaataatcattttgctaatttgcaaaccgcagaagaacgtaaagcgcctcagattctttatgctggaaattctatttcatctacttaccttgccgatttagttgaatacgtccaagataaagaattctcagtaaatgtcatttcaaaatcaggtacaacaactgaaccagcgattgctttccgtgtatttaaagaacttctagttaaaaagtacggtcaagaagaagctaataaacgtatctacgctacaactgataaagttaaaggtgccgtaaaagttgaagcagatgctaacaattgggaaacatttgtagttcctgataatgttggtggtcgtttctcagtactgacagccgtaggtcttcttccaattgctgcttcaggagcagatattactgctcttatggaaggcgcaaatgctgctcgtaaagatttatcttcagataaaatctctgaaaacattgcttatcagtacgctgcagttcgtaatgttctttatcgcaaaggttatatcacagagattttagctaactacgaaccatcattacaatactttggtgaatggtggaaacaattagcaggtgaatcagaaggtaaagatcaaaaaggtatctatcctacatcagcaaacttctcaactgatcttcactcacttggtcaatttattcaagaaggttaccgtaacctctttgagacagttgttcgcgttgagaaacctcgtaaaaatgtgactattcctgaattaaccgaagatttagatggtcttggttatcttcaaggaaaagatgtagattttgttaataaaaaagcaacagatggtgtactccttgctcatacagatggtggggttccaaatatgtttgtaacgcttcctacacaagacgcttacacccttggttacactatttacttctttgagttagcaattggcctttcaggttatcttaactcagtaaatccatttgatcaaccaggggtagaagcatataaacgtaatatgtttgctcttctaggtaaacctggattcgaagagcttagcgctgaattgaatgcacgtctttaaaaatatctaactaaaaagttcctcaaagagaggaactttttagttttgttgtaggataactaaaaacccactagcaccggtagcgatagtgggttggaaaaagggttgagaaaagttattaacttttctcaggagatttatgaaaaaggaaaataatttaggataatattttcctaacggctaggataaaccgcttattttaggatgatactagtatacagtagaaaccttaaataaaccttaaaaattcatactttatcattttattttcccctatactatttttgtataaatggtcaatattaatggtatcatagatatatggaaaagaaattattaagaaaagaagttttgataaccttaaaatctcaacctcaagcttacaaatcagaagttgactgtaaacttttagaggcttttataaaaactaaagcttatcaaaatagttgtgtaattgctacttacctatcttttgactacgaatacaatacacaacttcttattaaacaagctttatgtgatggcaaacgtgtccttgttcccaaaacttatccaaaaggtaaaatgatttttgtggactatcaaaaagataacttgaggacaacaccgtttggcttattagaacctgttaatgatagagctgttgaaaaagctagtatagacttaattcatgtgcccggacttatctttaacaataaaggttttcgtataggttatggtgcaggttattttgatcgctatttgagtgattttgaaggtgatactattagtactatttataggtgtcagagacaggattttgtagaagagaagcatgacgtagcagttaaggaggtattatgtctatgaagaagttcgctaaagagtatccgacgacagtactcttggtcagtctgacaacccttgtttttttattgatgcaactaacttatggaagtcaagcggagtctagccaagttatttttcaatttggtggaatacaaggtgattatctaaaagcatatccaacaaatctatggagactaataagtcctatctttgttcatattggttgggaacattttttattaaatggtttagctctgtatttcgtaggacaaatgggggaaagtatttggggaagtttgagatttctaattctctatattttatctggcttaatgggtaatatttttacgctattttttactccacatgtggtggcagcaggagcctcaacgtctttatttggtgttttttctgctatagcaatcgcagggtattttggaaaaaatccttatttaaaacaagttggaaaatcatatcaagtgatgatcttgttaaatttattttttaatatcttcacacccggagtgagtttagcaggtcatgttggtggtttagttggtggagtattggtggctatttttttgacaaaacaaaatggttctttattatttaaaacttggcaaagtattttagctttaatgatatttattattgtatcgatcagcttaataggtctatcgttggtataattctacggctatagcctctaaaaccaaactttctctgggaaaaatagaataaagtttgctaaatgatttttttatgttatgatagaaatctgtttttatgtgactataacttattaggaggttcattctcggtgaacagaaaaattattggcttaactctactatctttatctgtactaacattaacagcatgtggtaatcgttcagataagtctgcaaataaatcagatatcaaagttgcgatggtaactaatcaaggtggagtagacgataaatcgtttaatcaatcagcttgggaagggctacaaaagtggggaaaaaagaaggggttgacaaaaggtaatggctttgattatttccagtcatctaatgaatcagatcatgctaataaccttgatacggcagcctctagtggttataatttaatttttggtattggatttggtcttcatgatactattgaaaaagtatcagaaaataataaagatgttaaatacgttattgtagatgatatcattaaaggtaaagaaaatgtagctagtgttacttttgcagacaatgaagctgcttacttagctggagttgctgcagctaagacaactaagacaaaaacagttggttttatcggagggatggaaggcgtcgttgttaagcgatttgaagcaggatttaaggctggagtaaaatcaattgatccggctattaaagttgcggtatcttatgcaggctcatttacagatgcagctaaaggtaaaacgattgctgccacacagtatgcaacaggtgttgatgttatttaccaggctgctggtggtacaggagcaggaatttttagtgaggctaaaactgaaaatgagacccgcaaggaatctaacaaagtctgggtaattggtgttgacagagatcaaagtcaagaaggcaattatgtttcaaaagatggtaagaaagcaaactttgttctggcatctactataaaagaggtggggaaatctctccaatctgtagcagaattaacagagaaaaaacaatatccaggagggaaagtaacagtttttggtctaaaggatagtggtgtagatattaaagagcatcaattgtctagtgagggatctgttgctgtcaaaaaagctaaagaggatattgtttcagggaaaatacaagttcctatgaaatgataaaagtgtggaggaacaataagttcttcgtcaagtacaataaaaaagtttcctatttaggaaacttttttattgtacttgactcatattttacttcttagatgttttttctagagattttcctaaatcaatgatatatttcttcaagtcatctttaacttgtgggtgttgaagagcataatcaatagatgttttcataaaaccaaacttgtcaccaacgtcgtaacggtctcctgtaaattttctagcaaaaacacgttgcgttttatttaaagtatcgatagcatcggttagttgaatctcatttcctgcaccaggtttttgagtttctaaaatattaaaaatttctggagttaacaagtagcgaccaatgattgccaaattacttggagcctcttcgggagaaggtttttcaacgaaagtgttaacgctatatagaccattaactccttctccttgtggagcaataacaccataagcagaaacatcttcatgtggaacttccataacagcaattgttgatgcatgagtagcttcaaagtcattaattaattgtttggtgagaggaataactttattattggtaatatccattagatcatcacctagcataacaacaaaaggttcattaccaacgaaggcttttgcttgtagcacagcatctccaagcccacgaggatgactttgtcgaataaaatggagtcgaatgccagttgtttcatcaacaagtttgagaagttcgtttttccctttctcttttaggttatattctaattcaaaatttgaatcaaagtggtcttctatagaacgttttgatttaccagttacaactaaaatatcttcaattccagattttagtgcttcttcaacaataaattgaatagttggtttatcaacgattggaagcatttctttagctaaagctttagtagcaggtaaaaaacgtgttcctaaaccagcggcagggataactgcttttctgactttcatatatagctcctttaaatagtattaatataaacgatattagtgccattcattctctgaacgaaattcattggacatcatatctaaaatgctatctttgatattagccccttcatatattgatttataaatagcttctgtaatgggcatgtaaacatttaagttttgggcgatttcgtaagcaactttagttgttgagataccttcaataaccatccccatatttttttcaatatcttcaagtttctcaccacgtcctaaagcatctcccgctctccagttgcgagaatgaacagatgtaccagtcacaattaaatctccaactccggataaaccactgaaagtgagagggtcggcccctaattgtacaccaagacgtgttatctcagctaaaccacgcgtaataatagctgctttagcattatcaccataaccaagaccgtgtagtgctccagcaccaacagcaataatattttttagagcaccagctgtttctactcctacgacatcagtgttagtataaagtctaaaataatgattactaaacaatttttggacatacttagctgcttcaatatcttttgaagcagcagtaatcaaagtaatatcacgaacgatggcttcttcagcatgactgggacctgaaacaacaacgatatcactacgatattgttcagagatttcttcttctaaaattgtagaaagtcgttcatgagtaccaggttctagtcccttagaagcatgcataagaacaactttatgctttaaaagattagccacttgtttagcaacaagtcttgtaactttagttgggacgacgaataaaatgctgtcaacattattaatcgcttcctcaagattagtgtaggcttttattttggaatctaaggtaatatctttgaagtaacgttgattagtatggttagtattaatctcttctatttgttcaaccacgtttccccataagcgtacctcatgtccattgtcatttaatacttgtgcaagagcagtcccccatgaaccaggtccaagaacggcaattttttgttttgtcatcttattccttctttctaataataaggcatatagcgctaacattatatcatactctaatacactttgtcttgtttagtctgttgtcaatgatagtaacattagaaaagaattgagtcttttaggttatttatggtataataaaaccaatttagataaatggagcactattttgaaaaaaacctatcgggtaaaaagtgataaggattttcaaatgattttcagcagaggtaaaaatgttgctaatcgaaaatttgttatctactatttagaaaaagaacaaaaacactttcgtgtgggaatctctgttagtaagaaattaggaaatgctgttgttcgtaacgctattaaaagaaaaattaggcatgttttactctctcagaaaacagcgctgcaagattatgattttgtcgtgattgcgcgtaaaggtgtagaggaattggactatcaagcattagaaaaaaatcttatacacgttttaaaaatagcaggactcatctagaaaggtataaaattgaagaaaaaacttaaaacatttagcttaatattgctgacaggctctttattggttgcttgcggacgaggagaagtatctagtcattcagccacattatgggagcaaatagtttatgcatttgctaaatcaatacaatggctctcctttaaccattcaattggtttgggaataatcttattcactctaataatcagagcgattatgatgccgctttataatatgcaaatgaaatccagccaaaagatgcaggaaattcagccaaggctcaaggaattacaaaaaaaatatccagggaaagatcctgataaccgtttaaagctaaatgatgaaatgcaatctatgtataaagctgagggagttaacccatatgcaagtgtattacctcttctaattcagttacctgtcctatgggctcttttccaagctttgactagggtttctttcttaaaagtaggaacatttttgagcctagaattatcacagccggacccatattatattttacctgtactggcggccttatttacctttttatcaacttggttaactaacaaagcagctgttgaaaaaaatattgctttaactcttatgacttatgttatgccgtttatcatattggtaacaagctttaactttgctagtggtgttgttttatactggacggtgtctaatgcttttcaagtatttcaaattctattattgaacaacccatacaagattataaaggttcgagaagaagcagtaagagtggcacatgaaaaagaacaaagagttaaacgtgctaagagaaaagcaagtaagaaaagaaagtaggaaaaccatggtattatttacaggagcgactgtagaagaagctattgaaaaaggactacaagagttaaacatttcacgattgagggcacatataaaagttgtatcacgtgagaaaaaaggttttttgggctttggtaaaaagccagcaaaagttgaaatagaaggtatcaccgacgaagtaactgatattaatgaatcggtagcgttaaaaaatattaagaatgtaccgtctagcgtagatgtggtggaagaatatatagaggaggttgatgaaacgcttgaaaaagaagacgtatcacaaccagaacttccaaaaattgatgataaaaacgttgtaactacaagtgaagctattgaaaaaattgacctacttcctaatattgaagtagcagctgctcaggtgactaaatacgttgaaaatatcatctatgagatggatttagatgcaacaatagaaactacgacaagtaagcgacaaataaatctccaaatagaaacgccagaagctgggcgcatcattggttatcatggaaaagtattaaaatcgttgcagttgttagcacaaaattatcttcatgaccgcttttctaagagtttttcagtatccattaatgtccatgactacgttgagcatcgtacagaaactttaattgatttttctaaaaaaatagctaggcgtgttttagagactaatgaaccttaccatatggatcctatgagtaacagtgagcgaaaaactgttcataaaacaattgcaactatagagggtgttgaaagttattctgaaggtaacgatcctaatagatttgtagtagttactaagaaataaaaagaggtgagacctctttttttcttgcgctctatctacattttcagaaaatgtagaaaaagtatgaaaaaagagttgacaaagtaagagatgatgtagtaaactaaataagttgtctcgagagagcagtttctattagcgcgtagttaacaacttaaaaaaagtagttgacaaagcagaataagtttgctagaatatagaagttgtctcaagagaggcaaagacctttgaaaactgaacaagacgaacgaatgtgcagggtggatttacattgtaaatccgtcaatgacaaaaaaacaataaatctgtcagcgagacagaaaagagcaaagctcaaacttttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggataaggaaacctgccatttgcgtcttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattgtagaaagtaacaagaaaataaaccgaaaacgctgtgaatatttaatgagttttctagttttaaagaaactaggttaataaggttaagttaataagggcgcacggtggatgccttggcactagaagccgaagaaggacgtgactaacgacgaaatgctttggggagctgtaagtaagcgctgatccagagatgtccgaatgggggaacccactagttaatgactagtatccatatctgttaaggatatgagaaggaagacgcagtgaactgaaacatctaagtagctgcaggaagagaaagcaaaagcgattgccttagtagcggcgagcgaaacggcaggagggcaaaccgaagtgtttacacttcggggttgtaggactgcgatataggattaatcattatagaagaattacctgggaaggtaagccaaagagagtaacagcctcgtatttaaaatgatagattaaccttagcagtatcctgagtacggcgagacacgcgaaatctcgtcggaatctgggaggaccatctcccaaccctaaatactctctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcgtcatagtatcatgttgtagacccgaaaccatgtgacctacccatgagcaggttgaaggtgaggtaaaactcactggaggaccgaaccagggcacgttgaaaagtgcttggatgacttgtgggtagcggagaaattccaaacgaacttggagatagctggttctctccgaaatagctttagggctagcgtcgatgttaagtctcttggaggtagagcactgtttgggtgaggggtccatcccggattaccaatctcagataaactccgaatgccaacgagatataatcggcagtcagactgcgagtgctaagatccgtagtcgaaagggaaacagcccagaccaccagctaaggtcccaaaatatatgttaagtggaaaaggatgtggggttgcacagacaactaggatgttagcttagaagcagctattcattcaaagagtgcgtaatagctcactagtcgagtgaccctgcgccgaaaatgtaccggggctaaaacatattaccgaagctgtggatgacacaaaagtgtcatggtaggagagcgttctatgtgtgaagaaggtgtaccgtgaggagcgctggaacgcatagaagtgagaatgccggtatgagtagcgcaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatatagtgatggagggacgcagtaggctaactaaaccagacgattggaagtgtctggtcaaacagtgaggtgtgatatgagtcaaatgcttatatctttaacattgagctgtgacgaggagcgaagtttagtagcgaagttagtgatgtcacactgccaagaaaagcttctagcgatacatatactctacccgtaccgcaaaccgacacaggtagtcgaggcgagtagcctcaggtgagcgagagaactctcgttaaggaactcggcaaaatggccccgtaacttcgggagaaggggcgctgattttagatcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctatgataacgggacgccagtttcgtttgaggcgttgttgggatactacccttgtgttatggctactctaacccagataggcaatccctatcggagacagtgtctgacgggcagtttgactggggcggtcgcctcctaaaaggtaacggaggcgcccaaaggttccctcagactggttggaaatcagtcgtagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataagcgctgaaagcatctaagtgcgaagcccacctcaagatgagatttcccatgattttatatcagtaagagccctgagagatgatcaggtagataggttaggagtgtaattgtggtgacacatttagcggactaatactaatagctcgaggacttatccaaaaagagatattgacaacgttacggtttcttgttagactatagatattcaattttgagtgaataaggctcaatagttaagtgataattgcctaggagatacacctgttctcatgccgaacacagaagttaagccctagaacgccggaagtagttgggggttgccccctgtgagataaggtagtcgcttagcaaagggagtttagctcagctgggagagcatctgccttacaagcagagggtcagcggttcgatcccgttaactcccatagaagcgggtgtagtttagtggtaaaactacagccttccaagctgttgtcgcgagttcgattctcgtcacccgctttactttataagaaagtaaaaaccaagcaatagcttgggcgcgtagctcaggtggttagagcgcacgcctgataagcgtgaggtcggtggttcgagtccactcgtgcccatcaagaatatggtccgttggtcaaggggttaagacaccgccttttcacggcggtaacacgggttcgaatcccgtacggactattcttaaaaaagtagaaagtgatctttctactttttttattttaagtatatatttttgcaatagtattgtaattaaatttgatattaataaaaacacactatttagtgtgttagttagcgctttttcaattcaaggtaccgtttataccagatattgatatatgatgatgaaaaggggcctttattctcatttatccattctaccaatatttttacattttcctttaatatataatcaatatcggtaggatagttcatctgagctttatgctgttcatattcgtccacatctagtagtcttttttcaccatctgcaaatactttgacatcaaggtcatagtcaatatacttgagtgcttcagggtccaagatatacggacttgctagattacaatagtaggagacaccagtttcacgtatcatagcgataatgttaaaccagtattttttatgaaagtatactattgcaggctctcgtgtcacccagcgtcgaccatcattttctgttactaaagtatgatcattaacaccaatgagggcattttcggttgtttttaataccatggtgtcacgccaagttcggtgtaaactaccatcatgtttgtaactttgaattgtaataaagtcgccttctttaggtaatctcatagcctaccaactttctacaatttatacgtctgttatagtttatcataattttctgtaaaatacatcgtctgagagttattatcttataaatattctcttaaagcacttttgatatcttcgtactggtatcctttacgcattaaggcattgattatacgttgctttaattcatactggtcatgtttttttgataatttttggtattgtttatctaattctttataaatgaggtcttcttcaagttcttgatctttttcaatttcaaggttttgaattacggtatgcactatctgataatcaaatccttttgtagttaagctctgcatcaatttatcttttaatgcttttagtggaagtttgttttgatattttttatagagtttttggcttattttggatgctaagtcttgaaagtttatagcttgaagttcagattcaattattttacttttgatacctttttgcaataatttttgttttatcacgtatggtcccttatcgccagtatttagattttgctgtatgaaagattgcacgtagtttttatcgtttatccaattctcactttttagattatcaataatttgtggaataattttagaatcaatatcatgttgttgaagatatttaataacttctttctcggttctctgcttgaaagaaatataataaagacctagatttttaccgtatgatagttgggcaaattttttaatattttcaagtttctcggcattaattatcatccctttacttaacataaaatgaacgatagtatcttctgttatatataaattttcggtattgtctagctctagagtgtaaagtctttttttcttttcgattttggttattttcatagtttttattatagcaaaaatgataaaatagtaaaaatgagtctttttttaaatgttatggatttatagtattttcttagttagggagtaatgaactgatgaatgtggttttaaaacagcgaattcctttaaaaattaaacgaatgggaattaatggtgaaggaataggtttttataaaaaaacactaatctttgttccaggggccctcaagggagaagaggtgttttgtcagatttcttctgttagacgtaattttgcagaagctaaactgttaaagataaataaaaaatctaaaaatagggtagaacccccttgttctatttataaagaatgtgggggatgccaaataatgcaccttcaatatgataagcagctagagtttaaaacggatgttattcgacaggctctaatgaaatttaaaccagagggatatgagaattatgaaatccgtaaaacgataggtatgtcggaacctgaacactatcgtgctaaattacaatttcaagtgcgttcgtttggagggaatgtaaaggcaggtttatatgcacaagggacacatcgattgattgatatcaaagattgtttagtgcaagatagccttactcaggaaatgataaatcgagttgcagaacttttaggaaaatataaattgcctatttataatgaacgtaaaatagctggtgtccgtactgttatgattcgacgagcacaagcgagtggagaggttcaactgatctttatcacaagtaaaagacttgattttgatgatgttgttattgaattagttcgagagtttcctgagttaaagacagttgctgtaaatatcaacgctagtaaaacaagtgatatctatggtcaaataacagaagttatttggggtcaagaatccatcaatgaagaagtattagattatggtttttcgttatcaccacgtgctttttatcaacttaatcctaaacaaacacaaattttatatagtgaggcagttaaggccttagatgtgaaggaagatgatgatttaattgacgcttattgtggagtaggaacgattggacttgcttttgctggaaaagttaaaagtgttcgtggaatggatattatccctgaggctattcaggatgctaaagagaacgcactttatatgggttttactaatacacattacgaagctggaaaggcagaggatattatccctaggtggtatagtgagggatttcgcgctaatgcgttaatcgtggatcctcctcgcacaggtttagatgataaattgctaaatactatactaaaaatgcctccagaaaaaatggtttacgtttcttgtaatacatccacgcttgctagagacttagtaacattaacaaaagtataccatgtccactacatccaatccgttgacatgtttccacatacagcaaggaccgaggctgtagtgaaactacaacgtaaggaataataaagttttctaatcaaaaaataagagtatttttgggtattcttatttttagatagtaatggtgagatattaatataacatagtctaaaaacacatggtttaagctatttgatacggaaatttaccttagaaatggtaaatagttccattaagtatattcatctttgcaaatttgaccttgccttttaagtttcattgagttaaaatagaaaaaatatttttaacaagatgatagaacatcgtaaattaaggtttaaaggaaatgcttatgataataaattcattcgataatagtagaaaagcgattattaatcctgaagatattaattcaccaataaaaggttttccaaagactgttattacctgtttcgcgcgggagactttcaatcgtattttagaagaattgcctcatcgtgaaattgctagaactagtgtagcaaacttagaaattcccatttatgaattagaatttaaaggacaaaagattggctttttcaatgcttatgttggtgcttcagcttgcgtagcaatcttggaagatattatagtatttggaatggaaagtttaattgtttttggaacatgtggcgtccttgattcgtcaattgaggagacatccattattattccaagaagtgctattagggatgaagggacatcatttcattattcggaagcaagttctgaaattgcagtaaacacaaattcaatttttttactctgcggataatttagatgcagaagtatgggaagcaagatctttaggaaatagcgaggatttagaaaagaaagataaaattgcttatattgccatggagtttgctatagagactttttagggtctactgtatgatgttgaaaggaagatagcaatgtggaatgtaaaaacttttgataatttaactacacatgagttgtttcaaatatataaattaagagtatctgtatttgtggttgaacaagattgtccttatcaagaggttgatgatgaagatttgatttgtttgcatgggatgaattgggtagatggtcaattggcagcttattatagattgataccagaagatgataaggtgcatttgggacgtgtgattgttaatccagactttagaaaaaagggattaggaaatcaattagtggaatatgcgattaaatttagtgaggcaaattaccctaataaacctatttatgctcaggcccaagcttatttacaagatttttatcaatctttcggatttcaacctgtctcagatatctatctagaagataatattcctcatcttgatatggttttattataaatacatgctatttaaactatcaattaaaaggtctctcagtattgctgagagatcttttaattaacaaaaaattaaaaaatttaaattaaaaaataaaaataaaatttatcgctaattattctattgctaataaattaattatgttgtaatatagtatgcatactgatttttggaggaaataggaaaagtggataaacatcactcaaaaaaggctattttaaagttaacacttataacaactagtattttattaatgcatagcaatcaagtgaatgcagaggagcaagaattaaaaaaccaagagcaatcacctgtaattgctaatgttgctcaacagccatcgccatcggtaactactaatactgttgaaaaaacatctgtaacagctgcttctgctagtaatacagcgaaagaaatgggtgatacatctgtaaaaaatgacaaaacagaagatgaattattagaagagttatctaaaaaccttgatacgtctaatttgggggctgatcttgaagaagaatatccctctaaaccagagacaaccaacaataaagaaagcaatgtagtaacaaatgcttcaactgcaatagcacagaaagttccctcagcatatgaagaggtgaagccagaaagcaagtcatcgcttgctgttcttgatacatctaaaataacaaaattacaagccataacccaaagaggaaagggaaatgtagtagctattattgatactggctttgatattaaccatgatatttttcgtttagatagcccaaaagatgataagcacagctttaaaactaagacagaatttgaggaattaaaagcaaaacataatatcacttatgggaaatgggttaacgataagattgtttttgcacataactacgccaacaatacagaaacggtggctgatattgcagcagctatgaaagatggttatggttcagaagcaaagaatatttcgcatggtacacacgttgctggtatttttgtaggtaatagtaaacgtccagcaatcaatggtcttcttttagaaggtgcagcgccaaatgctcaagtcttattaatgcgtattccagataaaattgattcggacaaatttggtgaagcatatgctaaagcaatcacagacgctgttaatctaggagcaaaaacgattaatatgagtattggaaaaacagctgattctttaattgctctcaatgataaagttaaattagcacttaaattagcttctgagaagggcgttgcagttgttgtggctgccggaaatgaaggcgcatttggtatggattatagcaaaccattatcaactaatcctgactacggtacggttaatagtccagctatttctgaagatactttgagtgttgctagctatgaatcacttaaaactatcagtgaggtcgttgaaacaactattgaaggtaagttagttaagttgccgattgtgacttctaaaccttttgacaaaggtaaggcctacgatgtggtttatgccaattatggtgcaaaaaaagactttgaaggtaaggactttaaaggtaagattgcattaattgagcgtggtggtggacttgattttatgactaaaatcactcatgctacaaatgcaggtgttgttggtatcgttatttttaacgatcaagaaaaacgtggaaattttctaattccttaccgtgaattacctgtggggattattagtaaagtagatggcgagcgtataaaaaatacttcaagtcagttaacatttaaccagagttttgaagtagttgatagccaaggtggtaatcgtatgctggaacaatcaagttggggcgtgacagctgaaggagcaatcaagcctgatgtaacagcttctggctttgaaatttattcttcaacctataataatcaataccaaacaatgtctggtacaagtatggcttcaccacatgttgcaggattaatgacaatgcttcaaagtcatttggctgagaaatataaagggatgaatttagattctaaaaaattgctagaattgtctaaaaacatcctcatgagctcagcaacagcattatatagtgaagaggataaggcgttttattcaccacgtcagcaaggtgcaggtgtagttgatgctgaaaaagctatccaagctcaatattatattactggaaacgatggcaaagctaaaattaatctcaaacgaatgggagataaatttgatatcacagttacaattcataaacttgtagaaggtgtcaaagaattgtattatcaagctaatgtagcaacagaacaagtaaataaaggtaaatttgcccttaaaccacaagccttgctagatactaattggcagaaagtaattcttcgtgataaagaaacacaagttcgatttactattgatgctagtcaatttagtcagaaattaaaagaacagatggcaaatggttatttcttagaaggttttgtacgttttaaagaagccaaggatagtaatcaggagttaatgagtattccttttgtaggatttaatggtgattttgcgaacttacaagcacttgaaacaccgatttataagacgctttctaaaggtagtttctactataaaccaaatgatacaactcataaagaccaattggagtacaatgaatcagctccttttgaaagcaacaactatactgccttgttaacacaatcagcgtcttggggctatgttgattatgtcaaaaatggtggggagttagaattagcaccggagagtccaaaaagaattattttaggaacttttgagaataaggttgaggataaaacaattcatcttttggaaagagatgcagcgaataatccatattttgccatttctccaaataaagatggaaatagggacgaaatcactccccaggcaactttcttaagaaatgttaaggatatttctgctcaagttctagatcaaaatggaaatgttatttggcaaagtaaggttttaccatcttatcgtaaaaatttccataataatccaaagcaaagtgatggtcattatcgtatggatgctcttcagtggagtggtttagataaggatggcaaagttgtagcagatggtttttatacttatcgcttacgttacacaccagtagcagaaggagcaaatagtcaggagtcagactttaaagtacaagtaagtactaagtcaccaaatcttccttcacgagctcagtttgatgaaactaatcgaacattaagcttagccatgcctaaggaaagtagttatgttcctacatatcgtttacaattagttttatctcatgttgtaaaagatgaagaatatggggatgagacttcttaccattatttccatatagatcaagaaggtaaagtgacacttcctaaaacggttaagataggagagagtgaggttgcggtagaccctaaggccttgacacttgttgtggaagataaagctggtaatttcgcaacggtaaaattgtctgatctcttgaataaggcagtagtatcagagaaagaaaacgctatagtaatttctaacagtttcaaatattttgataacttgaaaaaagaacctatgtttatttctaaaaaagaaaaagtagtaaacaagaatctagaagaaataatattagttaagccgcaaactacagttactactcaatcattgtctaaagaaataactaaatcaggaaatgagaaagtcctcacttctacaaacaataatagtagcagagtagctaagatcatatcacctaaacataacggggattctgttaaccataccttacctagtacatcagatagagcaacgaatggtctatttgttggtactttggcattgttatctagtttacttctttatttgaaacccaaaaagactaaaaataatagtaaataaaactaagtaaactactcggcaatatgatgaaaagttcagtttaacattatgttaagctggacttttagggtattgactcttatttttgattaattttatattgattaatgacatataatattataatattataattacgattagtatgtgataccgttcactttgtaagctttcataagatgaactagccttaaggagttttgatagcaatgaaaacgataaaagattggcaaataaatatttgcttagcgacctataatggtcaaaaataccttcgccagcaattagatagcataatacaacaaggttatactgactggatttgtttaataagggacgatggatctactgatgatacagtagctattattaaagaatatgttaatagagattcacgttttatatttattaattctaacgatgacagaaagttaggaagtcaccgcagtttttacgagttggttaactataaaaaagcagatttttatgttttctcagaccaggatgatgtttggaaagaaaatcgtttagaacgttaccttgaagaagcagagaaatttaaccaagaactaccattgcttgtttattcgaactggacttctgtagatgaaaaattaacagtattgaaagaacataatccagcaacagttattcaagaacaaattgcctttaaccaaataaatggtatggttatcatgatgaatcatgagttagcaaagctttgggaatatcgtcaaattggcgcccatgattcttatgttggaactctagcttacgccgttggaaatgtggcttatatttctgacagtacagtcctttggcgtagacaagtaggggcagagtcgctaaacaattacgggagacaatatggggtggctacgttttggcagatgataaatacttcttttgatcgtgcttcgcttatttttgctcaagtatccgataaaatgtccctggagcgtaaactcttctttagtcgttttatagaattaaaaaatgccaatctaatgagaaggatttatcttttatcaaaattaaaactccgtcggaaatcattgaaagaaacagttgctatgactatcctacttttaacaggttacggtaaaccaaaagcataatttttttggttgaaggaaatcaagttgagttgtagttaaaaatatagaaaatatttatttttcaaaaagttgttgacacttaacgaaattagtatataataatattaaagaacaaggtagaaccttggctcgcattaatttcgggttttggaaaaggagtagcaatcgctactccttttttgttttacacaggaaaagtatgaaggtaaagcctttttttataaaaattaggcttgcttaattttttaatttttatattctttacattatgatgaaaacacaagatatagtggtgatatatgttgaaagacacaaaactttgtgttagtatactgtttaagcagatccttaataaaggtaaccgacaaaaaagtttaacgtaacttaacaaaacagtggttttgaagcaagagttagcttcttaccagaataaaaaaacatcaagaagaacattccaatagttgtgtgattttaacaaaaatccagtcctcttgggaggcttttttggtgcttaaaactcgcttaattttaatatttaggagactagtttaatgcaatcatactatgatcgttctcaatcgccacttgactatgccttgtcagaaaaagcttttcctatgcgttctgttaattggaataagctaaacgatgacaaagacttagaggtatggaacagagtaactcaaaatttctggttacctgaaaagatcccagtttctaatgaccttaattcttggagaacattggatgctgattggcagcaattaattactcggacttttactggtctaaccttattagattctgtgcaggctactgttggtgatattgctcagattaagcattctcagacagatcatgaacaagttatttatgctaactttgcctttatggtagctattcatgcgcgatcttatggaacgattttttcaaccttatgcactagccaacaaattgaggaagcacatgaatgggtagtggatactgaaagtctacaagctcgatcacgtatacttattcctttttatactggtgacgatcctttgaaatctaaggttgctgcagccatgatgccaggatttttgttatatggtggcttttaccttcctttttacctttcagccagaggaaaattaccaaatacgtctgatattattcgtttaattttacgagataaggtaattcataactattacagtggctataagtatcaacagaaagttgctaaattatctgtagaaaagcaagccgaaatgaagacatttgtctttgacctcctctatcagttgattgatttagaaaaagcctatctttacgaactatatgatggttttgatttggctgaagatgcaatcagatttagcatttacaatgctggtaaatttttacaaaatttaggatatgattctccatttacagaagaagagactcgtatatctcctgaggtttttgcacaactttcggcgcgtgcagatgaaaatcatgatttcttctcaggaaacggctcttcatatattatggggattacagaagaaacattggatgaagattgggagttttaaatggatagtacagtgaaggtggtctatttttcatcgaaatctaacaatacccatcgttttgttcaaaagttggcttgttctaaccagcgtattccatcagatggtagtagtatattggttactgaggattatattttgattgtgcctacttacgctggaggaggagatgataccaaaggcgcagttccaaaacaagttgtacagtttttaaatgttcgacaaaatcgggaacattgccaaggggttatttcttctggaaataccaattttggtgacacttatgccattgctggacctattattgctcgaaaattaaatgttcctttgcttcatcaatttgaattactgggaacacaagaagatgttacaagggtaaaggagttactttgccaattcactagaaaggataaataagatgacacaatcagatgcatatctctcgttgaacgcgaagacacgctttagagatcgcacaggtaattatcattttacttcggataaagaggctgttgaacaatatatgatagaacatgttgaacctaatacgatggtgttcacatcactaattgaaaagctagattatttggtttctaataactactatgaatcggaccttctaaaacaatataaccttgagtttatttgccaaatttttgagcatgcatacgctaagaaatttgcttttctaaattttatgggggctttaaaattttataatgcttatgctcttaaaacagaagacaatcgttattatttggaacactatgaagatcgtgttgtaatgaatgctctgtttttagctgctggtgatgaaaaagctgcctatgacctagtagatgacatgctagcaaatcgctttcaaccagcaacacctacctttttaaatgcagggaaaaaacgtcgtggtgaatatatctcttgctatttgttgcgcattgaagacaatatggaatctatttctcgtgctattagtacaagccttcagttatcaaaacgaggtggtggggtagcactttgcttaaccaacttacgggaatttggtgctccaataaaaggtattaaaaatcaagctactggtattgtacctgtcatgaaattactagaagattcgttttcttacgccaatcaattaggacaaagacaaggagctggtgcagtttacttacacgctcaccatcctgaagtattaacgtttttagatactaaacgtgagaatgccgatgagaaaattcgaattaaatctctttccctaggacttgttattcctgatattacttttgaattggctaaggcaaataaagatatggccttgttttcaccgtatgacattgagcgagtatatggtaaaccaatgtctgatatctctatcacagaagaatatgaaactttattagccaatgcggatattcgtaaaacctttattagtgcacgaaaactatttcaaacgatagcagagcttcattttgaatctggttatccttatatcttatttgaagatactgtaaatgctaaaaaccctcacaaaaaagagggacgaattgttatgtctaatttatgttctgagattgcacaagttaatacagctagtcaattttcagaagacctgactttcactaaggttggacatgatgtttgttgtaatttaggttctattaatattgcgcgtgctatggatcaagcggcggattttgaaaaattaattgctaatagcattagagcccttgatcgtgtatctcgaacttctgatttagatagtgctccatctattaaaaaaggtaatgcagctaatcatgctgttggtttaggtgctatgaatttgcatggatttttggcgactaaccatatttattacgattctcaagaggctattgattttacagattgcttcttttacgctatggcttattatgcctttaaagcttctaaccatttagcaaaagaaaaaggaacctttgagggcttctcggaatcaagttatgctgatggcagttatttctatcaatataccgaacaaaactttgagccaaaaacacagcgtgttaaaaatctactagctgagtatggtctgactctaccaagccaagaggattggagaaagcttgtgcaaagtattaaagagataggattagctaatgcgcatttattagctgttgctccgacagggtcaatcagttatctttcttcttgtactccgagccttcaaccggttgtatcacctgtcgaagtacgcaaggaaggagcactggggagggtttatgtacctgcttataagattgatgcagataattatgtctactacaaaaaaggagcttatgaagtgggatctgaggcgattatcaatattgcagctgccgctcaaaaacacattgatcaagctatttcgttaacgcttttcatgacagatcaagcaactacgcgagatttaaataaagcctatattcaagcatttaaacaaaaatgtgcctctatttattatgtacgagtgagacaggacatcctagaaggtagcgagagttatgatgatatgctggatgatttcacttcatcggacttagaagactgtcaatcctgcatgatttaactaaatatactcaatcagaagattaagagaaatatattggcttttagaaaggctttattgtaatgacaaaaaaacatcttaaaacgcttgccttggcacttactacagtatcagtagtgacatacagccaggaggtatatggattagaaagagaggaatcggtcaaacaagaacaaacccagtcagcttcagaagatgattggttcgaagaagataatgagaggaaaacaaatgtttctaaagagaattctactgttgatgaaacagttagtgatttattttctgatggaaatagtaataactctagttctaaaaccgagtcagtggtaagtgaccctaaacaagtccccaaagcaaaaccagaggttacacaagaagcaagcaattctagtaatgatgctagcaaagtagaagtaccaaaacaggatacagcttcaaaaaaggaaactctagaaacatcaacttgggaggcaaaagatttcgtaactagaggggatactttagtaggtttttcaaaatctggaattaataagttatctcaaacatcacacttggttttaccaagtcatgcagcagatggaactcaattgacacaagtagctagctttgcttttactccagataaaaagacggccattgcagaatatacaagtaggctaggagaaaatgggaaaccgagtcgtttagatattgatcagaaggaaattattgatgagggagaaatatttaatgcttaccagttgactaagcttactattccaaatggttataagtctattggtcaagatgcttttgtggacaataagaatattgctgaggttaaccttcctgagagtctcgagactatttcagactatgcttttgctcacatgtctttaaaacaagtaaagttaccagataacctaaaggtcattggagaattagctttttttgataatcagattggtggtaagctttacttgccacgtcacttgataaaattagcagaacgcgctttcaaatctaatcgtattcaaacagttgaatttttgggaagtaagcttaaggttataggagaagcaagttttcaagataataatctgaggaatgttatgcttccggatggacttgaaaaaatagaatcagaagcttttacaggaaatccaggagatgaacattacaacaatcaggttgtattgcgcacaaggacaggccaaaatccacatcaacttgcgactgagaatacttacgtcaatccggacaaatcattgtggcgtgcaacacctgatatggattataccaaatggttagaggaagattttacctatcaaaaaaatagtgttacaggtttttcaaataaaggcttacaaaaggtaagacgtaataaaaacttagaaattccaaaacaacacaatggtattactattactgaaattggtgataacgcttttcgcaatgttgattttcaaagtaaaactttacgtaaatatgatttggaagaaataaagctcccctcaactattcggaaaataggtgcttttgcttttcaatctaataacttgaaatcctttgaagcaagtgaagatttagaagagattaaagagggagcctttatgaataatcgtattggaactctagacttgaaagacaaacttatcaaaataggtgatgctgctttccatattaatcatatttatgccattgttcttccagaatctgtacaagaaataggacgttcagcttttcgacaaaatggtgcgcttcaccttatgtttatcggaaataaggttaaaacaattggtgaaatggcttttttatccaataaactggaaagtgtaaatctctctgagcaaaaacaattaaagacaattgaggtccaagctttttcggataatgcccttagtgaagtagtcttaccgccaaatttacagactattcgtgaagaggctttcaaaaggaatcatttgaaagaagtgaagggttcatctacattatctcagattacttttaatgcttttgatcaaaatgatggggacaaacgctttggtaagaaagtggttgttaggacacataataattctcatatgttagcagatggtgagcgttttatcattgatccagataagctatcttctacaatggtagaccttgaaaaggttttaaaaataatcgaaggtttagattactctacattacgtcagactactcaaactcagtttagagaaatgactactgcaggtaaagcgttgttatcaaaatctaacctccgacaaggagaaaaacaaaaattccttcaagaagcacaatttttccttggtcgcgttgatttggataaagccatagctaaagctgagaaggctttagtgaccaagaaggcaacaaagaatggtcatttgcttgagaggagtattaacaaagcggtattagcttataataatagtgctattaaaaaagctaatgttaagcgcttggaaaaagagttagacttgctgacggatttagtcgagggaaaaggaccattagcgcaagctacaatggtacaaggagtttatttattaaagacgcctttaccattgccagaatattatatcggattgaacgtttattttgacaagtctggaaaattgatttatgcacttgatatgagtgatactattggcgagggacaaaaagatgcatatggtaatcctatattaaatgttgacgaggataatgaaggttatcataccttggcagttgccactttagctgattatgaaggtctttatattaaagatattttaaatagttcccttgataagattaaagcaatacgccagattcctttggcaaaatatcatagattaggaattttccaagctattcgaaatgcagcggcagaagcagaccgattgcttcctaagacacctaaggggtacctaaatgaagtcccaaattatcgtaaaaaacaagtggagaaaaatttaaaaccagttgattataaaacgccgatttttaataaggctttacctaatgaaaaggtagacggtgatagagcggctaaaggtcataatataaatgcggagactaataattctgtagctgtaacaccaataaggtccgagcagcaattacataagtcacagtctgatgtaaatttacctcaaacaagttctaaaaataattttatatacgagattctaggatacgttagtttatgtttgcttttcctagtaactgctgggaaaaaaggaaaacgagcaagaaaataaggagaaattaatatgattacacaagaaatgaaagagattattaatagtcagttagcaatggtcgcgacggttgatgctaaaggtcaacccaatattggcccaaaacgttctatgcgtctctgggatgataaaacgtttatttataatgaaaatacagatggtcaaactcgtattaacattgaagataatgggaaaattgaaattgcctttgttgatcgtgaacgtcttttaggttacaggtttgtgggaactgctgaaattcaaacagaaggtacttattacgaagcagcgaaaaaatgggcagaaggacgcatgggggttccgaaagcagttggtattattcatgtcgagcgtatttttaatttacaatctggtgctaatgcaggtaaagaaatcacttaatataaaaaagcctcaagaaggggcttttttatattaagcaatactagattaagtttgttttcgagttattagtaatatctgcgatagcaagccaaatttccatttgataatcagtatcttgtggatgttgagatgaataaatttctaagtttggcgagttagctggttttagattattctcttgaaaaaatccttgtattatttttcgccatgtttcttgaagactcgatggcattggacctttaacagaaatgactgcataggtagcgcttgggatcctaataatttctaacccttttggggcttggacacttgtctctacttgataagtggcactgtaatcgaaacgaaaatcaggttgtgttttacaaatgccaatggcttgctggataccttcttgatttgactttacattttctaaagttactccagcaagtatcattgctggcttttcaacaatttgaaatgatagcataaaaatctttattctttatgattccttaagtaattatagagtcgttaaaatagtttctttttagaataattgtcttgttagcaatcataattttcttttggaatgatatggttcaaagaagaaatcttatgatatagagtattctctaagaggcacttattttatagcttttttctaaaaaaaatctattgactatttttgtttatttctctaaagatgatggattaatctttattctttaataacgccatggtgtctcataagggtaccaacgatttgctgaatgagatgctaatctagaaaatggataaacttctttaccctcttttttcaacatatcttctagataatctctcagcatacaaacatctccaggataagtaacatcaagacttaaaagagattcaacttcactgatattaagttgcaagtctttagcaacttgtttaataggataatttaaccttctaaaattttcttgtaattcaaaggttgtatctttcatttcttgaatagtaagcatatcattctcctaatagttggtttaataattggttgatctttctttttggcttttgggaaagtatctctcttgctatgtctgttattttatatccaaatttccttagctttattaaaggctgaccaagcttttggccatccaacataaaaagcgaggtgagtgataatgtcagcaatttcttctttagtaactccgttttgtttggcaaattgaagatgatgctctaactgttcaagatttcctccgctaattaaggcagatatagtaataatagaacgtgttttatctgttaaatgatcctcttttgcccaaacctcaccaaataaaatatcatcattatatctggcaaattcaggtgcaaattcttctaattgacgacgtccggctgtttgtttttctttcataatggattcctccttacttgaatttaacctagtcttgaatattcttcatcactaacagcttcataaaactcactcttaccagctgtaatcgcaatatgtgcaaattcagaatcttttttagcaccatgccaatgtctaacacctttatctgtaacgataacgtcgcctggttttaatgacactgcttcttttccttcttcttggtaccaacctgaaccttctgtaacgagaaggatttgataaccgtccaaatgaacatgccaattattacgacagcctgcttcaaaggttacatttccaactgaaacattcccatctggagattttgctaatgctgcgagataggattgcccaataaagaattcaccatatggatttttttcacccttaggaaagatagacttagttgtttcttgcataagatttcctcatttcgttgttggatcaaaaagttcttgttctctaggaacaactttattttgataattgtctattttgtgatttagacgattaagtgcttcttggaggccttgaagcctatcttcaagattgtcgcgttcatcttttaaaatttctagcctagctgggatagtggaatcgcctttttcaaccaaatgaatataatcaatgagactttcaacggaaacacctgcgcctctaaaatagcggacaaattctaaaatatcaatatcgttttgtgtgaactcacgaattcctgattcactccgatgaatagggggaataagattaattctctcataatacctgatggtatctgacgtaatgccagtctttttactaacttctttgatatgcatttttaacctcgatattcagtcaacaatcactaaggatttgatagcgtcacgtttatccattgcttcataagccttttgaatatcatctaatacaaaggattttgtaaaaactaagcctgggttaattttatgagttagaacagcatctaaaaggacagacttatcaaatgttgttacagaagcaatgccacctctaaggccgatatttttccagaataaattattggtattcatgtctggattttgtgggataccaacacgtcctatgacagcaccaggcctagcaatttgggtagctgtatcaacagactgctctgtaccaacacattctaaaacagcatcggcacctgcttgattggttaaatctaaaacacgtttaacggcttcgtcaccccgttcttcgacaatatccgttgcaccaaaagtcaatgctagttcctgcctatctttgtgacgactcattgcaatgatacggttagcacctaacattttagcagcgataacaccacagagtccaacagcaccatctcccatgacaactaccgtgtcaccttctttaacttctgcagttgctgcagcatgataaccagttgccattacatctgataaggtgagcagagagttaagagtctcattatcataatcagaaggttgtcctgggatcttaaccaatgcccagtttgcattagtataacgtagatattgaccttggtatcctacattttttgcagcttgatgatttgtacaatttccatcaaatccagccttacaagacggacattggccacagccatgtgtaaagggaacaataacaaaatcaccttttgacacgtcagttactttagtaccaacttcctcaacgataccaatagcctcatgacctgcaaaagaaccactttcacgttttgaaataccacgataccaccacaagtctgaaccacaaacacaggctctaacaattttgataacagcatctgtctcttgttcaatgactggttttggtgtatcagttataaccattttgccaggttcaataaatgtagctactttcataaccttacctcttttctataacttcattataactcttagagttaacttcaagtcaagaaaaacttaaaaattttgaaaattaaacatctgtaaaaatccgcatatggtttcattttccactaaaaacagggaagttagaaaattccccataatcgtcaaacataagtgattttaatatcgacatatcttcgtcactaattacaaagtcaaagtctagattagactgtaaatgttctttactagaagcctttggtaaaacgatcaggtttaattgtagtaaatattgaatacataattgagcaacactaaccccatatttttcagccattttttgaataccatcagatttcaatgcttgtccatgtgcaattggtgaataggcttcaacttgaatacctttactttgacagtaatcaatcaagtcgaaaggtgtatttccgatgtgagctaagatttgattgacagcaggtttaacatgaccattttttaagatattttctaagtctttttctaaaaagtttgagacaccgatggatttcatcttaccagatttttgagcatcctctaaagctctccaagcttctaaatttccttggtcaaaatgtttatctgtttcacgccattccttccaaggctgtggactatgaataatcattaaatcaatataatcaagccctaaagcttctagtgattgatcaattgattttgtagcactttcataatctttatgttcagcggcaattttagtcgtaacaaataaagattcacgtgtaataccagactctttaatccctacaccgacacctttttcattgttgtatgcttgtgcagtatcaatatggcggtagcctaattcgatagcatctttaacaacttgagctaccctatcattatctatcatccacgtacctaaacctaaagttggtattttatgattgtcatttaatatcattgtatctgtcatctttattttccttctttcattagtattgacctaatcttaacacttagagttaactccaagtcaaggaaaaaactaacactcaggttagttttttaatggtttgcaatgattttgatgttctcttaaagaataatcgatttcaacagtaacatcgtttatcttataatgttggcaaatcgttcgaatagctcttttacaatctttttcagatatcaattgatttaagcaacagtgaatgattgctcgattatcaataccatccattgaccagatattgagttgattgatagatcttacttgcgaaagtcccttaagttcatcatgtaatgcagcgtaatctatggaatctggaacaccatctaaaaaaagtttcagggttgatagtaatttaggaagtgctttagataagatgaaagtagatatggcaactgataataatggatcaaggatatacaacggtttccaatttaagataagagatataacaataatagctaaccaccctagaatatcttccaaaaaatgaaggcttaatatttcctcatgtttactttgaccagaatggagaataaaactagctagaccattaatgataatagcgatgacagctagaataaacatgccgtgataattaacaggagtaggatgccacaattttgggatattttctatcatgactaagatagatccacttataagaattagacttgtgataagagctcctaaaaggctaaaacgtttataacctaatgaaaatatcgtatcttcatctttcttagattttttttctaaagtagctgagatgccaatagctattgcatcaccaaaatcatgaacagcatcggctaagatagctcctgagaagaatagacttccaaagatgaattcaaggacggaaaagctgatatttaatataaaagcgatagccacttttttgtttgatgtcatatttttctccttttgttatactggtattgtagtgtgattctttcttctattatctaggagataaaagagaattgctagaaacaaaaaagaacacttgttcaatactgaacaaaacttagaaagtgtcctatatggtaaaagatagacaaattcagaaaacaaaagtagcgatttataatgcttttataagcttgctacaggaaaatgattattctaaaataacggttcaagatgtaatcggacttgcaaatgtaggaagatcaactttttactctcactatgaaagcaaagaagtgttactcaaggagctctgtgaagacctttttcaccacttatttaagcagggtagagatgttacgtttgaagagtatttagttcatatcttaaaacattttgaacaaaatcaagatagtatcgctacgttattattatctgacgatccctattttttattacgctttagaagtgaattagaacacgatgtttaccctagattgcgtgaggagtatattacaaaggtggacattcctgaagatttcttaaaacaatttcttttatccagttttatcgagaccttaaagtggtggcttcatcaaagacagaaaatgactgttgaagatttactaaaatattatttaactatggtagagaggtaaattatagagagttgggagattctcttatttcattagcgttatcagaggtgatgaatggattgattgtctaatatagcgagttgaaattattagattaaatgagtataattcgggagataaaaaagtccccttgatgaaagagtttctttgggattgttgatgtcaccataagcaaaatgaatatttttcgattactatattgtcttaggcttttgcttatattctagtgggctaattcccactatttttttaaatgtccttgaaaaattagaagaagtggaaaatccaagtaaattggaaacttcttctactttcttattttcatctagtaattgcttagcagcttcgatttttaagtttagaaaatattgttgaatagtgatgtgtttttcttgcttaaatagttttcgtaacttcgattcactcatgtgacattctttagctatttcttctgttttaataaagcgatttagattattttcaagatatcgaatcactgcgacaatagtttgagaatgaggggtttcgagatgtttttttaaagaatgaacttgttgagtatagaataagatagcagtatcacgtaattttaaaacttcatttagacttatagttgactcgttttcttttataaaacgatctcgtgctcgataagctgtttcgatatcaagtcctgcttggatggtagcctgtgagagacgatcataaatcatgatggagtagtttttttcagatcgcaattcatctccactgattataggtacgatagaattgctaaattgttccactgtttctttcaaaagaaattcactacctgatttaacagcttttagaatattattttcaaaatgatactgatatttgtaagaactcatattctgtttagaaaattgcttaattttatctagatcaaaggagttgctccaccctttcgtgtagtaatgtaagggctctgataatttatctttcacaaccccagttagacaataattggttactattagtaattctcggatttgactaagtgagaagaaaggtaattgggatagtctatcaataaagtagtcttgttcactagcattgatttgtgtttcagtcagctttttcttaagaagtaaagggtcaataacattgctacgccagggaccgatgataatataatattgttgaatatggtggacaagaaaaagttctcctaaagagccataatgaaataaaaaatcatgttgagttttactaaagttacttaaaataaggtaatgattgtaaaaaagtgaaatagttttctcggatttatactctctgataacagaaaaattttgatcacaaacagtaatagttagacctagaagactgtgtaatgatttcaacagtagaaaatcaatcatatgagttaccacctttgatttaatatgttatctattttagagaatatttctttaaagtcaacagaataattaggtagtcgatacctttttaaccaaatatgaattaaaaaaccgaaaaagtcaaatcagaaaaaaaaaaaaaaacagattagatcggataaaaaagtatagatattctaatatttgtttttaaagcctatactttactatgtatagagctatacagaataaagtaaaggagaatattatgtttagaaggtctaaaaataacagttatgatactttacagacgaaacaacggttttcaattaagaagtttaagtttggtgcagcttctgtactaattggtattagttttttaggaggttttactcaagggcaatttaatatttctacagatactgtgtttgcagctgaagtaatttcaggaagtgctgttacgttaaacacaaatatgactaaaaatgttcagaatggtagagcatatatagatttatatgatgtgaaaaatgggaaaatagatccattacaattaattacgttaaattcacctgatttaaaagctcagtatgtcattaggcaaggcggcaattatttcacacaaccttctgaattgactactgttggtgcagctagtattaattatacagtattgaagacagatggaagtcctcatacgaagcctgatggacaagtggatattgtaaacgtttcattgactatttacaattcttcagctttgagagataaaatagatgaagttaaaaagaaagcggaagaccctaaatgggacgagggaagtcgcgataaagttttgataagtttagatgatatcaaaacagatattgataataatcctaagacgcaatcagacattgccaataaaataactgaagttactaatttagaaaaaatactagtacctcgaatcccagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatggtaaaggaaataaactaccagcaacaggtgagaatgcaactccattctttaatgttgtagctttgacaattatgtcatcagttggtttattatctgtttctaagaaaaaagaggattaatcttttgacctaaaatgtcactaaacttttcaccatttattggtgtgaacacattaataaagttatgtatctctcttcaacaaacttaattaaagtgtttcaatttttcgagtttaattcttgaaaaatcctatcgagattattaatttcgataggattttgattttgtgtaagcgtccaataacgaggtatcttccattttcttccctattccgtaagcatccaatataccttgttattggacgcttactataaaactgaagaaatgatcctatttagttgaaatttgtaaatgaagtgtatcattagagcctaagatgttaatcctaggctctcttttgatgatttaaaatttttaggtgtaatcaaatgtaaggttagatgcaaaattttctaaaatgactgtttgtcttttcaagtaattaaatgtatttaagggtaatttataaaaataaaaggagtgtgtcaataatgttgtgtaaacacactggcaaagctgggattgttaatcaaataggctttcaagtgtgtctgtacattggccaaaacctttgtggattcgttgttcttgcttgaagttgtaatcattaaatagtgtgactagatagtattctagagcctcttcattgggaaagacgatttccttttttgtttgcgttgtattgcatttagtgatacaatagttatacaaaaatgatttgaggtgatattatgtcaacagtagcagtaagagttgatgatcaattaaaagatgatgctacagaactttttcaatccttagggttggatatgagcacagcagtaaaaatgtttttgattcaatctgttaaaactcaaagtattccttttgaaataaaaaataaatcatctgtttctgatgaagaatttcaaaatttggtagaaacaaaattaaagggaatacgagttaaggctagtgatccagaaagtgtaaatgcgttttttggagatgaagatttttcagaatatgaggaatattttaaatgagtgatattgaggtatattctgtattagtttctcgtattgaatattctgatggtacaggttcaaaggttcgtcctgctgtagtagtcaaatttaatgatgaagtaataaaaactttaagatttactactaaatatgaaaataagtctgacaatataagaagtcagtatttagaagttattgattaggcaaaagcaaatttaaataggcgttcttggatagatactattcaatattatgatgttgagaataaagggttcaatattaaaattataggtaagttaagcgatagagatgttgagaggttaaaagattttctcatagcaaaggaagtttagttatgaaaaagaaattattaggattgatgattttagctatatctacagtatttttagttgcttgttcgactaattcgttaaatgtaaagtattataaagtatatgatggtgaaaaaatgttagttttagaaattaatgatgaatcaggaatttatcataatgaaggaaactttgtagtaactaatattgatactaaaagtaaaagttttgtacttaaaggtgggtctgctaagtatactgttttatatgatgttaaaagtgatggtaaattgaatgttgatttagggaacttttattataatgcttctggtaaggagacatattataaagaaggtagcaaggctttagaaaaagcattaagagataaagaataaagttaggactattttcctaacttatttttttatttaaaaaatgaacttcaaaatgcaaagtcttaattttacttagcacctaatttttagttaaataatttgtatcccagcaataaaaagtatttttaccgaaatcaaagtaagaaccaaaaagaagatggggttactctgtcttagtttttcttggaaagtgttatctgttaattcaatgaaatcaagcgaggaaatgagatagcttttatttaattgatgagttgctttttccagattatttggagttatttgctcgtattcagaaataatattatgttatgatatcataaagagctaaattcatggtttgatttttatttctttgaaagttactaacgatcgtacttatttctttattgttcaaattggaataatctttaagtagatggaaaagtcgtatttctaaacattcctttgaaatttctaaatcaatggttatttctttgaatagtttattttcgtaaacaattttatagagtaacttgggatgatattgattttgaaagaaatagtatttatacatatcgaagatattcttcaataaaaaatgactttacaaagcctaaaacaaggacttcaataaggagagtttcagtaagtcatgatttaaaagagttattgcttgaactaaaatttcaacaagaaagaatgctgaaaggtttgcatataaaaaatacagatcaattgattttttatgactataggtttggtatgatatcaaatgatgctgttaacaaattcttggcaagctcattggaaaaattagaaatagaatctaagatgtcatcaacaggtgctagacatacttatggaagttatttgttggctaacggagtagatatttgggcggttgcaaaattaatggggcataaagatatcaaacaattaatagaaacatatggtcatttgcttctgtaagtggaagaaaaggaaaatgatcagcttttaaaaattcttaataataaaggtagtttttaaaatgactatcaagaacaaattaagaacaaaaataaaagaaaccctattataataaggtttcactcatatattttctgccaccaccgagaattgaactcggaattgagcattaccattgctctattataccatttaactatagcggctacttttctatgatactataagattttgacgaaatcaagtatttctttacttagaaaaatagtcgtttttttagtctaattctatttggagaaatttactattttcaatagctcttaaatggtgtgtttcttgtggagagaggctaataaggctatctttttcaaggatatgtttctgatcaccaaggataatttcaagttttctttccaaaacatttattaattttggatgagggcatcgttcatttttcagtccccggctgatgattttaatggtattgaataaaccttcatctttaatcattcctaacggggacataagacttatttttccaaattgatattctgaactttaaaaaccattttgtaagaataaattttgccaatcatctatttttagaggagcaacgttaacattcatagtatgtctaagttgatcgatcagcttggcagtgtcttcatcttgataagaaacatcatgtgtgagtaaacgtccaccaggttttaggacacgtaagtactcttttatggctttctccttagctgaattgttaagcatcgttaacattgcttcgttgataacgataaactattatcaggaaagggcagtctgagtgcatttccctgaataacttcaataaattcttctaattgggcctttttgacattttctttggccttttctattactttactatctagatcaagcgctgtaatgtgacaggaaaatgctttagcgatatcgatggaactggtacattgattacaagctacttctagaacacgactgtcagcactaaagtgtccttttttgataagccaattcgttgcttggacacctcctggtcttaagcgttttttcctagtcgtgctaagaattgatgtccaatttctttatgtggcaataagatcacctctttcttttaatagtaatatcattttttcttaattataacacatagatgctaagataacaaggagtaatagtgattgaatggtataagtgatgaattttagagagcgttttcttttaactaggggtgtgatgccaaaactagaatggcatagagaaccatacatctcaaaaggtcttccttagataaaactagttgtttttatatctgtcagaaaaatcataatttatttttgatataatgattttttgagtatttaatttatatgttataatgaaaaaaactaaaaaagaggaatatcatgtcatacgaacaagaatttttaaaagactttgaagagtggttacaatcgcaaataagtatcaaccaaatggcaatggacagtgcaaagaaagttttagaggaagataaggatgagcgagcagcagatgcgtatattcgttatgagagtaagttagacgcttatcgctttttgcaagggaaatttaataactatcataaccaaaaatctttccatgatttgcctgatggtctttttggacaacgtcattattaaaaggtttatcgctagaaagcttgtcaaataggcatttctatgatacattgttatagtagtttttagatactatgatagatttcataaatgaggagaaagcattatacaatggcaaagcgtattaaaccgaataaaaaaagagagcttttgaaagctaaagggatcaattggaaggatgttcgactatctcaaactttacaagaagtcgcattaccgaaaaagacggctcctgaagcgccaaaggcagtcgatcttttagaaggtttaactgctaataaacaagatgttttaaaagaagctggccttgtcagccttgaagcatttgcgaaagtaagtgaagcagatgttttagcactaaaaggtattggtccagcagctattaaacagttagttgataatggtgttgtttttgcaaaataatttgatttaccttgcgaaagtagccttattttgctagaataaattaacttagaggtgttttgaaatcccatttgtcacaggaagcggtcatactgagaaatccgcacaaatgtcaaagcttgttgctaagtccaataattgaaacaaaacgagttgcggatgttatcatccgaatttgggtggtaccgcggaaatcgtaacacgaaattcgtccctgtcagaattgacagggattttttgtatttaggagtgaggagattgaagtatatgcagattctagaagatttcgatggcaaagcattaccaaaactagaaacggatcggcttatcttgcgtcagcgaacggtgggggatgtcccagccatgtttgattacgtttgcttggaagaggttgcctatccagcaggactcagcccaatagcttctttagaagatgagtacgattattttgaaaatcgctactatcaaaatctggaaaaggcaaaattaccatctggttatggtattaccgttaaaggaagtgatcgtattatcggatcctgcgcctttaaccatcgccatgaagacgatgttttcgagatttgctatctgcttcatcctgactactggggtcatggctatatgacagaagctgtcgccgctttgattgaagtcggttttacccttctcaatctccacaaaatcgaaatccgctgctatgattacaataagcaaagccggcgcgtggcagaaaaactaggattcacccttgaagctaccattcgtgatcgtaaggataatcaagacaatcgctgtgtcaatttgatatatggtttgctgaggagtgagtgggagtaattattctactcttcatagaagttactagatcgactaatttggctgtgcagggcacttaactaagtcatcaataatatcgtagatatggaggagacaaatgattaagatacttggagaaatcgtagataaccagctacctgttgtggaaacgaatcgtctgttgttgcgtcaacgcaagttagaagatgctaaggagatatttgaatttgtcaaacttgatgaggtgagttatccagcaggttttccggctgttaaaagcttggaagaagagataacctatattcaagagatttatccaactaatcttgaaaaagaaaagttaccctctggttatgctattactctaaaaggcgatgataaggtaattggttcagtagattttaaccatcgccacgaagatgacatttttgaaattggctacctgctccaccctgattattggggacaaggcattgtgccagaagcagcttcagcccttgtggagataggtttcacactgctaggactacataagattgagctgggatgctatgactataataagcaaagtcaggcggttgcgcgcaaattaggttttactttagaggctaatattcgtgatcgaagagatgcccaggggaaacgttgtggcgatatgcgctttggtttactgcgaagcgagtgggagaaaaaaagaagatgaatattattatcatcggagcacaagcttctgggaaaatgacaattggtcaggaaatcgcaaaacagacaggcatgaccttattccataaccatgattctatagattttgttttacgcttcatgccatggtctccagatagtattgctctaacggagtctattcgctttaaattttttgaaacgtttgctaagactggtcaagaaatgatttttactattgtaattgatttcaatgattcaagagatgtagtatttctagaaaagattcaaatagtttttcaatctcacaaccaagaggtattatttgtagaattagaaacagagctaagtgagcgtctcaaacgaaatcgcacagaaaatcgcctcaagcataagccttcaaaacgtgatatcaaatggtcagagagcgatatttgttcaaccatggattacgctatctttaatcctgaagtagccccagaagcgcttacatattatcataaaatcaataatacttgcttaactgctactgaaacagcatatcttattattcaaaaaataaaccaaatcaaggagaaaaactaatgtcaaaagaactatcaccaaaatacaatcctgccgaggttgaggaaggccgttatcaaacttggcttgaccaagatgttttcaagccatcaggggatactgaggctaagccttattctatcgtaattccaccaccaaacgttacgggtaaattgcacttgggtcacgcttgggatacaactctacaagatatcattattcgtcaaaagcgtatgcagggctttgatacactctggcttccaggtatggaccacgctggtatagccactcaagctaaggttgaggagcgccttcgtgagcaaggcatttcacgttatgatcttggtcgtgaaaaattcctagataaagtttgggaatggaaagacgagtatgcagcaactattaaatctcagtggggaaaaatgggtctttcggttgattatagccgtgagcgttttacccttgatgagggactttcaaaagcggtaagaaaagtctttgttgatttgtacaataaaggttggatctatcgtggggagttcatcattaactgggatccagcagctcgcacagccctttcagatattgaagttattcacaaggatgttgagggtgctttctatcatatgaattatatgctggaagatggctcacgcgccctagaagtagcaacaactcgtcctgagactatgtttggagatgtggctgtagcggtaaatccagaagatgcacgttacaaggatttgattggtcaaaatgttatccttcctatcatcaataaacctattccaatcgtcgctgatgaacacgctgatccagaatttggaacaggtgtggttaagattacgccggctcacgaccctaatgactttgctgtaggtcaacgccacaacttaccacaagttaacgttatgaacgatgatggtactatgaatgaacttgcggatgaatttaatggtatggatcgtttcgaagctcgtaaggcagtagtcgctaaattagaatcgttaggaaacttagtaaaaattaaaaaaacgactcattctgttggtcattcagaacgaacaggcgttgtggttgaaccacgtttatctactcaatggttcgtcaagatggatcaattggctaagaatgccattgccaaccaagatacagaagacaaggtagagttttatccaccacgatttaacgatacttttatgagctggatggaaaatgtccatgactgggttatctctcgtcaattatggtggggacaccaaattcctgcatggtacaacgtcaatggtgagatgtatgttggagaagatgccccagagggtgacggatggacacaggatgaagacgttctagacacatggtttagttctgctttatggccgttttcaacaatgggatggccagacaccgaagcagctgacttcaaacgctacttcccaacgtcaaccttggtaactggatacgatatcatcttcttctgggtatcgcgcatgattttccaatcccttgaatttacaggacgccaaccattctcaaatgttcttattcatggactcatccgtgatgaagaaggacgtaaaatgtctaaatcactcggcaacgggattgatccgatggatgtcattgagaaatatggtgcggatgcccttcgttggttcctctcaaatggttcagcccctggtcaagatgtgcgtttttcatacgaaaaaatggatgcttcgtggaatttcattaataagatttggaacatttcacgctatatccttatgaataacgaaggtttaacgttggatcaagccagagaaaatgtggaaaaagttgttaatagtcaagttggaaatgtaacagaccgttggattctccacaatttaaatgagactgtgggtaaagttactgaaaactttgacaagtttgaatttggtgttgctggtcacatcctttacaactttatctgggaagaatttgctaattggtacgttgagttaacaaaagaggttctttatagtgacaatgaagacgagaaagtcatcactcgctctgttcttctttataccttagatcaaatcttgcgtcttcttcatccaatcatgccatttgtgacagaagaaatttttggacaatatgcagaaggatcaattgtccttgcaagttatccacaagttaacgcgacatttgaaaatcaaacagctcacaaaggcgttgaaagcttgaaagatttgattcgttcagtgcgaaatagcagagcagaggtcaatgttgctccatctaaaccaatcactatcttggttaagacaagtgacagcgaactcgaaagcttcttcaaagacaatagcaactacatcaaacgcttcacaaacccagagacgcttgaaatcagctcagcaattgccacaccagaacttgccatgtcatcagtcatcacaggtgcagaaattttcctcccacttgctgacctccttaacgttgaagaagagttggcacgacttgaaaaagaacttgctaaatggcaaaaagaactagatatggttggcaaaaaactcagcaacgagcgctttgtagctaacgctaaaccagaagtcgtccaaaaagaaaaagataaacagaccgactaccaaactaaatacgacgcaaccatagcacgtattgaagaaatgaagaagttggtgaggtaaaaaaataaaaaaacgctatcataaatgatggcgttttttgatataatttgattatggatctttagagataataagtagaaattgtgcagccttattatgtatagtcgctttaaactgtttgatgctagttcttatgctataataactctatcaatgtcaaaggagtttttatgtcaaaggtaaggtatggtgttgtgtcaacggcaaaggtggcgcctcgttttattgaaggagtccgcttagcaggaaatggtgaagttgtggctgtatcgagtcgaactcttgagtctgcgcaagcttttgccaacaaatatcatctcccaaaggcttacgataagttagaggatatgttagcagatgagtcaattgatgtgatttatgtggcaacaattaatcaagaccattataaagttgctaaagcagctctgttagcgggaaaacatgtgttggtagaaaagcctttcacattgacttacgaccaagcgaatgaattattcgctttggcagaaagttgtaatctgtttttgatggaggcacaaaaatcggtatttattccgatgacacaagtgattaaaaaattacttgcctctggtgaaataggagaagtgatctccatctcatctacaacagcctacccaaacattgaccatgtaacatggtttagagaacttgagttaggtggaggaacagtgcattttatggcgccctacgccctgtcttatttacaatatctatttgatgcgactataactcatgctagtgggactgcgacttttccaaaaggtcaaagcgatagtcaatccaaactactcttgcaattatcaaatggggtcctcgtagatatcttcttgacaacacgtctaaatttaccgcatgaaatgattatttatggaactgaaggtcgtctaatcattccacatttttggaaaaccactcatgcaaaattggtgagaaatgatactagtgcgcgaacgattcaagttgacatggttagtgattttgagaaagaagcttatcatgttagtcaaatgattttagaagggcaaagggtaagtcatatcatgacgcctcagttgacgctgtcaggtgttaagattatagaagacttataccgttcatgggggaaatgatgctggctatctagcatattaataaggagtactagatgttattttagtagtccttttttgttttgctctcataaggttaattagatttaaaagggttttctacttgttttttctcgatttttatttcataatgtagacaagtttagagtgaggtgcttctatgttttcgagcgattttggatttgagataattaatgttgacgacctatccttgcaagaggagagatttttaccttcagaattgctggcttatgcacgtgatgaaaatgagtcttctttcgtacgtgatattgaggggcatttggcacttgtttaccagcttttggatacgcaaggtcacgttgatgatgttcgtcatgtgccgagagtgataccagtgactctatttttgaaagaagatggcttgtttgtattagctaatcataaaaatattaaccttgtaaaaaaagcacttaatcgtgttgaaaaggtagattctccgaaacacctcttattatcattagtgactgctttctcaaagcaatattttgatgttttagatactatttctgaagaaagagataaactaatcaatgatttgcgtaaaagaccaaacaaatcgaacttggcaaggctggcaaatttacaaagtggaacagtacacttaatgatgggaactaagcaaaattttgaaatgctgaccgatttacaaaacattgagcaagataaagagaacactagaaatgaaaagatgcaacttcaagatgctattattgaagcaagacaattatctaacatgtgttccttaaattcacaggttttccaagaactttcttcttataataatgtcctcagcaataaccttaacgacaatgtaactactttaacaattatttccattggtatttccattattgctatggttaccagtttttatggaatgaatgttaagttgccttttgatagtgtggatgctgtctgggtattgattattttaattacgactatcattactattatgctctctattgttatgtacatttagagtctgtcaataatcttgtgtaaacactctagcaaagctgatattgttaatcaaataggctttcaagtgtgtccgtacattggccaaaacctttgtggattcgttgtccttgcttgaagttgtaatcactaaatagtgtgacgagatagcgttctagggattcttcattgggaaagacgactttctttttggtttgacgtttgatttctttgttaagtgattcaataaggttggtcgagtagatacttccccagatctgatgaggaaattcataaaagatcaatagattttcgattgattctaaggtctctattaccttcttgtagtgtggtttccactcattgataaagctatctaaggcttgctttgcttcctctacattgatcgcgcgataaattgttttaaactgctccaaaattagagcacgatctgctcgtttcaccttacttgcaatatttcggccaatatggacaaggcaacgctgttgtttggccattgggaaggcttgctggataagctgatcaagtccattaaaaccatcactcacaacaagagagacttgttgtacaccttgacccttaaatctttctagaaggtctgaccacgaagcattgttttcattgggtgcgatgtcatatccaaggatagccttatgcccatatgatgtgacgcctagtgcaatgtggatgcattccttactaactgtaccacgtctcagaggaaggtaagtcccatcaagatataatacggtatagttagcttctaaggaacgttcatgaaagctagccacgttttcctgtgtcgctttcgagatattagatactgttgctggactgtaatgatgaccatacatacgctcaatgatgtcgctgatttcacgtgttgtgactccagttcgataaagcttgataaccatttcttctaaatgattgtctcgacgaccgtaacttgggattaaggctggactgaactccccgtttcgatctctagggatcaacaaattaacaacaccatacttggtctcaaatcgacgtgtataagcaccattacgactattaccggtgttgtaacctgccttatcgtatggttcatagccaaggaaggcggatagctccacttggagaaggtcattcatggcagtttcaagagacgaacggaaaaattcatcaatatcttgtttttgagctaggaagttaagtaattctgtggtaaactgggtcatgggaataaatctctttctagtgaagtctcgcaactctactatacaggatttattcctttttgtgtttacacaagatattttacactacctacatttatgtccataaagaggataatcatcccaaacataaatagagaattaataagagggtactatcaattagtttagttttaagcatggtaacatgctttttttgtacgaagaaactttagcgcaaggcagaattcatctttgactttgagcttgctttctagctcttaaaacgacataatagaggataatgtacagtgaatagagaggttactatgtcaatagaatcagattttttccggaaaaaacgttttattttttcatcgcttgaggagtttggatttatcaaatctgaccaagagtatatctattgtcaaacatttatggataatgactttaaagctattatcacgatttcattggatggaaagatagctggtaaggttattgattcggcacttgaagaagaatatttaccgcttcgagcagcaaattataatggttcgtttgttggcgaagtacgatcggcttatatggctatattaggtgatatttcagattcttgttgtaaggacttattatttaccaaagatcaaagtaatcgtttagcggagaagatagctaaaacttttgaagattcagttgattatccatttgcgaagcacccacaatatgcttcctatcgtgtgtcaggtaaatggtatgctctgctttttccattgaagatggggaaactagaaaatgttccagctcaactgtcagaagatgaggttgaagttttgaatattaaagtcaatcctcaagatatggaaatacttttacaaaaagaaggtatttatccttcttatcatatgtctaaaaagacttgggtatctatcgttttagacaatactttgtctgatatagaaatttttaaattggtatcagatagtcgtaagcttgtttctcacaataaaaaatcaaattctgagccagagttttggattattcctgctaatcctaaattttacgatattgataaggagtttgcagagcatcaattgattgattggactcaaaaaggaaagattgcggtgggagattatgtgtttatttatattacagcacctattcgtgcttttcgctatgtctgtcaagtgatagaacgtgaccttaaaacaagtacttacttaggagcaagagatgtcaaagcttatatgcgactcaaactgataaggcaatttgaagattctacctatcctgtagcatttttagcagaacacggcgttaagactgtgagaggaccacggcgaatgaccaaggaattgcgacaagtcatggcaaaaacaattctagagtaatgactttcagaaaaaacttgtaaaaaagtcagaataattctacaattcctcttccattttgttacttgaaggagtataatagctctaacattttataatttaaggaggaacatatgaagaaaagctttattcatcagcaacaggagatttcttttgtcaaaaatacttttacacaatatttgattgataagttagaaatcgtcgaagtgcaaggacctattcttagtcaggtcggggatggtatgcaagataatttatctggtattgaacatcctgtatcggtgaaagtccttaatatacctgaagctgaatttgaagtcgttcactcattggctaaatggaaacgccatactttggcaagatttgggtttaatgagggagaaggtctttttgttcatatgaaagctcttcgtccagatgaagattctcttgatccaacacactcagtttacgtagatcagtgggactgggagaaggtcattcctgatggtagacgtaatttggactatctaaaagaaactgtggaaaaaatctacaaagctatccgcctaacagagcttgccgtggaagctcgttttgatattgaatccattttaccaaagcgtattacctttattcatacagaagaattggtagaaaaatacccagacttaagccctaaagagcgtgaaaatgccatcgctaaggagtatggcgcagtctttttgattggtattggtggagagttagcagatggtaaaccacatgatggtcgtgcaccggactatgatgactggacaacaccatcagaaaatggttttaaaggtctcaatggtgatattttagtgtggaacgaacagcttggaactgcctttgaactatcatcaatgggaattcgagttgatgaagatgctcttaaacgtcaagttgttctcaccggtgatgaagatcgtttagagtttgagtggcataagacgctattacgtggtttcttccctctgactattggtgggggaattggtcaatcacgattagctatgttcttgcttcgtaaaaaacatattggagaagtacagtcaagtgtctggccaaaagaagtcagagatacctttgaaaatatattataaaaaatcagccaagcagttttgtttggctgattttaacaataagtttatttttggcttaagaaagtttggatttgttgaggtgtagcttggcttccttgaacaagatatttagtcatttttccttgttgataatgtgctaaatttggaacagtggtaatatgatgctttttgaaaaaactcttcaatcgtttccctttgtatttttgactatcaaggtagtaaatttttgaatgaagtgtggcttgagattttaataattttggtaagaaagctctacaatattggcaagttggacgtcctataaaaatagtcgcttcagattgttgacttttgcttactaacgccttatctgtgatggcgattaagtcactatttgttatcatgtgttggtattgttgttgagaaatagtcatggtgtcagcgctacttaagtttgattttagcgttgtaaggcataatatggctattaaagttaataatagttttttaatcattatgggaacctcgtttctcttactgctagcttatcatatcaaaaaagaaggaaaagagatactatcttctctgtttgttataagcaattttttgataactctaccttattttttgttataatagtggttatgagagtagtagcaggaacatttggagggcgtcctttaaaaacgcttgatggaaaaacaactcgtccaacaactgataaggttaaaggcgctatttttaatatgattggtcctttttttgaaggtggtcgtgttttagaccttttttctggcagtggtagcttagctattgaggcgatctcaaggggaatggaccaagctgtcctagttgaaaaagataggcgtgcgcaggtcgttattcaagaaaatattgcaatgactaagagtccggagcaatttcaattattaaaaatggaagccaaccgtgctttagaacaattaacgggacaatttgatttggtcttgttggacccgccatatgctaaggaagaaattgtaaagcaaatccaaatcatggatagcaagggtttattaggcgatgatatcatgattgcttgtgaaacggacaaatcagttgatttacctgaagaaattgcttcttttgggatatggaaacagaaaatttatggcatttctaaagtaacggtctacgttcgttaggaggctttggtatggattacaagttagtgatgattattctcatcttagtcatattgatttatttgttgttgcgccttcactatttagaagagttgctaaaacattatcacttcaaaaatgatgaaggagtttgttcattatcaagaacaaaaaatccattgtatctattaatggcaatgattacttttttgccaaatcttatcaattggatagctaatggttttgaggcaatagacattgttcgcctgattcctgtggtagtctttttatggttgtattattgtggagatgacgacgaatgacaaagaaagctttatttacaggttcatttgatcctgttactaatggacatttagatattattgagcgcgccagctatctatttgatcatgtttacattgggttattttataaccttgagaagcaaggttacttttcgattgagtgccgtaaaaaaatgttagaagaagctatccgtcagtttaagaatgtttcagttttagtggcgcaagatagactggctgttgacttagcaagggaagtgggagcaaaatattttgttcgaggtctgcgtaatagccaggattttgattatgaagccaatttggagttttttaataaacagttggcagatgatattgagacagtttatttatcaacgtcgccatctttgagtccgatatcatctagtcgcatccgtgaattgatacattttaaggcttctgtgaagccttttgttccaaagagtgttgttagagaagtggagaaaatgagtgaagaatagagatccaaaaagaaaacataaaagtttactaggtctgcttaaatggtggattataggttttgcttttttattgttagtattagcaagccttgtagtgagactaccttattatttggaaatgccaggtggagcttatgatatccgttcggtattgaaagtgaataaaaaggctgataaagctaagggttcgtacaattttgtagcggtatctgtcagtcaagcaacgccagctcaggttctttatgcttggttaactccttttacagaattatctagtaaagaggagacaacaggtggctttagtaatgacgattatctcagaattaatcaattctacatggagacttctcaaaatgagtccatctatcaagctttaaagttagctaataagcaagtatctcttacttataaaggagtttatgtgcttaacttagctaaaaattcgacatttaaagatagattacatttagctgatacagtcacaggagttaatggcaaaagtttcaaaaattcttctcaacttatcaaatatgttgcagctcttcatctaggtgataaagtaaaggtacaatacacaagtcaaggtaaaaagaaagaatcagttggtaaagttattaaactatcaaacggtaaaaatggtattggtatcggtttgacagaccatacagaagtattatctgatgttcctgtggactttaatactgaaggtgttggaggaccaagtgcaggtttaatgtttactttagcgatttacgaccaattggttaaagaagatttacgtaaaggacgtaagattgcaggtactggtactattgagcaaaatgggcatgttggcgatattggtggagcaggtttgaaagttgtttcagcggctaaaaaaggaatggatattttctttgttcctaataatccgatcgataaaaatgctaaaaaaggcaaaacaaaggttcagacgaattatcaagaggcaaaagcagcagctaagcgattaggtacgaagatgaaaattgtaccagttcaaaatgttcagcaagctattgattatttgaaaaaaacaaaataaactcaaagagttcgggcgtctgctcggcttttttgttttgcgacatttgactatcaaagtgctaaaatgatagtatgacagagcttataagaatactacatttaaatgatctgcactctcattttgagaattttcctaaggtaaaacgattttttcatgacaatcaagcgcagccaatagagacgatttcacttgacttgggggataatattgataaaagccatcctttgacagaagcaagctcgggaaaggctaatgtccaattgatgaatgaactgggtattgagcttgctactattggtaataatgaaggagttggtttatccaaaaaagacttggaccaagtctacaaagattcagattttacggttattgttggcaatctaaaagataacataatcgaaccgagttgggcaaaaccttacattatttatgagacgcagcaaggaactaagcttgcctttttagcttatacttttccttattataaaacctatgaacctaatgggtggacgatagaagatccaattgactgtcttaaatgccatttacaaataaatgagataaaagaggcaaattgtcgcattttgatgagtcatttaggtattcgttttgatacaaggattgctcaagaattttcagaaattgaccttattataggtgcacatacacaccatttatttgaggaaggggagctaattaacggtacatatcttgcagcagctggtaaatatggtcgctttgttgggagtattgatataacttttgataatcatacactaaaagatattttaatctcaacatgtgatacaaaacaactaactggttatccttcggacagtgactggctaagaagattgagtcagaaggtaaagaacagcttagaaaagaaagtttaatatcctttccagcaccattatcattagaagaatcgtaccaactagtcatggatgcgatgctgttttacgcaggtgcagatgttgctattatcaattctggcttaattgttcagccatttgaaaaagacttttcgaggaaaaatctccacgaatcattacctcatcaaatgcgcctcgctaaattgacagtgagtagtcaagaacttttagagatttatgaaactatttatcaacaaggtcaatttttagcgcaacaaaagattcatggtatgggctttcgtggcaagtgctttggagaagttttacattcgggatttgattacaaaaatggaaaaatagtgtataatgagaaagatattgatgccaaagaagaagtgattcttgtaatcgttgatcagtattattttgcatcgtattttgagtgtttaaaaacgaaaaaagtagacttgcttttcctgaattactcagagatgtggcagcagattatttaataaatatgacactataaatgaaaaatagataaataaagagtagaagctagtcgtttctctcaatgattttagagaaaggagtattatgcgaaaagaagtgacaccagagatgcttaactataataagtatcctggcccacagttcattcactttgaaaatatcgttaaaagtgatgatattgaatttcaacttgttattaatgaaaaatcagcttttgatgtgactgtctttggacaacgtttttctgagattttattaaaatatgattttatcgttggcgattggggtaacgagcagttgaggctaagaggcttttacaaagatgctagtacaattagaaaaaatagccggatttcacgtttagaagattatattaaagagtattgtaactttggttgtgcttattttgtgttggagaatccaaatcctagagatattaaatttgatgatgaaagacctcataagcgtcgtaagtcaagatccaaatcacaatcatcaaagtcacaaactagaaataatcgttcccagtcaaatgccaatgctcattttacaagtaaaaagcgtaaagacacaaaacgccgtcaagaacgtcatattaaagaagagcaagataaggaaatgacctctgcaaagcagcattttgttattcgtaagaaaaaataagaaagggataaactgtaaccgtttattccaccatgaagaaagaaaatattatgcctaaaaaaactgatacacccgcctataaaccctctatttatagcttaactcgcgatgaactaatagcttgggctattgaacatggagaaaagaaattccgtgcttcacaaatctgggactggctctataaaaagcgtgtgcaaagcttcgatgaaatgactaacatttccaaagattttattgcacttttgaacgagaattttgttgttaatcctctaaaacaacgtattgttcaagaatctgctgatggaactgttaaatacctttttgaattacctgatggcatgctgattgagacggttttgatgcgtcaacattatggtttatcagtatgtgtaacgactcaagttggttgtaacattggttgcactttctgtgcaagtggtttaataaagaaacaacgtgatcttaacaatggcgaaatcactgctcaaattatgcttgttcaaaaatattttgatgaacgtggacaaggtgagcgcgttagtcacattgtggtcatgggaataggtgaaccctttgataactataccaatgtattaaaattcttgcgtacagttaatgatgataatggattagctattggtgcacgtcacattacagtgtctacttcaggtttagcacataaaattcgtgaatttgcaaatgaaggtgtacaagttaacttagcagtatctcttcatgctccaaataacgatttacgatcaagtatcatgcgtattaatcgttctttccctcttgaaaagttgtttgcggctattgaatattatattgagacgactaaccgtcgtgtaacatttgagtatattatgttaaatggtgtcaacgataccccagaaaatgctcaagagttagcagatttaacgaaaaagattcgcaaattatcttatgtcaatttaattccttacaatcctgtctcagaacatgaccagtatagtcgtagtcctaaagagcgtgtagaagctttctatgacgttttgaagaaaaatggagttaactgtgttgttcgtcaagaacatggtacggacattgatgcagcttgcgggcaattacgttcaaacacaatgaaacgcgatcgtcaaaaagcgaaggtagggcagtaatgcttaaaagattacttactgaagatggggaattgacaaagattagtcgtcgtttcgtttggatgttagtgattatctattgtcttattattgtcaggatgtgttttgggcctcaaattatgattgagggggtatcaactccgaatgttcagcgcttcggaagaattgtagctcttttagtaccatttaattcttttcgtagtttagatcagctaactagctttaaagagattttttgggttattggtcaaaatgtagtgaatattttactgctgtttcctctcattatagggttactatccctaaagccaagtttacggaaatataaaagcgttatattacttgctttcttgatgtctattttcatagagtgtactcaagttgttttagatattttaatagatgctaatcgggtttttgaaatcgacgatctatggacaaataccttaggcggtcctttcgccctatggacttatcgaaacataaaaggttggcttctaactattagaaaatgaaaataatgtaaaggctatgatattgttcaagccttttactatttaaaaagaatcactttagttgacgaaagtaagcttatagaggcataatagagagttgttaaatgagaattttaaaacacttttcatgtcttctgacttaattatgatgtttttcaatctttgagaaaggaaaaatatgtctattataaaaaatttgtggtggttttttaaggaagaaaagaagcgctatcttattggaattttgtcattaagtttggttgcggtgttaaatcttatccctcctaaaatcatgggatcagttattgatgctattacaactggaaaattaacaagaccacaattgctctggaatttattaggtttggttttgtcagctttagctatgtatgggctgcgttatatttggcgtatgtatattttagggacttcttacaaattgggtcaagttgtcagataccgtttatttgaacattttacaaaaatgtctccttctttttatcagaaatatcgtacaggtgatttaatggcgcacgcgaccaacgacatcaattctctaacacgtcttgcaggaggaggagttatgtcagcagtggatgcctctatcacagcattagtaacgcttatcaccatgttctttactatttcgtggcaaatgacattaattgcggttatccctttgcccttaatggccttagcaactagtaaattggggcgaaaaacccatgaaaccttcaaagaatctcaggcagccttttcagaattaaataataaagtgcaagaaagtgtctctggcgtcaaagtgactaaatcatttggttatcaagaacaagaaattgcttcttttcaagaggttaatcagatgactttcgtgaagaacatgcggaccatgacttatgatgtcatgtttgatcctttagttcttctttttataggtgcctcctacgtattaacattggctatgggagcttttatgatttcaaaaggtcaagttactgttggtgacttggtaacatttgtgacgtatttagatatgttggtatggcccttgatggcgattggtttcttgttcaatatggtacagcgtggtagtgtttcttataaccgtattaatagcctacttgagcaagaatcggatataactgaccctttaaatcctatcagacctgttgtcaatggaacattaagatatgatattgatttctttagatacgacaatgaagaaaccttagccgatattcatttcaccttagaaaaaggtcaaaccttaggtttggtaggtcaaacgggatcagggaagacaagtcttattaagttattgctacgtgaacatgatgtgactcagggaaaaattactttaaataaacatgatatacgtgattatcgattgtctgagttacgtcaactaatcggttatgttcctcaagatcagtttttatttgctaccagtattttagaaaatgttcgctttggaaatccaactctatctatcaatgctgttaaaaaagcaactaaattggctcatgtttacgatgacattaaacagatgccagcaggatttgagactctaattggagaaaaaggagtctcattatctggtggacaaaaacaaaggattgcgatgagtcgtgccatgattttagatccagatattcttattttggatgattctctatcagcagtggacgctaaaacggaacatgccattattgaaaatcttaaaacgaatcgtcaagggaaatcgactattatttcagcacatcgattatcagctgttgtgcacgcagaccttatcttagttatgcaagacggcagagtcatcgagcgaggtcagcatcaagagttgctaaataaaggtggttggtatgctgaaacgtatgcctcacagcaattagaaatggaggaagcatttgatgaagtctaatcaatggcaagtctttaagagattaatctcctatttacgcccttataaatggtttacagtattagctctatctctcttattgttgacgactgttgttaaaaatattattcctttaattgcttcacattttattgatcactatctgacaaatgttaatcaaacagcagttcttattttagtgggatattattcaatgtatgtcttgcagaccttaattcaatattttgggaatctcttttttgcgcgtgtttcttatagtattgttagagatattcgtagagatgcttttgctaatatggaaaggcttggcatgtcttattttgataggacaccggcaggatctatagtgtcacgtattactaatgatactgaagcaatatctgatatgttttcgggtattttatcgagttttatctcggcgatatttatttttacagttactctgtacactatgttgatgctagacattaaactaacaggacttgtcgctcttttattacctgttatctttatattagtgaatgtctatcggaaaaaatcagtcactgtcattgctaaaacgagaagtttacttagtgatatcaacagtaaattatcagaaagtattgaaggaattcgcattgtacaggcttttggtcaagaagagcgcttgaagactgaatttgaggaaattaacaaagagcatgttgtgtatgccaatcgttctatggctcttgatagtctcttcttaagaccggcgatgtctcttttaaaactcctagcatatgctgttcttatggcttattttggatttacaggagttaaaggaggtcttacggcaggattgatgtatgcttttattcagtacgttaatcgtctctttgaccctttaattgaagtaacgcaaaatttttcaaccttacaaacatcaatggtatcagcagggcgtgtgtttgatttgattgatgaaacaggttttgaaccaagccaaaaaaatacagaagcttttgtgagagaaggaaatatcgaatttaaaaatgtatcattctcatatgatggaaaaaaacaaatccttgataatgtttcttttagtgttaaaaaaggtgaaacgattgcttttgtaggagcgacaggttctggaaaatcatctattattaatgtctttatgaggttttacgaatttcaatctggacaagttttattagatgggaaggatattagggattactcacaagaacaattgcgaaagaatattggactcgtcttacaagacccctttttatatcatggcactattaaatctaatatcaaaatgtaccaagacatcaccgatcaagaggtacaggacgcagcagagtttgttgatgctgatcaatttattcagaagttgccagataagtacgatgcagctgtttcagaacgtgggtcaagtttttcgactggacaacgccaactattggcgtttgccagaactgtggctagtaaacctaaaattttaatcttagatgaagcgacagcaaatattgattcggaaacagagcagattgtacaagattcgttagcaaaaatgcgtcaaggtcgaacaacaattgccattgctcaccgcttatcaaccattcaagatgctaattgtatctatgttcttgatagaggaaagataattgaaagtgggaatcacgagtctttattagacctaaaagggacttattatcgtatgtaccaattacaagctggcatgatggaggtctagaaaatttagactattcaaaaggcataatctgtgaggtttagaggttggagtagttattcctctaagccttttttatattttacaattagtgtataatgaggtcaaagtgcaaggaaaggtctataaaatgttactattggtagataattacgattcttttacctataatttaaagcaatatttaagtgtctataaagaggtattcgtcataaaaaatgatgttcctaacctttttttattagctgagagcgcagaagccatcgtcttatcacctggaccaggacacccaaaggatgctgggaaaatggtagaattaatcaatcagtttataggaaagaaacctattctaggtatctgtttggggcatcaagcgcttgccgagtgcttgggtgggcgattaaatttagcaaatcacgttatgcatggtaaacaaagttgggtaacaataaacgaccatactagtttgtttaagggaattgatagtccaacccaagttatgcgttatcattcattggtagtgactgatttaccagagaatattgctgttattgcacgatcaaatgaggataatgaaatcatggcattccattgccccagcttaaaggtatatgcgatgcagtttcatcctgagtcaatcgggagtattgatggaatgaaaatgattgaaaactttttgacgttaattaatgactaaaatgtgttagtgtaggataatgactctctataaataaaagacagtaccttaggtactgtcttttatttagttgtatagatgagttaatctgtttgcaaatttacgataaataatcaagcaaatggatgcttttaaggtatccccaggaataaaaataaggttagaaaatagtgatttagttaagggtagagaagtttgaaaggaaagaacgatgctaccacaaatatcaatcaatagtacgccaaatatccaaataataaggaattgaacccagagttttgttgttttcactttctcaagccctaggccgataaaaaaagctgcaaatggataagtcagcagatagcctgctgttggcccaaacagcgttacgagacctgaccgtcctcctggtaaaaatggtgcaccaatagcaactaagagcaagaaaatagccacagctaggaaacccttcctactaccaagcagagcacctgccagcataacaccaagattttgtaaaacaattgggactggaatgaaacctaatgggatccctgggataaaacctaaaacaataagtagtgcaaccatgagtgcaatataggtagttgttcttgttttcatttaaattaattcctttttagtatgatttagttgtaatttttccaagaattcaatatcggtatgttgattgcgaccgccctctgttaggtaatttcccaaaaaagttgagtcaacaagtaaggtgactaatgattcaaaattctcaaaatggacctctcgtccagcgcttaatcttaattccttgaaaggaaaaacaaaacgcaacatggccataatttttaagcatttaatgggagtcaaatagttatattttccaagaggtgttccttcaacagcaagtaaaaaattgacagggatagaataggggtccagctcttttagtctgaaagctaatgtgatgagcccctcatcgctctctcccataccacaaatgaatccagaacaaacatcaatgtcttcattgtgaattctttctaaagtatcacaacgatctttgaagctatgcgtcgttgcaatgttggggtagttttcttcgggggtgttgagattatgattgatacggtcaattcctgcttgttttagctgatgaagttgttctctatccaaaaaaccagcggtaaggcatatttctagagggaggctttttttgatttcagggatgacttgacataactgctcaatttctctcttgctaggcttagttccactcatcgcaatacaaaagacgctagcaccattttgatgagcgacaatagcctgttttagaatgacattttgaggaagcagaccaaatttatcaatgtcagcagtgctttctttagattgagaacagtaaccacaattttctgcacaaagtccttgcttagcacttaataaaacgttaaggcgaatattatttcggctaacttgatttttaaggtataaggcagcagcgtagatttcccaccagttctcatcgctatttagaatttccagcgcttgttcataagaaatgctagtctttccagataatatttcgtcagccaaatggatataatttgtttgaaatgacatgatagcctcctttaacgaaattaataatagcataaaaaaactatattgtaaacttagtcgatgtcataagttaacaatataaaaattatgatatactggtcttatattttgacgggagataagatgaaaaaactatttaaaaaagcgatagctatgtgccgagatttgccgcttaattttgtaattgttgaacttagtttgtatcaaagagaggatggctcatctgataatattaaatggatttctaagagaattcttgaggtaacggtaactgatcagcaatggatttaccatttgaggatgcttaatttaccaaaacttaagccaatgtcactagcatccagtgactgtcctgcaagggaagagaaggctagtcttatttcaatagaagaatgtcaaaaattcactagcttagtgcgagataaaaatccttttcaccaaggggaagcagctattgtgcctgcggctctattattggaaaaaataatggaagttagaaaaggaaaaataaaggagattcatttgacttttttatctccagtaagggtgaatcaagaattctcagtgcaagtagtggataacacagtgattatttttcagcatcaaatattatggtgaggggaacatatgaagaatagagatgtttatattggttttgggctacgaacacctatcggtataaaagggaagcaatttaaacattaccgtccagaacttttaggagcacaccttttaaatcaaataaaaaaaatagaatcagaatctaacattgatagtattatttgtgggaacacagttggtactgggggcaatattggtcgtttgatgactcttttttctgattatgaatcctatattccagtacaaacgattgatatgcagtgtgcttcatcaagttctgccttgttttttggttatctaaaaatcagtaccggtattaatgaaaaagttcttgttggggggattgaaagtagttctcttcaacctatgagacgttatgctaaagaagataatcgtaacggagaatatacagttgctcagttttctcctgactcttatgctgaaactgtaatgttagaaggggcccagagagtctgtcaaaaatatggttttagaagagaaatgttagataaattggcattcttgagccataaacgcgccttaacagctaaacaaggtggctatttagaagaggtaatcttaccaatggaagggatgcgagatcaaggcgttagaaaactaaaagaaacattttttcaaaaattaccaagattgatggaaaattcacctttgctcactattggaaatgtttgtttaatgcacgatgctgctgcatttctaacgcttcagagtcagaaaacagaattccggattgttcacattgtagaagtagcaggagatcccaagcttagtccagaattggttcacacggctacggaaaaactattaacagaaactcatactaaaatatcggattatgatgcaattgaatggaatgaaccatttgcagcgattgatgctctatttaatcattattatcctgaagagagagaaaaattcaatatttttggagggacattagcttacggacacccttatgcctgctcaggaattattaatatccttcatcttatgcaggcattaaaatataaaaataaacctatgggtctaactgccattgcaggggcaggaggagtcggaatggccatatcaatagagtacttaggagttaagaatgcttgaatcattgaaaacgatagttaaaaccaatagcgataaaaagttatttgatggtgatttacaggtcagttatggagaattttataacttagtaagacaagatatggcgtcacaagacaataggaaacatgtgattagcacacactctctgcttaaccaattagtaagatttgtttcaaagttatgtcaaaaagctcttcctattatttgtaaacctaaccttactcataatgaaataagtcgattagaaaaagaagtgcagtatgctcctcaactagctgattttggtgttctttcttctgggactacagctgatgctaaactattgtggaggagcttcacttcgtggtctgatttttttagcattcagaatgcttatttttcggtcacttccaatagcaaactgtttattcaaggtgatttttcatttactggtaacttaaatttagcgctatcccttttattactggggggaacacttgttgtcacacagaaaaattctgtaaaatactggcagactttatgggaaaaaactggtgtaacgcatctatatctgctccctagttatctcaagttagtggaacaatatagcaaggagactgcgttagacaataaaactattattacctcttcgcaatatgtctctgactcattactggaaggtttatatagaaagcatcctaaagtgtcagtgaaaatcttctatggtgctagtgagctcaattatgtgtcatggtacgatggtcgtgatatccgagataagccacagtatgttggagaaatcgttccaaatgtagctgttaggattaaagagggaagaatttttgtaaaaacaccgtatagtatctgtggcctttcaagtgaatattgtgctggtgattatggtgaactgatagatggcaaattatatctatttggccgtggtggtgattggtgcaatcaatcgggcattaagctctatttacctagattaatcgaaaaaataaaaacatgcccttatatcaaggatgcagtagcatttacaaaagagagtcaaagtcatggacaagagtcacattgctgtattgttttaattgaaaatcagatgcaacaagagtgtttgaagtggttatcggaacattttgaaaagaagtatgggtttaagcattatcatattgtatctaaaattcctttgatgccatctggaaaaattgattatcaacaactcaaaagacagttagcatgagcttttactaaaaaaataaaatagggttaatggattgtaaacctcagttctgatattctttattttgaaagatatcgtgatataatgataaaaaagaaagataaggaataaaatgttatcaaaagcaaaatcacgatatattatccgtgagattattaagttatttccagatgctaaacctagcttagactttactaatgtctttgagcttttggtagctgtaatgctatcagctcaaacaactgatgcagctgttaataaagttacacccgccctttttgaacgctttccaaatcctttagttttggcacaagctgatcccaaagagattgaaccctatatttctaaaattgggctttaccgtaataaagctcgattcttaaatcaatgcgctaaacaattgatagagcattttgatggaaaagtcccccgaactcgtcaagagctagaaagtttggctggcgttggaaggaaaacggctaacgtggtcatgagtgttggatttggtattccggcttttgccgtagatactcatgtcactcggatttgtaaacaccaccagatttgcaaacagtcggcttctccactggaaattgagaaacgagtcatggaggttttaccaccagaagagtggctagctgcacatcaatccatgatttattttggtcgtgcaatttgtcatcctaaaaatccaaaatgcgaccagtacccacaactttatcactttcctgataatttaaagtgattagaataaaagagagtaactggtgacgattatataagcgatacttaaaaacggtagaaaagctatcgtttttttcatttttctcataactaaacaataaataattcctaaccaagcacctatttgaataataaaaagcatttgatgaagaggtaaagataagccaattgtggctaaataaaggaaatctccacttccgatattaatatcaaccacttcagctaaaatcccaaataaacacaaaacaatagaaacttttgtaatcggtgtgagaattatcgttgaaatggtgaataatatccatagaaaaataggatactcttggtattttatatcataataacttaagataaaactcatgcataaagaaataaaatagatggtagacataatcataaaatcctttttatagtttatatttatattcgaaaaatggtagaaaagagattacgatttctattatagatagtcagtctaacgtcataatgacaattagcaagcggttgcggattttcttgaaaattgaatggttttctgttaaaattcatatatgaaagttttattcgatgtgcagaatcttttgaaaaaatttggtatttatgtttatattggtaaacgtctttatgatatcgaagttatgaagattgaattgcaacgtctctacgataatggtctgataagtagagatgattatttaaaagcagaactgattttaagaagagagcacagactagaattggagaaggaaaataaaaaatgagtaagaaattattgggaattgacctcggaggaacgaccattaaatttggtatcttgacgcttgagggagaagtacaagaaaaatgggcaattgagaccaatactttagaaaacggaagacatatcgtttctgatatcgttgaatctctcaaacatcgtttgagcctctatggattaacaaaagatgactttctcggtatcggtatgggttctccaggagctgttgatagaactagtaaaacagtaacaggtgcttttaatctaaattgggctgatactcaagaagtaggttcagttattgaaaaagaagttggaattccattttttattgataacgatgctaatgttgcagcacttggtgaacgctgggtaggtgctggtgccaataatcccgacgttgttttcgtaaccctcggaacaggagtaggtggaggtgttatcgcagatggtaacctcatccatggtgttgcaggagcaggtggagaaattgggcatatgattgttgatccagaaaatggatttacgtgcacatgtggtaacaaaggctgccttgagacagttgcatcagcgacaggtgttgttagagtagcacgtcaactcgcagaacaatatgagggttcgtctgccattaaagcagcgattgacaacggtgatactgttacaagtaaagatatttttatagcagcagaagatggggataaatttgctaattctgttgttgaacgtgtatcacgttaccttggactggcagcagctaatatttcaaatattttaaaccctgattctgtggttattggtggcggtgtctcagcagcaggtgaatttttacgtagtcgcgttgagaaatactttgtcacatttgctttcccacaagttaaaaagtcaactaaaattaagattgctgaactaggtaatgatgctggtattattggtgcagcaagcttagccaatcaacaagcaagttaaggagataaggtatggatatgtctgttattttaattattgttattcttctggcttttgttgcttgggcatcttggaattattggagggttcgtagggcagctaaatttttagataacgagtcttttcaaaaagaaatgtcacgaggacagttaattgatatccgagaagctggtgcttttcatagaaagcatattctcggagcacgtaacattccagcaagtcaatttaaagttgccttatcggctttgcgcaaagataaacctgtcctcttatatgacgcaagccgtggtcaatctattccaaggattgttttgttactcagaaaagaaggttttaatcaactttacgtgttaaaggacggtttcaattactggacgggtagagttaagtaatatactaaggagagagttactattaataactctcttcactttttgtagaaatgaattaaattgaaaaaagtagaaaataaatggcataaataatgaaatgatgaaaagttttcttatcacaaataggcagttaatatgaaaacatttacacttgtgtaaattctgttttttaagaaaaattgtgttataattcataagttaacagaattacattataaaatagaggaaaacatgacaaatttaagaacagatatccgtaacgttgcgatcattgcccacgttgaccacggtaaaacaactctcgttgatgaattattaaaacaatcacatactcttgatgagcgtaaagagcttgaagaacgtgcaatggattcaaatgatatcgaaaaagaacgtggtatcaccattcttgcaaaaaatacagccgtagcatacaacgatgttcgtatcaatattatggacacacctggtcacgcggactttggtggtgaagttgagcgtattatgaaaatggttgatggtgttgttttagtcgttgatgcctacgaaggaacaatgccacaaacacgttttgttttgaagaaagctcttgaacaaaacttaattccaatcgttgttgtaaataaaattgataagccgtcagctcgtccatcagaggttgttgatgaagttcttgaactatttattgagctcggtgctgatgatgatcaactagatttccctgttgtttatgcttcagctatcaatggaacatcttcaatgtcagatgatccttcagatcaagaaaaaacaatggcaccgatttttgatactatcattgatcacattccagccccagttgacaactcggaagaaccacttcaattccaagtttctcttcttgattacaatgattttgtaggacgtattggtattggacgtgttttccgcgggactgtcaaagttggagatcaagttactctttcaaaacttgatggtacaactaaaaacttccgcgtaacaaaactttttggtttctttggacttgaacgtaaagaaatccaagaggctaaagcgggtgatttaatcgctgtttctggtatggaagatatcttcgttggtgagacagtaactccgacagatgctattgaaccactaccagttttacgtattgacgagccaacacttcaaatgactttcttggtgaataattcaccatttgcaggtcgcgaaggtaaatggattacgtcacgtaaggttgaagaacgtcttttagcagaattacaaacagacgtttctttacgtgttgacccaacagattcgccagataaatggacggtttcagggcgtggagaattacatttatctatccttattgaaacaatgcgtcgtgagggatatgaacttcaagtatcacgtccagaagttatcatcaaagaaattgatggtgttcaatgcgagccgtttgagcgtgttcaaattgatactccagaagaatatcagggtgctattatccaaagtttgtcagagcgtaaaggtgatatgcttgatatgcagatggttggtaatggtcaaacgcgtttgattttcttgattcctgcacgtggtttgattggttattcaacagagtttctttcaatgacacgtggatatggtatcatgaatcatacttttgaccagtatctaccggttgttcaaggagaaattggtggtcgtcatcgtggtgccttggtttctattgaaaatggtaaagcaactacatattcaattatgcgtattgaagaacgtgggactatctttgtaaatccaggtatagaagtttatgaaggaatgattgttggtgagaattctcgtgataatgacctcggagtcaatattacaactgctaaacaaatgacaaatgtccgttcagcaactaaagatcaaactgcagtcatcaagacgcctcgtatccttactttagaagagtcacttgaatttttagcagatgatgagtacatggaagtaactcctgagtctattcgtcttcgtaaacaaattttaaataaagcagcacgtgacaaagctaataaaaagaaaaaatcagctgaataatatccaaagtatttcttatttatgattaataagaaaggagttctatgttttacttaattgttgcccttttgattgccttgtattacttttttatggcaccaaaaacagtacgtaatactttgaacgctattggtttagtaggtttggtagccttattacttgtcttggcagttatgagttttattaaaatccttcaattgccaggtgaattgtatattgggcttataatgattcctctaggatatacagcatttaaagaaacattgaatttgtcagaaaagaagaaatagcttatgaacttaggattttgtctcctaagttcttttgttttgagaaattagagacatatcctttaccttgaaaaagccactgattaaaggtaaaataatagggataataatgatagaatgggacgagtaatgaaaacaataacaacatttgaaaataaaaaagttttagtccttggtttagcacgatctggagaagctgctgcacgtttgttagctaagttaggagcaatagtgacagttaatgatggcaaaccatttgatgaaaatccaacagcacagtctttgttggaagagggtattaaagtggtttgtggtagtcatcctttagaattgttagatgaggatttttgttacatgattaaaaatccaggaataccttataacaatcctatggtcaaaaaagcattagaaaaacaaatccctgttttgactgaagtggaattagcatacttagtttcagaatctcagctaataggtattacaggctctaacgggaaaacgacaacgacaacgatgattgcagaagtcttaaatgctggaggtcagagaggtttgttagctgggaatatcggctttcctgctagtgaagttgttcaggctgcgaatgataaagatactctagttatggaattatcaagttttcagctaatgggagttaaggaatttcgtcctcatattgcagtaattactaatttaatgccaactcatttagattatcatgggtcttttgaagattatgttgctgcaaaatggaatatccaaaatcaaatgtcttcatctgattttttggtacttaattttaatcaaggtatttctaaagagttagctaaaactactaaagcaacaatcgttcctttctctactacggaaaaagttgatggtgcttacgtacaagacaagcaacttttctataaaggggagaatattatgtcagtagatgacattggtgtcccaggaagccataacgtagagaatgctctagcaactattgcggttgctaaactggctggtatcagtaatcaagttattagagaaactttaagcaattttggaggtgttaaacaccgcttgcaatcactcggtaaggttcatggtattagtttctataacgacagcaagtcaactaatatattggcaactcaaaaagcattatctggctttgataatactaaagttatcctaattgcaggaggtcttgatcgcggtaatgagtttgatgaattgataccagatatcactggacttaaacatatggttgttttaggggaatcggcatctcgagtaaaacgtgctgcacaaaaagcaggagtaacttatagcgatgctttagatgttagagatgcggtacataaagcttatgaggtggcacaacagggcgatgttatcttgctaagtcctgcaaatgcatcatgggacatgtataagaatttcgaagtccgtggtgatgaattcattgatactttcgaaagtcttagaggagagtaactatggggaaaaaaattgtttttacaggtggtggtacggtaggtcatgtaacactaaacctaatattaatccccaaatttatcaaagatggttgggaagtacattatattggtgataaaaatggcatagaacatgaacaaattaatcagtctggacttgatatcacatttcactctatagctactgggaaactacgtcgctatttttcatggcaaaatatgttagatgtctttaaagtaggggttggcgttcttcaatcgattgctattattgctaaacttagaccccaagccttattttcaaaagggggatttgtttcagtacctcctgtagtagctgcacgcctattaaaagttcctgtttttgttcatgaatcagatttatcaatggggttagcaaataagattgcttataaatttgcgactattatgtatacgacttttgaacaatctaaagatttaatcaaaactaagcatattggtgctgtaacaaaagtcatggattgtaaaaagtcgtttgaaaatactgacttaactagtataaaagaagccttcgatccaaacctaaagaccttactatttattggaggatcagcaggtgcaaaagtattcaatgattttattactcaaacacctgagctggaagaaaaatataatgttatcaatatttcaggcgattcttctctcaatcgattgaagaagaacctttatcgcgtggattatgttacagacctttatcagcctttaatgaatttagcagatgtggttgttacacgaggtggctctaatactatttttgaattagtagctatgaaaaaacttcatcttattatccctcttggacgtgaagcgagccgaggtgaccaattagagaatgctgcttattttgaagaaaagggctacgcattgcagttaccagaatctgaattaaacataaatacacttgagaaacagataaatttattaatttctaacagtgagagttacgaaaaaaacatgtcacaatcatctgaaataaaatctcaagatgaattttatcaattattaattgatgatatggcaaaagtaacaaaaggataaaacatgcctaagaagaaatcagataccccagaaaaagaagaagttgtcttaacggaatggcaaaagcgtaaccttgaatttttaaaaaaacgcaaagaagatgaagaagaacaaaaacgtattaacgaaaaattacgcttagataaaagaagtaaattaaatatttcttctcctgaagaacctcaaaatactactaaaattaagaagcttcattttccaaagatttcaagacctaagattgaaaagaaacagaaaaaagaaaaaatagtcaacagcttagccaaaactaatcgcattagaactgcacctatatttgtagtagcattcctagtcattttagtttccgttttcctactaactccttttagtaagcaaaaaacaataacagttagtggaaatcagcatacacctgatgatattttgatagagaaaacgaatattcaaaaaaacgattatttcttttctttaatttttaaacataaagctattgaacaacgtttagctgcagaagatgtatgggtaaaaacagctcagatgacttatcaatttcccaataagtttcatattcaagttcaagaaaataagattattgcatatgcacatacaaagcaaggatatcaacctgtcttggaaactggaaaaaaggctgatcctgtaaatagttcagagctaccaaagcacttcttaacaattaaccttgataaggaagatagtattaagctattaattaaagatttaaaggctttagaccctgatttaataagtgagattcaggtgataagtttagctgattctaaaacgacacctgacctcctgctgttagatatgcacgatggaaatagtattagaataccattatctaaatttaaagaaagacttcctttttacaaacaaattaagaagaaccttaaggaaccttctattgttgatatggaagtgggagtttacacaacaacaaataccattgaatcaacccctgttaaagcagaagatacaaaaaataaatcaactgataaaacacaaacacaaaatggtcaggttgcggaaaatagtcaaggacaaacaaataactcaaatactaatcaacaaggacaacagatagcaacagagcaggcacctaaccctcaaaatgttaattagcaataaaaaagactggatttatcagtcttttttatatatatcaagtcagtcatagattgctagtaaaaattgatttcttgaaaaaaatttaagtttgttataagttccgaatggtttaaataagttagaaatatttcaatttgatgttgcttaataaaaaaacgtaatttggtaacaattctgctttttttatggtataatattttctgaataattctgtttttggcagatgtagaatagaaaagaatggaaagatagcgaggtcgagtgaatggctagaaatggcttttttactggtttggatataggaacaagctcgattaaagttttagttgcagaatttattgcaaatgaaatgaatgtaattggggttagcaacgtccctagttccggtgtaaaagatggtataattattgatattgaggcagcagcaactgcaatcaaagaggcggtaaaacaagctgaggagaaagcaggcatcaccattgacaaaatcaatgttggattaccagcaaatcttctccaaattgaaccaactcaaggaatgattcctgttcctaatgaatcaaaagaaattaaggatgaagatgtcgaaagtgttgttaaatcagcattgactaaaagcattactcctgaaagagaagttatttcattgattccgcttgaattcattgtagatggtttccaagggattagagaccctagagggatgatggggattcgccttgagatgcgtggtcttatctatactggaccaacaactatccttcataatcttcgtaaaactgttgaacgagcaggtataaaagtagagcatgttgtgatcgcccctctagccttagcaaaatcagttctaaacgaaggtgaacgtgagtttggtgcaactgtgattgatatgggaggcggacaaacaacagtcgcttctatgcgtaatcaagaattgcaatatactaatatttattctgaaggtagcgattatgttaccaaagatatttctaaagtgctacgtacaacagtagaaatcgccgaagcattgaaattcaactttggacaagctaatgttgaagaagcaagtacttctgatacagttcaagttaatgttgttggtaacgaggaacctgttgaaattacagaaagctatctttcgcaaattatttcaggacgtattcgtcaaattttagaacatgtcaaacaagacttgggtagaggtcgtttacttgatttacctggtggtattattcttgttggaggtggtgcaattatgccaggagttgtcgaggttgctcaacaaatttttggaactagagttaaattgcacgttccaaaccaagtaggtattcgcaatccaatgtttgctaatgttattagtatcgttgattatgtaggaatgatgtcagaagttgacattatcgcacaacatgctgtaactggcgacgaaatgctaagacataaaccagtcgactttgattataaagaaaaaacaaatacaatgtcgacaatgccttattctgagccgttaacctcttctatggaagattctaatttagaaccaatccgagcaagagaaaacgctcaagagcctactgagcctaaagctaatattggtgagcgcatcagaggaatttttggaagtatgtttgactaaaacaataagtgaggaataaaaatggtattttcatttgatacagcatcagtacaaggtgcagttattaaagttattggtgttggaggcggtggcggtaacgctattaaccgcatgattgacgaaggtgtcgctggcgttgagtttattgcagcaaatactgatattcaagccttaagtagctcaaaagctgaaactgtcattcaacttggtccaaaattaactcgcggacttggtgcaggaggacaacctgaagttggtcgtaaagcagctgaagaaagtgaagaagttttaacagaagcacttactggcgctgatatggtatttatcacagcaggtatggggggcggatctggtacaggtgcggctccagttattgcacgtattgcaaagagtttaggagcacttacagtagcggtcatcacacgtccttttggctttgagggtaataaacgttctaacttcgctatcgaaggtattcaagaattaagagaacaagttgatacactgcttatcatttcaaataataatcttcttgaaattgtagataagaagacaccattgcttgaagctcttagtgaagcagataatgttttacgtcaaggtgttcaaggtattacggatttgattactaacccaggtttaattaaccttgactttgcagatgttaaaacagttatggcaaataaaggtaatgcactgatgggaattggtatcggttctggtgaggaacgtattactgaagctgctcgaaaagcaatttattcaccacttcttgaaacaacgattgatggagcagaagacgttattgtcaatgttaccggcggtatggatatgacacttactgaagcagaggaagcatcagagattgttagccaagcagcaggtaaaggtgtcaatatttggttaggtacttcaattgacatggatatgaaagacgaaatccgcgtaacagttgttgcaacaggtgtacgtaaagataaaactaatcaagtatctggttttacaacatcagctccaactaatcaagcaccttcagaacgtcaaagtacttcaaattcaaactttgatcgtcgtggcaactttgatatgacagagtctcgcgaaatgccaactcaacaaaatcagcctcatgcacaaaatcagcaacaaagttctgcttttggtaattgggaccttcgtcgtgataatatttcacgtccgacagaaggtgaacttgatagcaagttgtctatgtcaacgttttcagaaaatgatgatatggatgatgaacttgaaacacctccattctttaaaaaccgttaattaaaatgatgaatttacaagaaaataaaacagcgatttttgacaatgttagtaaattagcactaaaagcaggtcgcgctcatgaatcagttcatatcgtagctgtaacaaaatatgttaactgtcaaacaacagaagcgcttattagaacaggtgttaatcatatcggtgaaaatcgtgttgataaatttcttgaaaaatatcaagcattaaaagatgaaaagcttacatggcatctcattggtagtttacaacgtcgaaaagttaaagatgtcattaattatgttgattattttcatgctttagattctgttaagttagcagctgagattcaaaaacatgctcaaaaactaattaaatgttttctacaagttaatatatcacgagaagacagtaagcatggttttactattgagcaaatagatgatgcactgaacttaatttctcggtacgataaaattgaacttatcggcatcatgactatggctcccttaaaagcaactaaagaggaaatatcatcaatttttgaagagactgagagtcttaggaaaaggcttcaagctaggaacatagaacgaatgccgtttacagaattaagcatgggcatgagtagagattatgatattgctattcaaaatggatcaacatttgtaaggataggaacttcattctttaaataatggaggggaatatggcattaaaagatagatttgacaaaattatttcttattttgacactgacgatgtaagtgaaaatgaagtacacgaagtacaagagagaacttcagtgcaaagagattccagagcagctacagcacaggaagcttctcagcgtagtcatatgactaactccgcagaggaagagatgattggtagtcgtccgagaacttatacctatgatcctaatcgtcaggagagacaaagggtacagagagacaatgcttatcagcaagctactcctagggttcaaaataaagactcagttcgacaacagagagaacaagtaacaattgctctgaagtatccccgtaagtatgaggatgcacaagaaattgttgatttacttatcgttaatgaatgtgtcttgattgattttcaatatatgcttgatgcgcaagcacgacgttgcttggattatattgatggtgcaagtagagtattatatggttcattacaaaaggttgggagttcaatgtttctattaacaccagccaatgttatggttgatattgaggagatgaatattccaaagactggtcaagagacgagttttgattttgatatgaagagacgataaatatgatattagtactattaatattattaaaaacaattagggtctattcttatatcttactagcctatgccttgttatcttggtttccaggagcatacgattcatggattggtagactagtggtacagattgttgatccgattattcgcccactcagaagatttaatctacaatttttaggtctagattttacagtaatagtagcattctttttactaaatatgttgagtagatttttaatcttgctttttacataagatgacgttagatgatatttatcagcattttcgaccagaagagtatgcgtttatccataaaatagaccatttagctcaatatgtcgaaaacacctattcgtttattaccactgaatttctaaatcctagggaatttaaaatactcgaaagtgttctagagaggcgaggtagtcattattacacttctggtcagtattttcaaacagaatatgttaaagtaataatagcaccggaatactatcagttagatatggctgattttaaccttagcctaattgaaataaagtataatgctaaatttaatcaccttacccatgctaaaattatgggaactttactgaattacttaggtgtaaaacgatcaattttaggggatatcctagttgaagaaggctgtgctcaggttttggtcgatagtcaaatgacaaatcaccttgttcattcagttacaaaaattggaactgctagtgtacaattagctgaagttcccttgtccaaacttctaactcccaaacaagatattcaaaaactaactgttattgcttccagtttacgtcttgataaaattttagcaacgattttaaagatttcacgaacacagtcgacgaaattgattgaggcagataaagtcaaggtcaattatgcaaccgtcaatcgagtttctgaacaattagtagagggggatttgattagtgttagaggatatggtcgatttacgttgaaccataacctagggttaactaaaaatcaaaaatataagttagaagtagacaaaatgatacataactaaggagaaaacatgccacttacagcacttgaaattaaagataaaacattttcatcaaaatttcgcggttatagcgaagaagaagttaatgaatttttagagattgttgttgacgattacgaggacttgattagacgtaatcgtgagcaagagcaatacattaaagatttagaagagaaaatcgcttacttcaacgaaatgaaggaatcgttaagtcaatcagttattttagctcaagaaactgctgagcgtgtgaaaatttcagcacaggatgaagcatctaacctaatggggaaagctacatttgatgctcaacatttaattgatgaggctaaattaaaagcaaatcaaatccttcgagatgcgacagatgatgctaagcgtgttgctatagaaacagaagatttgaaacgtcaatcacgtgttttccaccaacgtttgctttctgagttagaagggcagctaaaattagctaactcatctgcttgggaagaattgttgaaaccaacagctatttatcttcaaaattctgatgcttctttcaaagaagttgttgaaaaagttcttgatgaagatgatgctttaccagtggtggatgacactgagtcatttgatgctactcgtcaattctcaccagatgaaatggaagaattacagcgtcgtgttgaagaaagtaacaaacaacttgaagagtcaggtttattagatactaataatttccaaatggaagaaccgatcaatttaggtgaaactcaaacttttaaattaaatattgaagattaagaaaaacaaggttttaatattatattatcagcgagtaggagatggtgagagccctacaatccctaatattgaaattatcattttcaatcattctacctgaactattatttaagtaaggtagaaggcttaacccaccttacgggttgttgagggagtaagaaatagctattttctgctctgaattaaggtggtaccacgagctttcgtcctttatgtgatgaaagcttttttatttagcaatttaaaaaattgtgataactattactataagataaggagttagtatgaaattaaaagaaaccttgaatttaggacaaacagcttttccaatgcgtgcagggcttccaaataaggaacctcaatggcaagaagcatgggatcaagctgacatttataaaaaacgtcaagcattgaatgaaggaaaaccagcctttcaccttcatgacggacctccctatgctaatgggaatattcatgtaggacatgcactaaataaaatttcgaaagacattattgtacgttcaaaatcaatgtcaggttttcgagctccttatgtgcctggttgggatactcatggactcccaattgagcaagtattagctaaaaaaggggttaaacgtaaagaaatggacttggctgaataccttgaaatgtgtcgtgattatgctctcagccaagttgacaaacaacgtgatgattttaaacgtctgggcgtttctgccgattgggaaaatccttatattacactaacaccagattatgaagcagatcaagtacgtgttttcggtgctatggcagataaaggatatatctatcgtggtgctaaaccagtgtattggtcatggtcatcagagtctgcccttgctgaggctgaaatcgaatatcatgatattgattcgacatcactctactatgccaataaagttaaagatggtaagggaattcttgatacagatacctatatcgtcgtttggacgacaacaccatttactgtaacagcttcacgcggtttaacagtaggaccagatatggagtatgttgtagttgtaccagtaggtagtgagcgtaaataccttcttgcagaggttcttgtagatagtctcgctgctaagtttggctgggaaaactttgaaattgtgactcatcacactggtaaagaacttaatcacattgttacagaacatccatgggatacagaagtagaagagttggttatccttggagaccatgttacaacagattctggtacaggtattgtccacacggctcctggttttggtgaagatgactataacgttggtattgctaatggacttgatgttgtagttaccgtagatagtcgtggtttgatgatggaaaatgctggtcctgattttgaaggtcaattctatgacaaagtaacaccacttgtaaaagaaaaattgggagatcttcttttagccagcgaagttatcaaccactcatatccatttgactggcgtacgaaaaagccaatcatttggcgtgcggttccacaatggtttgcctctgtttcgaaattccgtcaagaaatcctcgatgaaattgaaaagacaaatttccaacctgagtggggtaaaaaacgtctttataacatgatccgtgaccgtggcgactgggtaatctcacgtcaacgtgcttggggtgttccacttccaattttttatgcagaagatggtacagctatcatgacaaaagaagtgactgatcacgttgcagatttatttgctgaatacggctcaatcgtttggtggcaacgtgatgctaaggaccttctaccagcaggttatactcatccaggttcacctaatggtctctttgagaaagaaacagacatcatggatgtttggtttgattctggttcatcatggaatggggtaatgaatgctcgtgaaaacctttcctatccagcagatctttatcttgaaggttctgatcaataccgtggttggttcaactcatcactaattacatcagttgctgttaatggtcacgctccatacaaagcagtcttatctcaaggttttgtacttgatggtaaaggtgagaaaatgtctaaatctctaggaaatacaattcttcctagtgatgttgaaaaacaatttggtgcggaaatcttgcgtctgtgggtaacttctgttgactcaagtaatgatgttcgtatttcaatggatatcttaaaacaaacatcagaaacttatcgtaagatcaggaatacattgcgtttcttgattgcaaatacttccgattttaatcctaaacaagatgcagtagcctatgaaaatttaggtgccgttgatcgttatatgactattaaatttaatcaagttgtggatacaatcaacaaagcttatgctgcttatgattttatggcaatttataaagctgtcgttaacttcgtaacagttgatctatcagcattttaccttgattttgcaaaagatgtggtttacattgaagcggctaacagtccagaacgacgtcgtatgcaaactgttttctatgatattttagttaaacttacaaaacttttgactccgattctaccacatactgctgaagaaatttggtcatacctcgaacatgaggaggaggagtttgttcaattagcagaaatgcctgttgcacagacattctctggtcaagaagaaattcttgaagagtggtcagcattcatgacgttacgaacacaagctcaaaaagctctcgaagaagcacgtaacgctaaagttattggtaaatctctagaagcacatttaacaatttatgctagtcaagaagtgaaaacgttattaacagcgttaaatagcgatattgcactcttgatgattgtctcacaattaacaattgctgatgaagcagacaaaccagctgactcagtatcatttgaaggtgttgcatttactgttgaacacgctgaaggtgaagtctgcgaacgctcacgccgtattgatccaaccacaaagatgcgttcgtatggtgtagctgtttgtgatgctagtgcagcaattattgagcaatattatcctgaagcagtagctcaaggttttgaagcttaataaaaattatttaacgctatattttgacaaatatcttaccagttttaatggaagaaattggtaagacatttgtttagtagtcatcaaaaaagaagccttgattaggcttcttttaattatgctgttgttggatatgaaatttcaattaacttggcagtatggagtgatttcatctgctcttgaataataatagattgatctattttacgctttaagaagaactcacgaatagcttctaattcttcatctttgatagcacgatatttgtttgaaattaataattcataatgtttaggtgcttttgtaaaaacgacatcggtgttgccagctgaatagacttccactaattttgcatctgtattttggagttgatttcgaactagttcaggatgactactggttgtattaattagtctcataactattttccccctgattcttattaggtttattataacactatttaggaagaaaggtatgaattatttcctagaatggtgatttttttcccaagcttggacaccccatctatggcttcctcgttttagcttttctttagcttcttggataggaaaccaggctagatggttgaaatcttctagtggcgcttgatccttatgataggcagtaacttcataaatataggcgggattatagtagtaagtatcacggtgtctagagtaaaaatattcatcagcttgaccatagtaatggccaattgttgcggaataacctaattcttcaattaactcacgagttaaagcttctaggtgattttcattttcttcaatttccccacctggaagaaaccaagcaccattaggtgcctgtactaaaataattttatcatgagttggatttggaataatagcatagacaccaaatcgtgacctatagtttacattatctattttttcaccgaaagtaggattagtcatagttctctctcctgattgtgttttatgattttaaaagctttaattattttttatttattatactaaaatttttggaatatttccttaataattgtattaaaatttaaagacgaggtaggagagaaacagctttatagaggctattattttttgagaagagtgtgaaaaaaggttgagtttcttactcaaccttttgtactttcttcagtttttttagaagattttattatgatatttccattgctagtcataatagcacgaagttctttttcgcttggattctcaagatagtaatctgtgatagcatcttcaatatgttcttgaatggtacgacgtaatggacgtgctcccattttgggatcgtaacctaaatcaaccaatttttctttcactttatcagtgacatctagatgaataccattgatggcgagacgtgcattaacgtcagataacataatatcaacgatattgaggagattctctttatctaaagccttgaattcaataataccgtcaaagcggttcataaattcagggctgaagaagttacctagttgacctagtacggaattcgttctaccttctcgtgaggcaccaaagccaacgcttgcttcagttttaccagaaccagcatttgaggtcatgatgataatggtatctttaaaactaacagttcttccttgtccatctgttaatcgaccgtcatcaaggacctgcaagaacatatgcatgacatcaggatgagctttttcaatttcatctagaaggatgagcgagtaaggatttcgacgaaccttttcagttaattgtccagcttcctcgtatcccacgtatcctggaggcgctccgactaatttagcaacagcatgcttttccatgtactctgacatatcaaaacgaatcatactatcagctgaaccaaagagctcaattgctagttgtttagaaagttcagttttaccaacgccggttggtcctacaaataaaaaggaaccaataggacggtttgggctaccaagaccaactcgattacgacgaatagcttttgcaatcttaacgacagcgtcatcctggccgatcacatgttgtttcaagtcatctgcgagattaattaattgagattgttctttttcttttaaatcaccaacagggatattcgttttttcttcaatgatgtgctcaattgttttttcggtaataataggtgtatcttgatcgtcgaccttttgttgttgcatttctttatattttgcaatctggtcacggaagtaagctgcacgttcgtaatcttcttcacgagtcgcttgcgcttttaaattttctgcttcaatgagacgttgatcaatttcttttggatcaacaaaatttagtgttaggttcattttagaaccagcttcatctaataagtctattgctttatcaggtaaaaagcggtcctggatataacgattagatagtactgcagctgcttctatggcatcattattatattttacatgatgataatcttcgtattttttttggatacctttcaaaatagtaatggtttcttcaacagaaggctcatcgacttttacaggttgcatacggcgttctaaggcagcgtccttttcgataatacgatattcattgagagtagtagcacctactagttgtaattctccacgtgcaagggcaggttttaaaatattacctgcatccatactaccttcgccagctgtaccagctccaactatttcgtgaatttcatctatgaatagaataacatcttgacgttgacgaatttcttccatcaacttttgcatgcgttcttcaaattgaccacgaatgcccgttccttgtactagactcacaacatccaaacgaataacttgtttgccttgaagtttatgaggcacattaccatcaacaattttctgagcaagtccttcaacaacggcagttttcccaacgccgggttcgccaataagtacaggattattttttgtacgacgattaaggatttcgataacacgaataatttctgagtcacgtccaataacagggtcaatatcaccatggcgggctatttcagtgacattgataccaaattcttctagaatccctttggcttgagaaggagttgcagtttggttgcgattattatttcgtccattaccgtttcctccacctcggtttcctcctgattgtgtaggaggagtgtttggtaaatcttggccattaaaggctctgaaattatttaaatctccaaagaaatcatcaaagaaaggattgatgccaccaggcgcatgtgaaacatgatttaaacctgaaaaaagtggattattagggtcagttttaataatttggtagcaattttgacaaagatcaacttgcttttgttttccattaacatttgtatacaaatgaatagttgattcgtttagtttgcagttttgacagagcataggctacccctttcttatgacatttaactattgatgtgtatatagtcaaatatagtcaaactttatgcttttattatagcacctaaagcctagaaatcaagaaaaaagttctgtttttagcactgaatatattagagtgctaaattgaaaaatagatgactactgagaaaaatcgttatttgcggattttagacgataaaatcgttaaaaagttagtaaaaatgttgcttttcatgttgctttggtcacttttgtgttaaaatagaaaagactagaaaatatataggagtaagtaagatggaatcacatttagtgagaatcatcaatcgcctcgaattaatggcgactgatggtggtaatttaaaacgtaattttgaacgtgaaggtgttgttgtagcagaagtatcttttagtaatgaccctgaaaacggtcctgttttcacattacgtgatgtagaagcgcgtgaatcatattcatttgacagcattgaccttatcgcaatggaaatttacgatttattatactgataattataaaagaccttgaaggtcttttttttatatctaaatatacagtaaaatagaataaaaacaaaaatatttatctaaacttgtatttttattctttgtgtgatagactattggcaattacttttttaggagatgtcaatgaatttttcatttttaccacaatattggtcctattttaattatggtgtgatggtaaccattatgatttcaacatgtgttgttttttttggaactattataggtgtgttaattgctttagtaaagcgtactaatttacattttctcacaatattagctaatttctatgtatgggtatttcgtgggacaccgatggtagttcaaattatgattgctttcgcatggatgcattttaacaatttaccaacgattagctttggtgttttagatttagattttacacgacttttacctggtatcattatcatttccttaaatagtggtgcctatatttcggaaattgtacgtgcagggattgaggctgtaccatctggacaaatagaagcagcttactcgttggggattcgacctaaaaatacacttcgctatgttatcttaccccaagcttttaaaaatattttacctgctctagggaatgaatttattacaattattaaagatagtgctctccttcaaactattggtgtcatggaattatggaacggagcacaatcagttgtaacggctacttactcaccagttgcaccgttattatttgcagcattttactatttaatgttgacaacgattctctcagctttgttaaaacaaatggagaaatatcttgggaaaggggtaaaaatagatggttgagccaattatttcaatacaaggacttcataaaagttttgggaaaaatgaggttttaaaaggcattgacttggatattcatcaaggagaagtagtggttattattggcccttctggctctggtaagtcaacatttttaagaacaatgaatctcttggaagtaccaacaaagggaacagtgacttttgaagggattgatataacagacaaaaagaatgatatttttaaaatgcgcgaaaaaatgggcatggtttttcaacagttcaatctatttcccaatatgactgtactagaaaatattactttatcacctattaagacaaaggggctttctaatcttgatgctcagacaaaagcatatgagctacttgaaaaagttggactcaaagagaaggctaatacttatccagctagcttatctggaggacaacaacaacgaattgctattgcaagaggtcttgcaatgaatcctgatgtccttctttttgatgaacctacttcagctcttgatcctgaaatggtaggtgaagtcttgactgttatgcaagatttagctaaatctggtatgacgatggttattgtcactcatgaaatgggttttgcacgtgaagtagcggatcgtgtcatttttatggatgcaggaattattgttgagcaaggggcccctaaggaagtatttgagcagacaaaagaaatccgcacaagagatttcttaagtaaagtattataatttcattgtctaaaacaacttgttttagacttttattattccattgttatgagtaaattgttactgtattgtttggaagttggtaagtctatatataatgtagactaagaatgatagggtgatgaaaaaaatttagatgctttaaatatattaagtgtagttaatttataaaataagttgactttataaggttaatttgatactattcagttagctcctgaagaactaaaatctcttatcatggagctgatttttaccattttggtcttagaataggatgtctcatatgaattataaagagatttatcaagagtggttagaaaacgactcactcggtaaagatattaagtcagatttagaagctattaaaggcgatgaatctgaaattcaggatcgtttttacaaaacattagaatttggaacggcgggattgagaggtaaacttggagcaggaaccaatcgtatgaatacttatatggtggggaaagcagcacaagcattagctaatacgattattgatcatggccctgaagctattgcacgtggaattgcagttagttatgatgtccgttatcaatctaaggaatttgcagaattaacttgttccattatggcagcaaatggtattaagtcttatatttataaagggattcgcccaacaccaatgtgctcatatgctattcgtgctctaggatgtgtttcgggtgtgatgattactgctagtcataatcctcaagcttataatggttataaggcatattggaaagaaggatctcagattttagatgatattgctgatcaaattgccaatcatatggatgctataaccgattatcagcaaattaagcaaataccctttgaagaggctctggcaagtggttcggcaagttatatcgatgagagtattgaagaagcatataaaaaagaagtgcttggtttaactattaatgatactaatattgataagtcagtccgggtagtttatactcctttaaatggcgtaggaaatttacctgtgcgcgaagttttaagacgccgtggttttgaaaatgtttatgtggtacctgagcaggaaatgcccgatcctgattttacaacggttggctatccaaaccctgaagttcctaaagcatttgcctattcagaatctctaggaaagtcagttgatgcagatatcttacttgccacagatccagattgtgaccgagtagcattggaagtcaaagatagtaagggagaatatattttcttaaatggtaataagataggggcacttctttcctattatattttttcacaacgatgtgccttagggaatttgccacatcatcctgtattggtaaaatccattgtaactggtgatctatcaaaagttattgcagataaatataatattgaaactgttgaaactttaacaggatttaaaaatatttgtggaaaagctaatgaatatgatatctcaaaggataaaacttatctctttggctatgaagaaagtattggtttttgctatggcacttttgtacgtgataaagatgctgtgagtgcttcaatgatggtagtagaaatgactgcctattataaagaacgagggcaaacacttttagacgttttgcaaaccatttacgataaatttggctattacaacgagcgccaattttctcttgagttagagggtgctgaggggcaagaacgtattagtcgtattatggaggattttagacaggacccaatattacaagtaggtgagatgacattggagaattctattgatttcaaggatggttataaggattttccaaagcaaaattgtttaaaatattattttaatgagggttcatggtatgctttaaggccgtcagggacggaacctaagataaaatgttacctttatacgattggttgtacagaagcagatagtttatcgaaacttaatgcaattgagtcggcttgtcgtgctaaaatgaatagtactaaataagtcatatgtaaaaaggcgatgagggattcattgccttttctattgattaaaattgatacaaaatgaatagcgatataaaatagcataatcgctattttttgatataatatagaaaaaacggatgaagaaggagtatcaatgactgaattaatagatggtaaagccttatcacaaaaaatgcaggctgagttagggcgaaaagttgaaaggttaaaggaacagcatggtatcatacctggtttagctgtaatccttgttggggataatccagctagccaagtgtacgttcgaaataaagaacgctctgcattagaagctggttttaaaagtgagactctacgattatctgaatccatttctcaagaagaactgattgatattatccatcaatacaatgaagataaaagtatccatggtattttagttcaacttccgttaccacaacatattaacgataaaaaaattattttagcaatagatcctaagaaagatgttgatggtttccacccaatgaatacgggtcatctttggtcaggacgaccgatgatggtaccttgtacgccagctggtattatggagatgtttagagagtaccatgtggatttagagggaaaacatgctgttatcatcggaaggtccaatattgttggtaagccaatggcacaacttctccttgataaaaacgcaacagttactttgacacattcaagaactcgaaacctttctgaggtaacaaaggaggctgatatccttattgttgcgattggtcaggggcactttgttacaaaagacttcgttaaagaaggtgctgtggtgattgatgttggtatgaatcgcgatgaaaatggtaaattgattggagacgttgtatttgaacaagtggcagaagttgctagtatgataacacctgttcctgggggcgtaggacctatgacgattacaatgcttttggaacaaacttatcaagcagctcttagaagtgtgagtctatgattgttggtgaacaagaagcgagggcgttaattaagccacgccctaaatcaagccataaaggtgattatggtagtgttcttctgataggaggtttttatccctatggaggtgctattataatggcagctttggcctgtgtcaaaactggtgcaggattagttactgtagcaacccaaagttgcaatatcccctctttgcatagtcaactaccagaggtaatggcgtttgatagtgatgattacaaatggttggaaaaatcaattgttcaaagtgatgttattgtaattggtcctggattaggagtatcagaatcatctcgaaaaattttgaaccagaccatggagaagattcaatcacatcaaagtgtcatccttgacggatcagccttgactctgttatcagaaggtgcgtttccgcaaacaaaggctaaaaatttagtgttgacacctcatcaaaaagaatgggagcgattgtcaggtatcgctgtatcgcaacagacaaaagaaaatacccaaaccgctcttaaatcttttcccaaagggacgattttagtcgctaagagttcgcatacgcgtatttttcaagatttagacgaaaaagaaattatagtaggaggtccttaccaggcgactggagggatgggggatactttgtgtggtatgattgcaggtatgttagcgcaatttaaagaagcctctcctctagataaggtatcagtgggagtttatctacattcggcaattgctcaaggattatctaaagaagcctatgttgttctaccgacaacgattagtgatgagattccaaaagaaatggctagactatctaaataaaaaataagtagagaggtgttagcatgacacttcttttgctttatcgagctatttgtagagcaaataggtattttttaagtttttttggtataatgaagttaataaaactctcatgaggaggtgctatgtcagactatttatccgtgtcgacactgactaagtatttaaaattaaaatttgacaaagacccttatttagagagggtttatttaactgggcaagtgtctaattttcgtcgtcgcccaaaccatcaatatttctctttaaaagatgataaatcagtcattcaggcgacaatgtggtcaggtcacttcaaaaaattgggttttgaattagaggaagggatgaaggttaatgtagttggccgtgttcaactttatgaaccaagcggctcctactctattattgttgaaaaagcagaaccggatggtataggagctcttgctatccaatttgaacaactaaagaagaaactctctcaagcaggttattttgatgatcgtcataagcaattaattcctcaatttgttagaaaaataggagttgtgactagtccaagtggagccgttattcgggatattattacaacagtatctcgtcgatttccaggagtggaaatattacttttccccacaaaagttcaaggagagggcgcagctcaggaaatagcacaaactattgctttagctaacgagaaaaaggatttggatctattaattgttggccgtgggggaggttctattgaggacttatgggcatttaatgaagaatgtgttgtagaagctatttttgaatctcgtcttcccgttatttctagtgtcggacatgaaactgatacaactttagcagattttgtagccgatcgcagagcagcaactccaactgcagcagctgagcttgctacaccggttactaaaattgatatcttgtcttggattactgaacgtgaaaatagaatgtatcagtctagccttcgtcttatcaggacaaaagaggagaggttgcaaaaatcaaagcaatcagttatttttaggcaaccagagcgtctatatgatggtttccttcaaaaattagataacctaaatcagcagttaacatattctatgcgtgataaactacaaacagtaagacaaaagcaaggtttgcttcatcaaaaactgcaaggcatagatttaaaacagcgtattcatatttaccaagagcgtgttgtgcaaagtagacgactattatcaagtacaatgactagtcagtatgacagcaagctagcacgttttgaaaaggctcaagatgcgcttatatcattggatagttctagaattgtagcgcgtggttacgctattatcgaaaaaaaccatactttagtatctactactaatggaataaatgaaggagatcatttgcaagttaagatgcaagatggtcttttagaagttgaggtgaaggatgtcagacaagaaaacatttgaagaaaatttacaggaattagagacaattgtctcacgtttagaaacaggtgatgttgccttagaagatgccattgctgaatttcaaaaaggaatgcttatttcaaaagagttacaaagaactttaaaagaagctgaagagacgcttgtaaaagtgatgcaagctgacggaacggaagtagaaatggatacttgatggttactattgaaaaaattgatgaagctattcatcgttattacaaacagacacatagtgtcgtttctcctgatttgattaaggctatcctctactcagttgatggaggtgggaaacgtattcgtccacgcatccttttagaaattttagagggatttggagttgaactaatagatggtcattatgatgtggctgctgctttggagatgattcacaccggctcattaatccatgatgatttaccggcgatggataatgatgattttcgtcgtggccgcttaacaaaccataaaaagtttgatgaagctacagcggttttagctggagattccctttttttagacccatttgatttagttgtaaaagctggttttaaagctgatgttactgttaggttaatagagttattgtctatgtctgcgggtagttttggcatggttggtggacaaatgttagatatgaagggagaaaacaaagttttatctattgacgatttaagcttgattcatattaataaaacgggacgcctgttagcttatccctttgttgcagcaggtattttagctgagaagtcggaagaagtaaaaggaaaactgcatcaagctggccttttaatcggtcatgcttttcaagtacgtgatgatattttagatgtgactgctagttttgaagaattggggaagacaccaaataaagacattgtagcagaaaagacaacttatccaaatttattgggtttggataagtcacaggaaatacttgatgatactttgaaaaaagctcaggcaatttttcaaaatctagagaaaaaagctaactttaatgctagaaaaataatagatataatagagggattacggttgaatggctaaagagagggtagatgttcttgcctataaacagggactttttgatacacgagagcaagcgaaacgtggtgttatggcaggaatggtgattaacgttatcaatggagaacgttatgataaaccaggtgaaaaggttgcagacgatactgaattaaaactaaaaggtgaaaaactaaaatatgttagtagaggtggattgaaattagaaaaagctttacaagtttttgaaatttcagttgcagataagctaactatagatattggcgcctctacgggtggttttactgatgttatgctacaatcaggagcgcgtttagtttacgcagtagatgtaggaacaaatcaattagtttggaagttacgtcaggatcatcgtgttcgttctatggaacaatataattttaggtatgcccaaaaagaagatttcaaggagggactgcctgaatttgcatcgatagatgtctcatttatctctcttaatttgattttaccagctctaaaagaaattttagtggatggtggacaagtagtggcattaattaaaccacaatttgaagcaggtcgtgagcaaattggtaaaaatggtattgtcaaagacaagttggttcatgaaaaggttttgacaacagtgaccaatttcacgaaagattatggatatacggttaaacatcttgatttttcgcccattcaaggtggacatggaaatattgagtttttaatgcatttgcaaaagtgtcaagatccacaaaatcttgtgcttgaccaaatacaagatgttatagaaaaagcacataaggaatttaagaaaaatgaagaagagtgaacgtttaaatttaattaagcaaattgttcttaaccatgctgttgaaacacaacatgagttgttacgcagattggaagcttatggggtaactctaactcaagcaactatttcacgtgatatgaatgaaattggcattataaaagtgccatcagcaaaaggtcgctatatttacggtttgtcaaatgaaaacgaccctatctttacaactgctgtggcaaagcctattaaaacaagtattttatcaatatcagataagctactaggtttagagcaatttatcaatattaatgtcataccaggtaacagtcaattaattaaaaccttcataatgtcacattgtcaagaacatatttttagtttgacagctgacgataatagtctccttttgattgcaaaatcagaagcagatgctgatcacattcgtcaatcaatgattgcaatgttggagaaaaaagattagtagaggaccttatgcttttagaaatttctattaagaatttcgctattatcgaagaaatttcacttaattttgaaacaggaatgactgttttaactggtgagactggtgcagggaaatctatcattattgatgctatgaatatgatgttaggatcccgtgctagcgttgaagtgattcgccatggtgctaacaaagcagaaattgaaggatttttctctgttgaaaaaaatcaatcattagtccaattattggaagaaaatggcattgaattagcagatgaattaattattcgccgagaaatctttcaaaatgggcgcagcgttagtcgaattaatgggcaaatggtgaatttgtcaacactaaaagctgtggggcattatttggtagacatttatggtcagcatgaccaagaggaactaatgaaacctaacatgcacattctgatgttagatgaatttggtaatacagaatttaatgtcataaaagaacgttatcaaagtctttttgatgcttatcgtcagcttcgtaaacgcgtattggataagcaaaaaaatgaacaagagaataaatcacgtattgaaatgctagaatttcaaatagcagaaattgagtctgtagcccttaaatcagatgaagaccaaacgctactcaagcaacgtgataaattaatgaatcataagaatattgcagatactttgacaaatgcatatcttatgttagataacgaagagttttcaagtttatcgaatgttcgttctgcaatgaatgaccttatggctttagaagaatttgatcgagaatataaagatctttccaccaatctttcagaagcttactacgttattgaagaagttactaaacgtttaggtgacgttatcgatgatttagattttgacgctggtttactacaagaaattgaaaatagactagatgttattaacacaataacgcgaaaatatggcggtgatgtgaatgatgttttagactattttgataacattactaaagaatatagtctattgacaggtagtgaagagtcctcagatgctttagaaaaagaattaaagattttagaacacgatttgattgaatcagcaaatcaattaagtttagagcgccataagctagctaaacaattggaaaatgaaatcaaacaagaattaacagagctttatatggagaaagctgatttccaagttcaatttacaaaaggaaaatttaataaagaagggaacgaaatcgttgaattttatatttcaacgaatcccggagagggctttaagccattggtaaaagtggcttcaggaggagagttatctcgattgatgttagctattaaatctgctttttcacgtaaggaagataaaacttccattgtatttgatgaggtggatacaggagtttctggtcgcgtggcccaggctatcgctcaaaaaattcacaagattggtagtcatggacaagttttagcaatttctcatttagctcaggttattgcaatagcggattaccaatattttattgaaaaaatttccagtgactcttcaacagtttcaacggtaaggcttttaagctatgaagaacgtgtagaagaaatcgctaaaatgttggcaggaaacaatgtaacagacactgcacgtactcaagctaaagaattacttggtagttaactttggtaacgtctttaaaaagctaacattgttaggagaaattaatgttgatacacttaaattttgttataataagggtattgaaatattaaagtatagaataggataggatatgagtaaaatcaaaattgtaacggattcttccattaccattgaaccagaacttattaaagagcttgacattacagttgttcccttgtcagttatgatagatggtaccttgtattcagacaatgacttaaaagcacaaggggaattcttgaacctaatgcgtggaagtaaggaattgccaaaaacaagtcaaccacctgtaggtgtttttgcagaaatttatgaaaaattaatgaatgaaggtgtggaacatatcattgcaattcatttaacgcatacactatcaggaactattgaagcatcacgccagggagctaatattgctggtgcagatgttacagttattgattctacttttacagaccagtgtcaaaaattccaggttgtagaagctgcgaaattagctaaagagggagctgatttagataccatcttggctcgtgtggaagaagtacgccagaagtcagaattatttattggcgtatcgacccttgaaaatttagtaaaaggtggtcgtattggacgtgtaacgggtcttctaagttcattgcttaatataaaagtaattatggagctaacaaaccatgaattagtaccgattgttaaaggtcgcggtctaaagaccttcagcaaatggttagataattttgttgaaagtgcccaaacacgaaaaattgctgaaattggcatctcctactgtggtaaagctgatatggctaataactttagagaaaaactagctgttctaggtgctcctatatccgttttagaaactggctcaatcatccaaactcatactggtgaggatgcatttgctgttatggttcgttatgaataagaaaaaaatacttaccggactttctttttttctggtaagtcttcttttatcttttgggattttttccttgatcattccaaaatcaaatcctaaattaacaaaaaaagacttcctaacaaagaaagttatcccacttaactatgttgctcttggagattctctgaccgaaggtgtgggcgatacaacctctcaaggtggttttgttccactgctatcagaatcactccataatcgatactcttaccaagtgacttctgttaattatggtgtgtctgggaatactagtcaacaaattttaaaacgtatgacgacagatcctcaaatcgaaaaagatttagagaaagctgatttattgacgctaactgttggtggtaatgatgtcttggctgttattcgtaaagagctcagtcatttatcactaaattcctttgagaaaccagcagaagcatataaggaacgtttgaaagaaatccttgcaaaagcaagacaagataatcctaaattgcctatttatgttttaggcatttataatcctttttacctaaactttccacaattaactaaaatgcaaaccgttattgataattggaataaagctacaaaagaagtagttgatgcttcagaaaatgtttattttgtcccaattaatgaccgcctttataagggaataaatggtaaagagggtattacagagtcatcaaatagtcaggcaagtatcactaatgatgctctctttactggagaccattttcatcccaataatattggctatcaaatcatgtctaacgccgttatggagaaaataaatgaaacaagaaaaaactggccgtaatttaaatttctggaaatgggcatttctcttattgttggcaattaacctttccttcacagcagtgattgcaagtcgcttaattcaagtacgtgagcctaatacaggaaaaatttcgactggggtacaagataaagtaaaagtaggtacttttacgaccaataagtcgcaactgaataagacaattgcactttatttaaaacaatatcaaactaagaagatgaattataagatttatgctgcttcatcttctatactatttgaaggctcttatcaattattaggttatgaagtgcctttatacatctattttgaaccttatcgtttaacaaatggcgctgttcaacttaaagtgacctcattttcagtaggaactcttccgcttccagaaaaagatgtgttacaatatataaaatcatcttataaattgccaaactttgtagatataaaacctaaaaaatcggttattaatattaatttgcaagatttaaaaaataaagaaggtatttatttgaaagcgactgcaattgatttagtaaacgataattttagtttcgatatttttaagaaaaagccctaaaatgacgttaaatacttgaccttaagcctttttttagatatcatataatctgttaaaacttatgttgtataagtttagaatttatttggaggatttgttaacatggctaacaaacaagatttaattgcaaaagtagcagaagctacagaattaactaaaaaagattcagcagcagcagtagatgcagtttttgcagctgtagcagattaccttgctgaaggtgaaaaagtacaattaatcggttttggtaactttgaagttcgtgaacgtgcagctcgtaaaggtcgtaacccacaaactggtgcagaaatcgaaattgcagcatcaaaagttccagcatttaaagctggtaaagctcttaaagacgctgttaaataattcgtctagaaaaaccttgtcatatcaatgtttattgatagcgacaaggttcttttttatatccaatactcaataaatgactagagagattaaaggaatttagagtttcaaatgtgttagagcatacccttgaattatcttaactgtgatgttataattcctaaaagataagttaaaagagaggttgcgaaagagaatgtcagaaaaagctatactattaattatccttattgcttttgttattatcgctattataaagatagctctgttaaagttatatatgaatacgataaaacctaaagtagataatgaaggaaacatcataacaaagcctgtaaaggatgatttaacacccgaggaacgtgaagaacgtgaatttgataaagattggtaaaatcaatataaaagagcaaacaaggtttgctcttttattatttttaaaggtaattaagttgtcctcgaaaatcctccaatgattgatagcctttatcagccattatttcttttaattctctgcttacacgctgaaaaatttctggtccttctttttgtaaagcggttccgatttggaccatactagctccacatagaatgtgttcaaaggcatcacggccgtttttaacaccacctgttccgataattttaattgaaggatttaaacgtttgtagaaagcatggacgttagctaaggcggtaggcttgataaaatccccaccgatacctccaaagccatttttaggctttataacgacagtttcatcatcaataacaagtccatttccgatagaattaacacagttaataaaagctaaaggatatttgttaaaaattgtagctgcttgatcaaagtgaacgatatcaaagtaaggtggtaatttgatgcccaatggcttttgataatagctaaagatttctgaaaggatgaggtcagtcatttcaaaatcataagcaatttgaggttttccaggaacatttgggcacgataaatttaactctattaggccattgtaactactgttttcaacctttttaagaataatatgtgtctcttctggtgataaacctactaatgataaaacgtgatttttgctattgtcttgatcttgtaattcagtcacgaaatcaagataatagtcaatacctttattagggagtcccatagaattaattgatccccagtcagtatctgcataacgtggttgagggtttccctctctagcttcaagggtacctgtttttgtaacaaaggaaccagcttcagaattttcaatagctaataactcttccttagtcatacaataaatacccgctgcattcatcaaacaattgtcaaaactaaaaccagcaatttccgtttttagcgataccataatatcctcctgaagataaatttttactattttatcacttgattaatagagctgcaagaaaataatgataatggtaataaaatttcgctaaataacgaacattattgtttgtataaacaataatagtaaagaaataaatgatgctttctataatgcataaaaaataagcttatgtaagcttattttttatgttcggcgtaagattttctttagtaattgaatactcttatattttaatggatttggatagtagcggaaagtacccattttacgaacaatgtaaccattaaaattctgtttaaagcgaagtacgccatctgaaccatcaaaatttccttgaatacctaaaaaattatagaaagttgattgacgctttaaagcctcttgcataacatattcttgaagaactgcaggcgcataaaatttattaaattctgtgtatgagccagagaaaagatagacagtttctttcgggctataaataaagaggctaccagctaaaacaacatcttgatttccaaatttttgaataaaaggttcgacttctttgcgacgtttatctaaactagctagttgattgacaagctcagtacgttgacgatggtatttggcagaatctgtattattttgatggcgattatcaaggactgtaatctgttcttccaatttctttgcatttaattgtaggttatgatcatattccctaaagtttagagttgcaatgacaaattccgccttatctccgaaactatcataaaaatcttgataataatctagagatttatccatatagtcccggcgatcagaagtagaagaagtaatatccttaaagatatgtagttcttcccgcttgaggacacgtatttttataccaaaagacatggcttttttaaccaaggggcgtccttttttagagaaagatttaagaagattttgaggagtgataccttctagatttttaacataatgccaatcaggttcaccgccaggataaccaatatgaagcccatcgtggtgataacctatactagtcaggtcatcaataagataggtgttcggtgcacctttaggcttaccttcaccagtaaactcttggtaggtatcataaggtttaattaataattctaaagcgccctgagatttggcatagttctgtagttctttataaaaatgtttcagatatttagaattggaatgggctggaccagaattgacttccatatgaagtccaccagtcattgggatggtataaacaatactgatgatttccattttcccatcgatttggtagcccatgtaggtaatgtcatacccacgtttttttagaagctttgccatctcaggggtttgcataaacgattgtaaatcgtaatttcctgaataactttcgaactctttagctgttaattctttaagcgccataaaagtatcctttcctaactagctattacgttttttgcgtaaggcatagacataattagaggctttataaagcaatctgttcactggaatgttaaattctccaataaattcctcaatgattggttcgaacttagacttaaaatgatataaaccaccagataagtcattctcaatcccccccatattttgccaaatatttccacgttcaaaagccctttgagctgtttcaaaccaagtgtaaataggagcagaataagatttaaagtaatcgtccataccagcataaatattttctgatgtattaccaaattctagagtgagggttgcagccaatggaataatgtctcggtcataggctttttgagcttctttgagaaaatcaatttctttatttaatcgatcaatcgtaccttggtgttgtttaacttttttctcacgattaagttcaagtgattttattctttcagattgggctatctgacattctttttctattttttctaatcgttttgcaacatctagcgaagccattgtgatgtatgagttattaggatacgtatcaaggagtttttggtagtagtcaattcctctaagatttatccctttacggtcttccgtttttttcatcaactctgcaaaatcttcaagtagttcatggctaccaaattgtatatctactcccttatttttggaagttcgaatagcttgacgagtttttttagacattttatcaagtccaaattgattagcatataggtttgcctgaaaacgtggttggatagtatgagctaaatctgttgtccgaccagtccaatcagcacctgcacgctgtaaatgatcaatggcgattaacccttctttttcatcgggcgaattttcaaaatctttggcattgaccatttttaaatagatgagaggatcacacttgataaagagagctctttgttttttgccaaaagctttaaggtccttaaggaccttagttacaatatctagattggagtaatccatgattggtccacgcggaatatatagcatggagaagccaagaggaagtgatttgatgagaatactagcgctggcaatttgggtttcaccgtcaaaaaagccaagtaattgactaccccagttgtcttttactttgggccaattagaagattgaagtaggtttgtttggttggattcgctcacaaagcgatcgtgttcgacagcggtaatttctctatacatgagtttcctttcttagtgagagtgtctttgtttttttcgaatagtataggctaggttggccaatttatataataatggattgattgctagattaaactcgccaatatattcttcaaacattggattgaagttacttttaaattttgttaaaccatcgttaagacttccctcgacaccgcctagattagcagatacaatatcgtttttgaaagcatcttcgaacaccctagcattcaagagatactgtggataaaatttacggaagctatcatccataccagcatacaacatctccaggacattgccaaaacgaatggacaaaattcctgcaatgacaggctcatctggatatttcttgctaaactcctgaaattcaaggatatattgtttaacagaagcttcttgttgatttagccttgtcaggcgacttttttgatgggatggagtttctgataaatctttttggatttgaagaagttgttctttaaattgcgctaatcttttaggaagattgactttagctaaatagagataggcatcttctccataaattgtcattagttgatggaaatagttttcattacgtaaagctacacctttacgattctcggttaatgctacaaccgtggcgaatttaggtaaatcatcaatgttggcacgataaatttgaacaccgcgatgctttgcatcttttatcagacgtttagtgtgttttggaaagttttcttctatatttgctttggtatagatattcgcttgaaaacgaggttggatggtttcggaaatggctttcgttggacctatccattgggcacctgctgacttaagattatcaattgcctgtctactttcatctatctcttcggcgacattctcttctttaaggtgatattgacgtagaagaagtgctggatcgaattttgcaaaaacagcacgtttctttcgtccaaagttttttagtgtttttaacacaaagttaactaattctttattgctgtagtccataataggtccacgtggaatataaagcattgtaaaaccaagtggtaatgatttaattaagatgctagctacagcaactaattggtcatctttataaaagcctaaacgttcattttgccaatttgattttacttgtgcccactttgaagagtggaggagattggtttgagacgatgcaatagcaaaggcatcatattctttttcggatattccaacggtaacatgatacatcagtttattacccattcacgtagtgcgtaggctacgccactttcctcgtttgatttggtgatatattttgctattttttttagttcaggattgccgttttgcataacaacaggatttccaacaacttcaagcatagcacggtcattttcttcatcaccaatagccattgtttgatctacagttaatcccattttctctgcaaggtggagaagtgcagtgcctttattaacgtttttgggtaaaatttctaaataaaaaggagttgattttacaatagtgtagttatcgagaactttttttggaattttagcaattgctgcatctaagatgtcaggttgatcaatcatcattagtttaatgatttctttgtctcccatttcttcaggagtacgatagaagagcggcatattaactaaagttacttcgtgtattgtatatttaccaatatcacgatttgctgtgtaaattccttcttttgtaatggcgtgcatgtggacgcctaatttacgcgctaacagttcgaaatccagatagtcttcataggttaaggtttctttgatgatgtcatctcctgtggctgtgtcttgaactagaccgccgttaaaggtgataacataatctccctcttcattgagtttcaattcttctaaaagatcttggactccgatgattggacgtcctgtagcaataacaattttaacgccttttgattttgcttcttgaacagctttagccacttcaggtgtaatttcacgcttactatttaatagggtgccgtcaatatctacggcaacaagtttaattgaagtcattttatctcccactctttattcaatatcctaaaatactcaccttatatcttactaaaaaataaagggtttgtcatgaatggctattatctttcgtgagtgtcaaatgctcatttgtgatataagattgaaattcttcttttgtacttgaaaataggctatctaatgtcaacatttcttttggaaaataaaaacgttgatcaccataattagatccagttaatgcttttacaatcggtgataagcttgataattcagcaagttgtccattcttttggataatttgaatttctgttcgtggatttgaatgttcaggccgataaacatcgtaaggtaagtcaaaattagcatggacaccagtgtaataatcgggatcaaaaccaacctgtgagactagttctttcattttaactagattttctttatcagactcttcaaaggtaattgatttaaagacttttcgattgataaaacgattagctaaatctgccaaaatgttatcatcagcttgcatccaagattggaagtaagtattcattaccccatcatctagggctaaataatcttgtaaatcatattgatccgtgaagaaaggaataagatttggagaagtttgttcaaaaaaatcgcgatgggtatcaaataagaagcgagcacgttttagtaaattttgtaagagtaattccatagcacgactggctggatggaaataaacttgcatatacatttggaagcgactaacaatataatcttccacagcgtgcatcccgttacgagcaaaagcaattccagaatcggttggtctaataacgcgtaaaattcgtgttaaatcaaattgtccatagctagcagcagtgtagtaagaatctctgagaagatagtccattcgatcacaatcaatttgactagaaattaattgaacaacttgtttattggggtagctatgattaataacactagctactttatcaggaaaatcaggagccacctttcgtaaaatagcattaatctctgtggtaggattggtgatgatttcctgagtgtaagcttcatgatcagtattgaagagacgctcaaatgtatgagaatatgcgccatgtccgatatcatgtagtagggcggcagccatcgttagcagggactcatttttattccaaagatcagaataatgttcatcaaagatttctgtaactttacgagccagttcataaactccgagacaatgtgaaaaacgactatgctctgcaccatggaaggtaaaagaagtcgttgaggtttgtttaatgcgtcgtaaacgttgaaattctttagtgttaatcaagtcatatatgacttgattatttacatggatataagtgtgaacggggtcacgaaatactttttcattcatatatatattatagcaaaaattgaaacttgagtcagaaattggtagaatagaaggataaaagaagtgagagaagtcatgaaactagaaattaacaataacattcaaattgacaacgaaaccgaaatgattcatgagattcacgattgtcaatttattgaaaaaggaagttacgtttatttgaattatattaatgctgagggcgagagggtagttattaaggcaaatcatgaggaattgcttatgacgaggttttcaaatcctaagtctgtaatgcgttttcatcgtgaaacgcctgctttggttaatatccccactccacttggtgttcaacatttgattacagagacaagtcactatcagtttgatttgtcacagcaaaggttgcatatcaattatgtccttaagcaaacggagacaggagactgttttgcaaattatgaattaaggattcaatggtattaagataactaccattaacaaaagagtagtcgttatgaatttcgtttactgaagacgctgggatctctttatgagagccatttatttgataaactgcagtgtggtttatttcgactagatgaacttcgttttttcccttgagattattagtgatagcaaggataattaattgaaaaatggatttttttctgttacaatgattaacatatcaagggagtagcagacggtttaccgtggcaatgtcgtcattacgaaagaaatttccggcgttgtcttaaacagcgagacttgttttcataaaaacaggtctctttttgtttgtggagagaccaaaggaggaaaggttttgttaaaagaacagaaaaaatccttgttttacacacaaggtcaagaagaggttctaacgtctttagaatcttctcgtgaaggattatcaacgacagaagcgaaaaatcgcttagagatgtatggtcgcaatgagcttgaagaagggaaaaaacgtagtctaatagctaagttttttgaccaattcaaagatttaatgattattatcttactggttgctgcagctctctctgttattacggaaggtatgcatggcttaacggatgcattgattatcttggcggttgttatcttaaatgcagcttttggtgtttatcaagaggggcaagccgaagcagctattgaagccctcaaagatatgtcaagcccaattgcgcgtgttcgtcgtgatggtcatactattgaggtggattctaaagaactagttcctggtgacctcgttatgttagaagcaggagatgttgttcccgcagatttacgacttttagaagccgcgtctctaaaaattgaagaagcagctctaactggtgagtcagtacctgttgagaaagacatatctcaagtagtagcagaggatgcaggtattggtgaccgtgtgaatatggcgtatcaaaattcaaatgtcacgtatggtcgaggatatggtgttgttactaacacagggatgtatactgaagttggtaaaattgcggacatgttggcaaatgctgatgaatctgaaacaccattgaaacaaagtttagttcaactttctaaattattgacttacttaatcgtgattattgcggttattactttcttagtggggatatttgtccgtaaagaaggttggattgaaggattgatgacttcagttgctttagcagttgcagctattccagaagggcttcctgcaattgttacgattgtcttatcaatgggaacaaaaactcttgctaaacgcaattctatcgttcgtaaactccctgcagttgaaactttaggttctacagaaatcattgcatcagataagactggaactctgacaatgaatcaaatgactgtcgaaaaagtgtatactaatggtgttctccaatcatcttcggaagaaatttcagttgataataacactttacgtattatgaatttctccaacgatactaagattgatccttcaggaaaattaattggtgacccaacagagactgcactggtacaatttggtttagataagaattttgatgtccgtgaagttttgaaaaatgaaccacgtgtagctgagttaccatttgattcagatcgtaagttaatgtctacgattcataaagaatcagatggtcgctactttatcgcagtcaagggtgctcctgatcaattattaaaacgagttactaaaattgaagataatggcttggttcgtgatatcacggctgaagataaagaggctatcctaaataccaataaagaactcgcaaaacaagctcttcgtgtcttgatgatggcttataaatatgaaacacaaattccaagtttagagactgatattgttgagtcagatttagtattctcaggtttagtgggaatgattgaccctgagcgtccagaagcggcagaagctgttcgagttgctaaagaagcaggaattcgtccgattatgattaccggggaccatcaagatactgcagaagctattgcaaagcgtctaggtattattgatgcaaatgacacagaagatcatgtctttacgggtgctgaacttaatgaattaagtgatgaagagtttcaaaaagtatttaaacaatattctgtctatgcacgtgtttctcctgaacataaagtgcgtatcgtgaaagcttggcaaaacgatggcaaagtcgttgccatgactggtgatggtgttaatgatgctccatcgctaaaaacagcagatattggtattggtatgggaataactggtacggaagtttccaaaggtgcttctgatatggtccttgctgatgataattttgcaactattattgtggctgttgaggaaggacgtaaagtcttctcaaatatccaaaaatctattcagtatcttctttcagccaacatggcagaggtatttacaattttctttgcaactttattaggatgggatgtacttgcaccggttcaccttctttggattaacttggtaacagatactcttccagccatcgctcttggagttgagccagctgaaccaggagttatgacacataaacctcgtggtcgccagtcaaacttctttgatggtggtgttatgggagctattatctatcaaggtattttacaaactatcttagtacttggtgtctatggttgggcattgatgtatccagaacatgctggttatcgcatgattcacgcagatgcccttacgatggcctttgcaacgcttggtttaatccaattggtacatgcatttaacgttaagtcagtttaccaatcaatctttacagttggagcttttaaaaatagaacctttaactggtctattccagtagctttcattcttttgatggtgactattgttgttcctggatttaataaacttttccatgtaactcatttaagttcaacacaatggttaactgtagttatcggaagtttattgatggtagtgttaacggaaattgttaaatttatccaacgtaaattaggacaagacgaaaaagctatttagtttagctgataaaaaaactcacttagaatatctaagtgagttttttagcaatcaaatattgtcatagagttgcgtaattcgtcttcaaaatatttttttcgatagttttcaaaactatccaaatgcttaacggcattataccttttgctaagattccaggttaaattagggttatgattgggattctgattgacaaagtcaatagttaaattccattctctaatatatccaagtggtctagaatgataagtagtctctccaattttaacgtcgccaaatgagcggtgtgcatgaccaaaaacaacatctttgatatgatatttttggaataaatcatgataagcctgactccccaaaaaagcattaaaaggagagaatctaggatgagtcatcgtgaattgtttatggggaacaaagtgcatagcaataatgatatttgaagaatcgacttttgctaatatttcgtctaagcgttttaaaattgatgcttggatagttacatcattatttggacgttttaaacgtctatcaaaccaaaaagtcttttttaatttttcaacatccttgatgtctctattatttgaaaagctgtaatcataccagccatgaaaagctagtagcatttttttgtcaaatcgataggtttgaaagtcaagacgttggatttctgtttctgttaaatcaagcatatcatggtttcctaaattatagctaagtttaatatgcttttttaagttattgataaagggaagtgtatctttagtaaaatgattagatatatctccagcgatatggaggtgatcaattttttctttcttaagcaaattaattaacgttttcgtctcaaaggtagaaaaatgattgaggtcaatatgtaaatcactcatgatagcaagtttggtcataagggtattgtaccatattgtagttcaaagagttaaacagtaaatttttgaaatagttttagagtcattctataatagatatgtcattgtagaatgcgctttcataagtgtgtttagaagttttatatttaaggtgccttaaggaggtctcatgtctaatttttataagctcttgaaagaaaaatttcctcgaaaagaagatatcgtaacagaaatgatcaatttagaagctatttgtcaattacccaaagggacggagtattttattagtgatttacacggggaatacgatgctgttgattatctcttacggacaggtgcagggtctattagagctaaattattagactgttttgattggcagaaaatagttgctgttgatttagatgatttttgtatactgctttattacccaaaggaaaaattagccttcgataaaatgaacttgtcagcaagtgcttataaaacgaagttatgggaaatgattccgttacaaatacaagttttaaaatatttttctagtaaatatacaaaatctaaagtacgtaagcaattgtcaggtaagtttgcttacattatcgaagaacttttagctgagattgaccgtaacccagagaagaaaagctattttgatactattattgaaaaattatttgaattagaccaagtagaagatttaattatagtattgtcccaaacaattcaagttttgattattgaccatttacatgttgtaggggatatttacgatcgtggtaggtatcctgatcgtatcttgaataggttaatggcttttccaaatttggatatccaatgggggaaccatgatgtcacttggatgggagcagcatctggttcttacctttgtatggtaaatgttatccgtattgctgcacgttataataatattactttaattgaagaccgatatggtatcaatttgcgtcgcttggttgattactcacgccgttactatgaacctctaccttctttcgttcctatattagatggagaggaaatgactcatccagatgaactagacttgttaaatatgatacaacaagcaacagcaattttacagtttaaattggaagcccaattgattgacaggcgtccagaatttcaaatgcataatcggcaacttattaaccaggtaaattataaagatttaagtatatctattaaggaagttgtgcatcaacttaaagattttaatagtagatgcattgattcgaaaaatcccagtcgattaacaagtgaggaagaagagcttttacaacaattgatgatagccttccagacttctgaaagtttaaagaaacatattgatttcctatttgaaaaaggaagtatgtatttaacatataatgataatcttttattccatggttgcataccaatgcatagtaatggtgattttaaaagctttaaaattgcaggaaaaacttatggtggtagggatttactggatttatttgaaagtcaaatacgtctagcatatgctagaccagagaaacatgatgatttggcgacagatatcatttggtatctttggtgtggtgaaaattcttctctttttggtaagaatgccatgactacttttgagcgctattatgtttccgacaaagtaactcatcaagaaagaaaaaatccctactttaaactgagagataaagatgatatttgcactgctcttttacaagagtttgatttgcctaagtttgggcatattgtcaatggtcatacgccagtcaaagaaaaaaatggtgagcaaccgataaaagcaaatggtaagatgttagtaattgatggtggctttgccaaaggttatcagaaaaatacaggtttagctggctacactttgatttataatagctatgggatacaattaatttcacaccttccttttacatccattgaggaagttttaagtggaaccaactatatcattgatacgaagcgattagtagaagaagccaaggataggattcttgtaaaagatacaactattggacaaaagttaaccaaagagattaaagacttagatcacctttatcgtcattttcaggaatatgatgactagtgtttaagtaatttactaattgatatgtaggatttaatttttcagtttcttaccttgtctcttttattaaattgacttaaaataatattatggacataaaggcagaaattcaaaaattagcaaaagaaattggtatctctaaaattggttttacgacggcagataactttgattatttggaaaagtcattgcgtgcttctgtggaagaggggcgcaattcaggatttgaacataaagtcatagaggatcgtatctaccctgaaaggcttttagaatcggctaaaacgattatttcaattggcgttgcttatcctcacaaacttcctcagcaacctcaaaaaacatcttataaacgaggaaaaattacacctaattcgtgggggcttgattatcattatgtggtcggcgaaaagttagacagactatcaaaaggcattgaagagctctgtcgagattttcctttgcaacaaaaagcaatggtcgatactggagctttagttgatactgcagttgcccaaagagcaggtattggttttataggaaaaaatggtctagttatttctaaagaatatggctcttatatgtttttgggagaattaattaccaatttagagatcgagccagacaagcctgtcgattatgattgtggtgactgtcgtcgttgtctagatgcctgtccaacttcttgtttaattggtgatggctcaatgaatgccaagcgttgtctatcatttcaaacccaagataagggaatgatggacatagagtttcgaaaaaagattaaaacagttatctatggttgtgatatttgccaaatttgctgtccttataacaaaggtataaataatccattggcgacagagattgatcctgagttggctcaaccagaattaataccatttttgagtttatcaaatggacaatttaaagaaaaatttggtatgattgctggaagttggcgaggtaaaaatattttacagcgtaatgccattattgcgctagcaaatgctcatgataaaaccgcagtggtcaaattaatagagattattgataaaaataataaccctattcatactgcaacagctatatgggcattgggagaaattgtcaaaaaaccaaacgatgagatactggagtttatgagtaatttaaccttaaaagatgaagatagccgaaaagagttggaattaatccgtcataaatggcaattttaagccttttatggtatttttaagaaccttatgataaaataaaacagattaacaaagattggagaaatctcatggaagtggctgaaattcgccaaaaaatagtagaaaataaagagaagttgactagcttcaggaggtctctttgacttagatcgtttggaagaggagattgctcttcttgaaaatcaaatgactgagccagacttttggaatgacaatattgcagcgcaaaagacatctcaagaactgaatgagttaaaaggtaagtatgatactttccataatatgcaagaattatctgacgaaacagaactcttacttgagatgcttgacgaagatgattctttgaaagaagaattagaagaaaatctaatgcagctagataagataatgggtgcttatgaaatgacgcttctcttatctgagccttatgaccacaataatgctatcttagaaatccatcctggttcaggaggaactgaagcgcaagattggggagatttactcttacgaatgtatacccgttttggcaatgctaatggtttcaaagtagaagtattagattatcaagcaggggatgaagctggtattaaatcggttaccctctcttttgaaggccccaatgcttatggtttgttgaaatcagaaatgggagttcatcgcctcgttcgtatatcaccttttgattcggctaaacgtcgtcatacctcatttgcttcagttgaagtgatgccagagttagatgatacgattgaagtagaagtacgtgatgatgacattaaaatggatactttccgttccggaggagctggtggtcagaacgtcaataaagtatcaacaggtgttcgtttgacgcatattccaactggaattgtggtatcgtctaccgttgaccgtactcaatatgggaaccgcgatcgcgctatgaagatgttgcaggctaagctatatcagttagaacaagaaaagaaagcacaagaagtagatgctcttaagggtgataaaaaagaaatcacttggggaagtcagattcgttcttatgttttcaccccttatacgatggtgaaggatcatcgtactaactttgagcttgctcaggtagataaggttatggatggagaaatcaatggctttattgatgcctaccttaagtggcgcattgaagactaaaaataatgaaggagaaacatggcactaatagaaatgtctggtgttactaaaaagtatcgccgttcaacaactgccttgagaaacttaaatttatcaattcagcaaggtgagtttgtgtatttagttggtccgtcaggtgctggtaaatctagcttgattcgcctcctataccgtgaagaaaaattaagttcaggtagattaaaggtaggggaattcaatctcaataaactcaaacgtcgtcaaattcctattttacgtcgtagtattggagttgtcttccaagattataaattactaccaacaaaaacagtttatgagaatgttgcgtttgcgatgcaagttattggagctaagcgccgtcatattaaaaaacgcgtgccagaagttctagaattagtaggtttaaaacacaagatgcgttcttttccaacacagttatctggtggagaacaacaacgtgtggcaattgcacgtgcgattgttaataatccaaaattattaattgcagatgaacctactggtaatttggatccagaaattgcttgggaaatcatgcatctattggaacgtattaaccttcaaggaacgactgttttgatggcaacacacaatagtcaaattgttaacacacttcgtcatcgtgtcattgagattgaagcaggtagcgttatccgagatgaagagaagggagaatatggttatcatgattaatttctttagacatttctgggaatcgcttaaaaacttgaaacgtaacttttggatgacttttgcttctgtaacatcagttaccataaccttacttcttgtaggcttgttttcatcagttttactgaatgttgaaaagttaacaactgatgtttcaggtaattttactatcagtgcctttttaaatgttgactcaacggatgctcaaaaacaagtcaaagataaggacggaaagctaaaagataatcctgattatcataaagtttacgacaaaattaaacgtatttctggtgtagagaaagtcacttattcaagtaaagctgaacaattaaaagaagttcaaaaagagtatggttcagatgttattgatgatacctataaagatgctttgttagatgtttacgtagttgggacaagttctgcaaaagtttctaagagtgtcagtgaagcaattggacgcattgaaggtgttgattatactaaagaacctattgattcaacaaaactatctaatctcacagataacatccgtatatggggatttggtggtgttgccttattaattgtccttgctatctttttgatttcaaatactattcgtatgtcgattatgtcacgccgtacagatattgaaatcatgagattagttggcgctaaaaattcttatattcgaggaccgttcttttttgaaggtgcttgggtagggattttaggggctatcgttccatcgctgattttctattttggttatcaatttgtgtttaacaagtttaatccaaaatttgagacaagccatgtttcattgtatcctatggatattatggttccagcaattattggtggtatggtgattattggtattattattggctcacttgggtctgtcctatcaatgagacgttaccttaagatttaataaaaagagatgaaatctatttcatctctttttattaattgtagatatcatgttagtggataaaattcgaaataaacgtagccaattgtttttcagatgatttgtgagaaagggtagctttaccatcccctttttgatgtccgtagttaccaaatcggctatggtttcctccgacaatagttcgaaaagtacttgaatttgggaggcgttttttagcttcctcatatttttcccagtttaaaatatgatcattacttgctgtaatggagagtactcttaaatttttatgagataggtcggatttacgtgaagggtaggaagctaataatatgagccctctaacaggggctactttggcattttggctagcaacaactcctcctaaagaatgtccagcaaggtaaacattagttaagtggttctgattaataattgttttagctttatgaggcgataaaactggcaaatttaaaggtgtcttcaaaatataggtattatcccctttgtcagctaaatctctagcaagttgagaataagcttcttcttccacaagagccccttgatagaaaataatatttgcttttaccttacccttgcttctaaaaagaaggtagttcttatggtttgtagcggttttagcaattctcctagctaatggggaggcttggtaagtattgaagtaaatggtcatcccgacggccattaaaatagcaaggatacttgttgttaaccaaagaaaaatagagtgacgttttatgttcattggaagaaaggattaaagtttttttcgtggccaatagttgtattcatgccatggcctgggtgaacactataatgactaggtaaggtgaatagttcttgacgaataccagtaatgaggtcctcaaagttactggtaggtaagtcagtacgaccgatagtttcacgaaatagagcatcgccagtaacgactaattcatctgagtggaaaacaaacgagactcctccccaagaatgaccaggtgttggtaaaactgtgaattcaaaaccatttagttgatagggttgctttaatttaaaaaagttctctgccggtcttgctataacattaatgatatcatcatgacggcctaacccagataaattatcatctggggaagatagccaagcggcttctttttctgaaacataaacaggtggattatcaaaagtatctctgaccaaatctaaactaaaaatatgatcatagtgagtatgagttaagaggatagccactaaaggtttttcaaaggatttaattttagcaataatttcttggccattgctccctggatcaatgaggataacagcttgatcattaacgaggtaataagtattttcaccagcaatgtggtttattgttttatagattttcataatgatagtgtaccaaaaaatcaagactttgttaaaaaaagagtggcggaaaataaatggcaactagtttcagaaaatatgggatctcacagcaatttcttgacaccgttttcataaaggtgtatcataaaagtaatcaataagccaagcctaaagctgaacttagtttaagaacactgactttttgagagcaacctaattggttgactaaagaatatgaggtggaagatatgtcaaaagttgctattgttactggtgctggtcaaggaattggatttgctattgcgaaacgtcttcatgcagacggctttaaaataggcgttttagactataatgaagagactgctcaggctgcggttgataaactatcacctgaggatgctgttgcagttgtagcagatgtttcaaaacgtgatcaagtttttgatgctttccaaaaagttgtagatacttttggtgatttgaatgttgttgttaacaatgcaggtgttgccccaacaactcctcttgacactattactgaagagcagtttgaaaaggcttttgcaatcaatgtcggaggaactatttggggaagccaagcagctcagaaacattttagagaattaggtcatggcggaaaaattataaatgcaacttcacaagcaggatgtgaagggaatcctaatttgactgtttatggtggtacaaaatttgcagttcgtggtattacacagactttggcaaaagatttagcatcagaaggaatcacagtcaatgcttacgcaccaggtattgttaaaacacctatgatgtttgatattgcccatgaagttggtaagaatgcaggcaaagatgatgaatggggtatggagcagtttgccaaagatatcactttgaaacgcttgtctgaaccagaagatgttgctaatgcagtaggcttcttagcgggagatgattcaaattatatcactggacaaacaatagttgtcgatgggggtatggtattccattaaaaatgattaatgctaacactgtgagtttcactcacagtgttttttatatttcttaaaaaattatcttatcttggttattggagtgatggcatctttgaggtatagtcatgttttgttttatagatatagcgtgctataatagacttactatgacccagaaaaaacttagaaaatatgcagtagttgacttggaggctactggagcaggtcccaatgcttctattattcaggttgggattgttattatccaaggaaataaaattattgatagttatgaaacagatgttaatcctcatgaatctttggatgagcatattgttcatttgacaggtattacggataagcagttggctaaagctccggattttggtcaagtggcgcatcacatttatcaattgattgaagattgtatttttgttgcccacaatgtaaagttcgatgcaaatttattggctgagcaactatttttagaaggctgcgagttacgtacaccaaggatagatacagtagaattatcacaagtattttatccctgtttagaaaaatattctttaggggcattagcagaaagcttaaatattgaattaacagatgcgcacactgctattgcagatgcaagagctacagcacagttattcattaagttaaaagctaaaattagtagtttacctaaagaagtgttggagaccattttaacatttgctgataatcttttgttcgaatcctatttattgattgaagaagcttatcaagaagctgatttcgttaatcctaaagaatattatttctggcaaggattggtcttaaaaaaagaaaaagctgttggaaagcctaagaaattatctagtgattttcaagttaacatggctttgttaggtatggatgctcgccctaagcaagttgtttttgctgacttggttaaagcgcattttaatgatcaaacaacaacgtttttagaagctcaaccaggacttggtaaaacatatggttatctcttgcctttattggatcagtctcaaaaacaacaaataatagtatctgttccaacaaagattttgcaagatcaaataatggctaaagaaataaagcacattcaagaactttttcatattccctgtcacagtatcaaaggaccgagaaattacttgaagttagatgcgttttataagagcctccaagtgcaggatcgaaatcgattgataaatcgttttaaaatgcaactgctagtgtggttgacggaaacgactacaggtgatttggatgaaattaaacaaaaacaacgattagaatcttactttgaccagctaaaacacgatggagaagtgactcaatcatcacttttttatgatctggatttttggaaacgcagttatgataaagttgcacaaagtcaacttgttattatcaatcatgcttattttcttgagcgtgttcaggatgacaaagattttgcaaaggggaaggttttagtttttgatgaagctcagaaacttgttttgggactggaaaatttttctcgtgggcaacttgatattagtcaccaattgcaggttattcaaaaaataattgatagttctattccattattacaaaagcgccttctggaaagtatctcttatgagctaagtcatgcagtagaacttttttatcgtcataattcttttgaattttcagagacctggttgaaacgtctaaaaaatagtataaacgctttagaagtagtaggattagatgagttacaaacttttttcacagctacttatactaactattggtttgaaactgacaaagtcaatgagaagcgtttaaccattttacgtggggcgagagaagattttcttaaattttcaaagttcctcccccccacaaaaaagacctatatgatatcagcgactttacaaatcagtcccaaagtctacttgtcagatcttttaggaggattttcaagtataagtacagaaaagatagcgcatgagaaaaatgccaatcagaaagtatggattgatacctctatgcccaatatacttgatttatcaccggaacagtatgcttacgaaatagccaagcgtttacaagatataatgacgttaaagcagcctaccttagtcttattaacttctaaacagacaatgtttatggtatctgattatttggataagtgggagataaaacatcttactcaagataaaaatggcttagcttataacgttaaaaaacgttttgatcgtggagaaagcaatcttcttttaggtacaggatctttttgggaaggtgttgactttgtacatcgtgatcgtcttattgaagttatcacgcgattgccttttgatactcccaaagactattttatccagaaactatcgcagagtttaacaaaagaggggaaaaacttcttttatgactattctttaccaatgactgtcttaaaattaaaacaggccttgggacgtactacaaggagagaagaacaaaagtcagcggtaattattttggatagcagattggttattaaatcttatggacaaaccatcatgcattctcttggtagagattttgaaatttctaaggaaaaaattaacaaggtcttgactgaaatggctaaatttttgatataatggtaaagatcattgtctaaaaataagattttgacagtgcgactcaagattaaataatagtagtacgttgataaaaggaggagtaatgacctatttgtcagaacgtgtactcaatatggaagagagtgttactttagctgcgggagctaaagcaagagaactcagagtacaaggaagagatattcttagtttaactttaggggagcctgactttgctactcctaaaaacattcagcaagcggctattgaggctataacagatggacgtgcaagtttttacacaccatcaagtggtttgccggagttgaagtcagcaattaatgcgtattttgaacgtttttatggctactcccttaaacctaatcaggtggttgtgggaactggtgctaagtttatcctttatactttctttatgacagtactgaatcccggtgatgaagtaattattccgactccttattgggtatcttatgctgatcagattaagatggctgaaggtaagccagtttttgtcacagcaaaagaagttaatcacttcaaagtaactgtggaacagttagaagctgttaggactgataagacaaaagtcatacttcttaatagtccatcaaatcctacaggtatgatttataaagctgaggagttggaggctattggaaattgggcagtcgaacatgatatcctaattttagcagatgatatttacggtcgattggtttacaatggcaatatttttacccctatttcaagcctttcagagtctattcgaaaccaaacgatagtcataaatggagtttctaagacttatgcgatgacaggttggcgtgttggttttgcagtgggtaatcatgatattatagcggcaatgtctaaagtagtcagtcaaacaacttctaaccttacggctgtctcacagtatgctactattgaggctttaaatggttctcaagagtcatttgaaaaaatgaggctagcatttgaagaacgccttaatatcatttatccattgttgtgtcaggtccctgggtttgaggttgttaaaccacaaggtgctttttatcttttcccaaatgttacaaaagcaatggaaatgaaaggatatacggatgttacagcattcacggatgccattcttgaagaagttggacttgctttagtaacgggtgctggttttggagcgccggaaaatgttcgtctgagttatgctacagatcttgaaacccttaaagaagctgttcgtagactgcatgtctttatgggaagtaatgaaattaattaaataaaaatagagagaaacttatgtcaaaaaaacttatttcaattgttgatgttaaagattatgttggtcaagaagttactattggtgcttgggttgctaacaaatcaggtaaaggtaagattgcgtttgtacagttgcgcgatggttctgcctttttccaaggtgtcgcttttaaaccaaacttcattgaaaaatatggtgaagaatcaggtcttgaaaaatttgacgttattaaacgtctcaaccaagaaacatctgtttatgtaacagggattgttaaagaggatgaacgttcaaaatttggctatgagcttgatattactgaccttgaagtcattggagagtcacatgaatatcctataactcctaaagagcatgggacagacttcttgatggacaaccgtcatctttggttgcgttctcgtaaacaaatggctgttatgcaaattcgtaacgctattatttattcaacttatgaattctttgaccaaaatggttttatcaaatttgatagcccaattttatcagaaaatgcagcagaagattcaacagagttatttgaaacagactattttgggaaaccagcatttcttagccaatctggtcaattataccttgaagctggagcaatggctctaggccgagttttcgactttggtccagtctttcgtgctgaaaaatctaaaacacgtcgccatttaacagaattttggatgatggatgctgagtattctttcttgtcacatgaggaatcacttgacctccaagaagcttatgttaaagcattgatccaaggcgttctagatcgtgcgcctcaagcacttgatattttagaacgtgatgttgaggctctcaaacgttatatcgcagagccattcaagcgtgtttcttatgatgatgctattacacttcttcaagagcatgaagcagatgaagatacagattatgaacatttagagcatggtgatgactttggttcaccacatgaaacttggatttctaattactttggagtgccgacatttgtagtgaattacccagcaagctttaaagcattttatatgaaaccagttcctggaaatccagaacgcgttctttgtgctgatcttctagctccagaaggttatggagagatcattggcggctcaatgcgtgaagacgactacgatgctcttgtggctaaaatggatgaactaggtatggataaatcagaatacgacttttaccttgaccttcgtaaatacggctctgttcctcatggcggttttggtataggtattgaacgtatggtaacttttgttgctggtaccaaacatattcgcgaagctattccattcccacgtatgttacatcgtatcaaaccataataaaaaagcgctagctagtgcgcttttttattatggtctttagaatcgttggttaattaaattgggactatgtttttttaacaatgtgattgtcgaaaagacaaggataagactgattagtcgatccatataatctgttccaacttgaacaagtatcaaactacttgtcatgtctaatccaattccatgtaagaattgtgctataatacttgagccactagaggtaattcctttaaaaaggataactgttataactgaagcaataatagttcctggtaaagaaataatcagtgatttccacaataggctagagggtttacaattccttttaatcaagatacccgtaatgatagcaaccacgatggcgactggtgaataataaagtgaaaaaatatcagtagtcatccaattgatgagtgcactgagaaaagcagtgctggcagcgtaccatggtcccaggataactgctattaacaatgtacctatagtatctagatagataggtaggcgtaaaaatagagctaaattagccccaacaaggttgatggcgatagcgattgagataaatgaaattaaacgagcaggtgattttgtcatttgttaagtcctaacatttctaagtcttcaatgatgactgaattttgtgcatgtaataggacggtcataaaatcattccaaaataaattagtattgactgaggttaaaatcttactgttagcatcttttttataaaaatgatactgatctacaattgtttgtcccatggcgattccgtgacaagcaacatcggtatagctatcaaaaccagtagcgatattttcattaacaaagtaagcaatagctaaaggatcatttatcacacatccaataatatgctcatattgccagtgaaaatcgaagtagaactttgtgattttttggataaaacttgatacgtctggattaatacgctccatataagataaatgattgggggttaatacaatatgacgtgtgatgtctagtccaaccatctctatttttttgtcaaggttttcaaatacatattgtgcagcatgaggatcacaccaatagttgtattcagcaactggagaacaattgccatgtgatttaaaacttcctcccatgctaataaatcgcttgcaatgtttgcctaatttgggattagtttgtaaggctcgagcgatattggtcagaggtccgagagctataatagaagtatcatttttgtgttcaaaatagtttgctaaaaaacaatctgctgattcttcttgaaagataattggttgcgccaatgtaaagttattctctccaaggccatccattccatgagtatcctgagcagatacaaattcacgttgtaaaggcaagttatcaccaacataaactggaatgtcgtgacggtttagtaattcaagcgttacaaaggtattctttagtcctagctcaacaggcgaattgcctgctgttatagtaatagcaacaacttctaacttaggatgctgaatagcatacatcagtgctaaggtatcatcaataccgggatcgcaatcgataataattttttctttattcatttgtctcctttcttttaatattagtgaatgttctatgcttttatgaaactattaacaatagtcatggcaataaaaaagatcttggcagttaccaagatcacacgaaaaaatgaatttagttttctaaattcaatcatattttcagtcacttagttttttattctgggaagttttcgaaccagtccgagaaatactcgattatgcacgtgttttattataatatgaaagcactaacttgtaaagattcaaactgaccatttaacagtgtctagattgattgttttagcatttgaaattaattttgaaatcggacatctgctgtgtgctttgttaacgattagcttactatcagataatgacagtttttcaatactagcaacagcgttaacttggaaataaaatcccttacctacttgcttttccttcatgagctggcaagtaacatcaacgcgagattttaggtctttgaatcctttttgttctaaaatagcttttatagttgcatttaaacatgttgaccatgctaaagcaattaattcctcaggattaaatcctggtaaatgatttaaagggtgattggtctccacaatttttccattggagagataaacttttccatcaacgccttgagtgtttgatgaggttacttcataaagcataataaactcctttgggtctagtttaccaaatttgggagcattccgacaagattttactatttagaatgagtttcttttcctctgaagtaaaatcctaattgctagccatttgtggtataatggcataaaacataagagaaagaggtaatcgtaatgtcagacgaacaaatcaaacttgtgattgtaacaggtatgagtggggcaggaaagacagtggctattcagtcatttgaagatttaggatattttacaatagataatatgccgcctactctagtgcctaagtttttagaattagcagcacaatcaggagatacaagcaagattgctatggtagttgacatgcgtagtcgtcttttctttagagaaattaactctattttggatagccttgaaattaatgataatattaactttaagattctatttttagatgctactgacaccgagctagtgtcacgatataaagagacacgtcgtagccaccctcttgctgccgacggcagagtgttagatggtatttctctagagagagaactattagcaccgcttaaaagtatgagtcagaacgttgtggacactagtgaattaacaccaagacaactacgtaaggtcatttctaaagaattctcaaatcaagatagtcaaagttcttttcgtatcgaagttatgagttttggttttaaatatggtatacctttggatgcggatttagtattcgatgtgcgttttttaccaaatccatactataaaccagaattaagagataagacaggtttagatactgaggtttatgactatgtcatgagttttgatgaatcagatgatttttatgaccatcttcttgccttaataaagccaatcttaccaggctatcaaaatgaagggaaatctgttttgactgtggcaatcggatgtacaggtgggcaacatcgtagcaccgcttttgctcatagattatcagaagatttaaaagcagattggacagttaatgaaagccatcgtgataaaaataagcgtaaggagacggtaaatcgttcatgagaaaacctaaaataaccgttatcggcggaggaacgggaattccagttattttgaaaagtcttcgcttagaagatgttgagattacagcggttgtcacggttgcagatgatggtggttcgtcaggtgagttgcgctcagttatgcaactaacaccaccaggagatctaagaaatgttttggttgccttgagtgatatgccgaagttttacgaacaaattttccaatatcgttttgcagaaggtgatggggattttgcaggtcatcctttaggaaatcttattattgctggtgttgctgaaatgcaaggttcaacttataacgctatgcagagtttaacacagttctttcatacaacaggaaagatatatccatctagtgaacatccgctcactctgcatgctgtttttaaagatggccatgaagtggttggagagagtcaaatagccgattataaaggcatgattgaccatgtgtatgtcactaatacttataatgaagagactcctacggccagccgcaaagttgttgatgcaattttagaaagtgatatgattgtgttggggccagggtcacttttcacctctattttacctaacctagttattccagaaattaaacaagctcttttagaaactcgggcagaggtagcttatgtatgcaatattatgacacaacgtggtgaaactgagcattttacagacgcagaccacgttgaagtattgaaacgtcatttaggacaagatgctatcgatacagttttggttaatattgaaaaagtgccagagtcttatatggaaaacaatcattttgatgagtatttggtacaggttgaacatgatttttcagggcttagaaaacatgccagacgtgtcatctcgtctaactttttaaaattagaaaaaggtggagccttccatcatggtgacttcgttgttgaggaactaatgaatttagtaggaacacatttatgagttttacagtaaaagtcaaagaagagctgctaggtcataagagtgaaaataagatggaactgtcagctattatcaaaatgtcaggtagtttaggattagctaaccacggccttaacctttctattactacagaaaatgctaaaattgctcgtcatatttatagcatgctagaagaacattatcatttgcagccagaaatcaaataccatcaaaaaacgaacttacgaaagaatcgtgtgtatactgtttttattgaagaaaaagttgatgttattcttgctgatttgaagttggctgatgctttttttggtattgaaactggtattgaacactctatattggacaatgatgaaaatggaagagcttatctcaggggagcattcttatcaacgggtactgttagagaacctgattctgggaaatatcaactagaaattttttctgtttatctagaccatgcacaagacttagctaatcttatgaaaaaatttatgttagatgcaaaggttattgaacataaacatggagcagtaacttatttgcaaaaagcagaagatattatggatttcttgatagtcattgatgccatggaagctagagatgcttttgaagagattaaaatgatacgtgagacacgtaatgatattaatcgtgctaacaacgttgaaacagctaatattgctagaacaatcacagctagtatgaagactatcaataatattatcaagattatggatactattggttttgatgcactgcctagtgatttaagacaagtagctcaggtgcgtgtggctcatccagattactctattcaacaaatagcagacagtttagaaacgcctctgagtaagagtggcgttaaccatcgcttacggaaaataaataaaattgcagatgaattatagaaggagatattcacatggcttgtacaacaatattggttggtaaaaaggcttcttatgatggttcgactatgatcgctagaacggaagactctgttaatggcgatttcacacccaaaaaattaaaggtaatgacatctaaagatcaaccgcgtcattacaaatcagttttatcaaattttgaagtagatttaccagataacccacttccttatacttcagtaccggacgcattgggaaaagatggtatatggggtgaagccggtattaacagtaaaaatgtagcgatgagtgctacagaaactattacaacgaattcccgcgttttgggtgcagatcctttggtttcagatggtataggggaagaggatatactcactttagtgcttccctatattcagtcagcgcgagaaggtgtggagcgtttaggtgctattttggaaaaatatggaacctatgaatcaaatggtattgctttttcagataccgaagaaatatggtggttagaaacaattggtgggcatcattggattgctcgtcgcgtacctgatgatgtttatgttactaatcctaaccaactaggaattgatcattttgaatttaataactgtgatgactacatgtgctctagtgatttgaaagagtttatcgaacaataccatttagatttgacctattctaatgagcatttcaatcctcgatatgcttttggtagccaacgtgataaagatcgtcattacaacacaccaagaagttgggcaatgcagcgttttttaaatcctgaaattgaacaggatccacgtagcttgtttattccctggtgtcaaaagccttaccgaaaaattactgttgaggatattaaatatgtgttgagtgatcattatcaagacagtgtgtatgacccatatggaccagaaggggatgcggtaagtaggagagcttttcgttcagttggtatcaaccgaactagtcaaacgtctattctacaattacgaccaaataaatcacttgaaacgacaggtgttcaatggttatcttatggctctatgccatttgcaaccatggtgccgttgtttacacaagttgagactgtaccaaactatttttcgaatacaaccaaggatgcttcaacagataatttttattggaccaatcgtttaattgcagctctagcagatccacacttttatcaacatgaagctgatattgaaagctatatcgagagaacgatggctcaaggacatgcacatattaacggtgttgatagagaagttgctgagaataaagagattgattttcaacagaaaaatcaagaaatgagtgactatatccaaaaagaaagccaagaattgttaaatcgtattctatttgatgcaagtaatttaatgacaaatcgcttttcaatgggagattaaaaaactcggaatattttccgggttttttaagataaaaacgcttgcataagtatataaaacttgcaaaaaaaaaatatcgtgctatactttactagtaaaatattaaccggtaaataacgggttaaataaaaaggagaaaaaatgagaaagaaatttcttttattgatgagctttgtagctatgtttgcagcttggcaacttgttcaagttaaacaagtttgggctgatagtaaacttaaagtggtaacaactttttacccagtttatgagtttacaaaaaatgtcgttggtgataaagctgatgtatctatgttaattaaagcaggtacagaaccgcatgattttgaaccatcaactaaaaacatcgctgccatccaagattcaaatgcttttgtttacatggatgataacatggaaacttgggctccaaaagtagctaagtcagttaaatccaaaaaagtaacaactattaaaggtactggcgatatgttacttactaaaggcgtcgaagaagaaggtgaagaacatgaaggacatggtcatgaagggcatcatcatgaacttgacccacacgtatggttgtctccagaacgtgcgatttctgttgtagaaaacatccgtaataaatttgtcaaagcttatccaaaagatgcagcttcatttaacaaaaatgcagatgcttacattgcaaaattaaaagagcttgacaaagaatacaaaaatggtttgtcaaatgctaaacaaaagagttttgtgactcaacacgcagcgtttggttacatggcgcttgattacggtttaaatcaagttccaattgctggtcttactccagatgcagaaccttcatcaaaacgtttaggcgaattagctaaatacatcaagaaatataacatcaactacatttattttgaagaaaatgcttcaaataaagttgctaaaactttagcagatgaagttggcgtgaaaacagctgtgcttagtccacttgaaggactttctaaaaaagaaatggcagctggcgaagattacttctcagttatgagacgtaatttgaaagttcttaaaaagacaacagatgttgcaggtaaagaagtagctcctgaagaagataaaactaaaacagttgaaacaggttactttaaaactaaagatgttaaagaccgtaaattgacagattactctggtaattggcaatcagtatatcctcttcttcaagatgggacacttgatccagtttgggattacaaagctaaatctaaaaaagatatgactgctgcagagtacaaaaaatattatacagcaggttacaagactgacgtagaatcaatcaagattgatggtaaaaaacatcaaatgacctttgtacgtaatggtaaatcacaaacatttacatacaaatatgcaggttacaaaatcttaacttataaaaaaggtaatcgtggagtacgttatctctttgaagctaaagaaaaagatgctggtcaattcaaatatatccaatttagtgaccatggtattaaaccgaataaagctgaacacttccatatcttctggggttcagaaagccaagaaaaattatttgaggaaatggaaaactggccaacatacttcccagctaaaatgtctggacgtgaagttgcccaagaccttatgtctcattaatatttaaaagatgatatcggatacgatatcatctttttttctttgtacgtgataggctcaaacatagaaaaaagcacttctaatagaagtgcttttaaaattaatgctatgcttattgagcagcgtttgcgtctttgagaccatattttttgttgaaacggtccacacgtccatctgcttgagtgaatttttgacgtcctgtatagaatggatgtgaatctgatgagatttccacacgaataagtgggtaagtttcaccttcgaattctactgtttctttagttgatttagttgaaccactaaggaatttgtaacctgtagttgtatctaagaaaacaactggacgataatctggatggatgtcttttttcatctttaaaaatttcctttctgccataactcgtctgagtcatagttattaaccactctattctatcaaataagaatagtcttgacaagtgttttgataaaaaaagtaaaattataaagaaagtatttcctggatttcttggtaaatagcttgattctcttccaaactataagaattagctccgctggctaaaggatgtccgccaccattatgacgtttagctatttcattaatgatgtgtgacttactacgtaggcgcacacgataatgcccatcgctttgttcaacgaaaattgcccaactttctacaatatcaatttttccaggtacaccaacgattgcagcagtctctgcatctgttacatcgaagcgttttaggtcttcttgtgttaaagtaacgcatgcagcgccgttcttgtcaattttaagttgctcaaaaataaagccttgtaattttgcaattttgaaaggaaaggaatccatttgacgtgccattgcagaaaaatcaaagtcaaattcacgaagtttgctagcaatcttcagtgttttacttgtggtagcaggatataaaaagcgtcctgtatctcctacaataccattatatagaactcttgctgcacttgttgataacaacaaatcacaagaaagagcaaagtctgtcacaatttcacttgcactagaggcgttagtatctacataagagagatctccatagacttcatcgtttggatgatggtcaattttaattaaaaagtcaccttttttataacgttcatcatcaatgcgtggggtatttgctgtatctgtaacaacaacaagagcgccttgatagtcttggtcggtcacttgatccattttagcaatccaagcgagagtgggttcgtcaaaaccagtagcaagtacttttttctttggaaaattatgcctgatgatatcccttaagccgatttggctaccaagagcatcagggtctggtctcatatgtcgatggataatgatggtgtcgtactctttgattttatcaagaatttgttgaaaaataatcattttttacctacctaactgttttgtcttttagtgaagaacaaggctatattgttgactatattatagcttaaatcttttattgaggaaagaaattaagatagcggtcacaatgtttgtttatttttatatgatggtatgttatttttttataaaattcggatactgctaactaataatcttttttataataatattttgtaaatgtattgctttttagctaacttttgttaatatagtaaaaatgctttttaataggagataaattatgacacaagcagtattaaaagaattggctaaggcggagttgcattgtcatctagatggctcactttctttaccagctattagaaaattggctaatatggctgatataatactgccgagtagtgataaagaattaagaaaatatgttatagctccagctcaaacagaaagcttggtagattaccttaaaacgtttgagtttatcagaccgcttcttcaaacgaaggaagcattacgttttgctgcttatgatgttgctagacaggcagctttagaaaatgttatttatattgagattcgttttgcgccagaactctctatggataaaggtttaactgcaagtgatacagtccttgcagtcttagaaggtttagcagacgctcagaaagaatttaatatcgttgcacgcgcccttgtttgcggtatgcgccaatcgtctcataaaacgaccaaggacattattaaacacattgttgatttggctcccaaaggcctggtaggttttgattttgcaggtgatgaattttcctatccaacagatagtttagtagatcttattcaggaagtaaaacgctcaggttacccgatgactttacatgcaggtgagtgtggttgtgctaagcatattgcggatagtttaaatttagggattaagcgtatgggacatgtgacagctttaacaggacagagggatttaataaagcgatttgtcgaagaagatgctgtagcagagatgtgtttaactagcaatttacaaacaaaagcagcctcaagtattcaaagttttccttatcaagaactttatgatgctggaggtaagattacaattaatacagataatcgtactgtttccgatacaaatttgacgaaagaatatagtcttttcgtaacttattttggaacgaaaatagaagactttcttgttttcaatcaaaacgctgtgaaggcctcctttacaagtgattcagagaaagatactttactacataagctacaagaaaactatgacagctatctaaaataaccttcacgattctttaaaaatatgatagaatagtggtaatttacaagtggaggaagatatggctttagcaaagattgtttatgctagcatgaccggaaatactgaagaaattgctgacattgttgctgataaattacgtgacttgggtctagatgttgaagtagaagagtgtacgatggttgatgctgcagattttgaagatgctgacattgcaattgttgccacttatacatatggtgatggagatttaccagatgaaatcgtggacttttatgaagatttagcagaggttgatttatctggtaaagtttacggcgtagtgggttcaggtgatactttctatgattacttctgcaaatctgttgatgagttcgaggctcaattcgcattaacaggagcacaaaaaggtgctgattgtgttaaagttgatttagcggcagaagacgaagacattgaaaacttagaagcttttgctgaagaaattgcttctaaacttaactaagctaccaaaaagacgaacacgagtcgtctttttaacttttttaccatcttttgtaactagaatatgagatatagatatggaattagaagagattcgtcaagaaatagatgaaatagatcagcaattagtaagccttttagaaactagaatgggtctaattttagaggtcatagcatttaaaaagaaacatcgacttccagttttagataataatcgtgaaaacgaagtgcttaacaatgtattgaagaaagtccaaaaccatcaatttgacgatgtgatacgagcaactttcaaagacattatgacagaatctcgtgtttatcaaaaggagaatattgtagacggtgattaaacgatttgataattatgctcagtacgtacttgttttaggttttagcttactaattggtggtgtggttggggctattacagcagtctttggacgtgttctattattcctgacagcctttagaagtgattatatagcttacctactcccttttcttagcattgttggtttatttatagtttttgtctatcaaaaatttgggggtaagagtgttaaagggatgggattggtatttgaagtaggtcatggtaatgaggagactattccgaaacgtcttgttcctctcgtgatattaacaacttggttaacccacttatttggtggtagtgcaggtcgtgagggggttgctgtacagattggggctaccgtttcacactactttcaaaaatattgccgtttacaaaacgcttctcaacttttcctagtaatgggaatggcagcaggttttgctggtttatttcagactcctttagctgctactttttttgcgattgaagttttggtagtaggtcgtttaatggtttcgtatgtattaccaagtttaattgctgccctgacagcaaatttcgtctcacattctttaggtttagaaaaattttctcatagtatagcaacatcaatggcgttaacaccagatattattctaaaattattggttttaggactatgttttggtctgtgtggtaatttatttgcttatttattggctaaagctaaattaattgcttctagtaggttgctaaacccatataaacggattttcacacttggattgttagctacttttttattgtttatcttccattttggacgatattcaggactgggaacaaatctaattgaggctagcttcactaataagaacctttatgattatgattggttgttaaaattgtgtttgacagttattactttggctgcaggttatcagggaggagaagtaactcccttatttgcaatcggagcaagtttaggagtgattattgcgcccattttaggtttgccagttattttagttgctgctttaggctatactagcgtttttgggagtgcaacgaatactctgttaggtcctatcttaataggaggcgaagtctttggctttgccaacactccttattttgttattgtatgtcttgttgcttactccatatcacatgctcatacgatttatggtgctcaatctagatagttagtgatgagttttaaaagagtttatcagtttgtagaacggaatattccgttctcttttttattctcttaaagtttataaaaatggagtttgtcaattttatgaatgcaaaaattatgtggctaatataatttcttcaaagaaattgattttatgattgtcattaaaatactgtaaaatccaattgaatgtgtaggaacttaggttaggataatgtctacaagcatttaagtcgcgatggtgaaatgcattataagataaaaagttgatgtggatttcaactttatgggaaagagttaagtgacacgaaagctaatatagaaaacgtagcttaaaaaatcaaatattaaatgaattaaactctcaaaaatcagaaaaaagctaacctagaaacagtaaatcaaatttaaataatagacttcctgcgaaacaaaatatggtacaatagttctatgaattatgaagcaagcaaacaattaactgatgtacgatttaagcgccttgttggtgttcagcgcactacttttgaagagatgttagctgtgttaaaaacagcttatcaacgtaaacacgcaaaaggtggccgaacccctaagttaagcttagaagatctcctcatggctactcttcaatacatgcgagaataccgcacttatgaacaaattgcggctgattttggcattcacgaaagcaacttaatccgtcgaagtcaatgggttgaatcaactcttattcaaagtggttttacgatttcaaaaactcatcttagtgctgaggatacggtgattgtggatgcaacagaggtaaaaatcaatcgtcctaaaaaaatcaactagcgaattattctggtaaaaagaaatgtcatgctatgaaggctcaggcgattgtcacaagccaagggagaattgtttctttggatattgcagtgaactattgccacgatatgaagttgttcaaaatgagtcgcagaaacatcggacaagctgctaaaatcttggcagacagtggttatcaagggatcatgaagatgtattcacaagcgcaaactccgaggaaatcaagcaaacttaagccactaactcttgaagataaaacctataaccatacgctatccaaagagagaatcaaggttgagaatatttttgccaaagtaaaaacgtttaaaatattttcaacaacctatcgaaatcgacgcaaacggtttggattacgaatgaatttgattgctggaatgatcaaccgtgaactaggattttagtttcgcaggaagtctaatatacaaataactattctaaaggatgacaccttgttcttctagataaaatagctttacaagtaggttaaaatttggtagaattgtgagagtgtgtgatggacgcacaaaaaacggctaatccgctgagacaagtacttaagattagtaagagaaggagaataaaaatgaatccattaattcaaagtttgacagaaggtcaacttcgttctgatatccctgagttccgtgctggtgatactgtacgtgttcacgctaaagttgtcgaaggtactcgcgaacgtattcagatctttgaaggtgttgttatctcacgtaaaggtcaaggaatctcagaaatgtacacagtacgtaaaatttctggtggtatcggtgtagagcgtacattcccaattcacactcctcgtgttgataaaatcgaagttgttcgttatggtaaagtacgtcgtgctaaactttactacttacgcgcattgcaaggtaaagctgcacgtattaaagaaatccgtcgttaattttgatgatcagattttaaaaatgcttggttgtttgaggatagtaactatgttttaaaactggacaaccaagacgtaaaaaatctgcctgtgggcagtttttttactaggtccccttagttcaatggatataacaactccctcctaaggagtaattgctggttcgattccggcaggggacatgtaaataacgtcaaaagcctttgtattaaaggctttttgttttattccgattttaaaaggggcacaaaaggggcagtttgtttatttataatttctttcatatttacagttgtgtgactgtaaatagataatgttgtttttggatcgctgtgaccaactctatccattatcgcatttagcggtatccctttttctgctaaaaatgatatatgcgagtgtctaaataagtgcgtgtgataatctccataaattttcaatcgcttattgatgtacgcgtttaaaatcggtacaccgttcgaatttggaaagacgaatgaacttgtctttttctgtctattgacgatatctaaaatattatctgatacagatattttgcgtgttgattttttggtcttggtcgtagtgatttctcgtgtgttaaaatcgtaagttgcattaatcagaatttctttattttcaaaatctattttgtcgtaagtcagacaagataattctccataccgtacacccgtcaaaaacatgaataaaacgatgtctgcgagcgtttgttcgtcattgtctatcattctattgcacaggtcgtaaacctcgttagatgttaaataaagcaccttttcaggcttgtaatcatcctttggtttgggaactaagacgttctccgtcggattacttgtcatatagtccatttgtatcgcataagaaaatatggcatgcaatctctttctacatttatgcgtaacatgatacgaattgtgttttaatagtttatcaatgattagtctaatatcacgtttagtcaacttgttgataattgtatcatctggtaacacggttgctatatgactgtcagatactaaataaccacgttttgtggagtctttgacggtcggtatccattgctttagatattcctttttaagttctccgtaagtcatttctgagtgatttctgatagcgagcctatcttcaatcttttcctgcaatattaaaccagcttttttctgagcttgactagaatttttatctagtgtcacagatacttttttgtacttatttgttagagggtcagtatatctttcgatatatttaaatttcccgttggctagctcctctatccacattgttttatacctcattttctgttaaaataggtatggtaaaaacccctcccaaaaagcaggtttttactatactagaatttgcctcacgctctccttggacaaaatttgagcgtggggcttttttattttgtcttaaacgttcttccacaatttgtgcaatgccagttgtttttaccctttttcccaaccaaacctagcaataagaacggccaagcaattaaaaatccgatacaaccgacacaaccattaaaacctttacggtcttggttcataaattgtacttttgtactttggcagtaaggacaacgctgtgcaaaaaatcccatttttaattctcctaattttgatttcagcttttaacgtggttcagatattacacatagttattaattttcctatttacgtttcgactggggtaaaatggcacgttatacaaaatgacgtttaaataatttatggctttcaatgttctgatcaacatctttctcatcccaaatttgcaactcccaaggatagtagtgattgctcttattcttgaaataaacgtgtattcctgtgtaattatctttatctcgtaaataccagttttttaagtcaaacttatctttccattcatcaagttgttccatcacttgtgaaatatcctcagaagataaaatgatacgagcgccaaaaatgtcattgagaatagaattcacaggataaccatcttgtcttttggaaaaacgttcaattttgtctaagatactttccgatgtttttacgcgatagacataaggaatatccttaacatcagctttcatcaagtaatcattgatagattcgtgtaaattcaagcggtaatctaaaatcgcttgaacaggtacttttgaaaaggtatgttttagattaatcttttcaactttcccagtttcaaaataatcttgcgaataaacaaggtgtattctattaatttccgagattaagcgttcaactttttccagcatattaattctccctgtaaatatctacgacttctcctatcgtgcggatgttgtcgttctctgaaagatagatttcctcatagcttttatttaaactttgcaagtaccaagcgccgtcataatcacgtttgagtttttttacaaagttttttccattgacttggaatatccctatatcattcatatcgacttgactagataccttgacgaacagtaaatcgttatcttgaataagtggttccattgaattaccagctactttcgcaatagtatcatacttatcggggacatcatcagcccgtagtttaacttccatatgtaaattgtcttcttggtatgcccccagaccagcagcaactaacccctcaacgtagtcagtgatataattttctgtctcctcaacttttctatcgaacatagaaacaactttattttgttcttctaattgttcgttagcgaagctaaggactttttcttgtctaggttgttctaattgagaagaagtagaagtgattttttgtagggtagaggaagttagatttttttcagttttcgtttcatttaacgcgactatctgattttcgtctagcgaatttaataaatcatcaaaagagatgccaattgtgtcagaaactttctttataatcggaatagatgggatgatttcttttccgttacgaggatctctgtttttttcaagaatagaaacgtaagctttgctgatgcctgattctttagcgaattcagccatgctcagattattggtatctcgatacttttttatatattttcctagatgcatatcgaattcctttcaatataatgtctaacattttaaacatattatacagtacaaaaaaatttttttcaagttttttgtccaacatacttgacaatcatttgtctaacatgttagactataatcaagcttaaggaattaagcaaaacgaaaggaggtacagctaatgaaatctaggctaaacaaaaagcctaaacacaaagaagtcgagttggaaattcacattctttggtttaagcttaggattcactactcaatagagtggtgacaataccaagagggctaagaagccctctcccctaacggggtaagtttagtttagcacattggctgtatctccgcaagaatgaaaggagagtagatgtggaagaatctatattgaactctaagcgctacacaaaacttgtcgtagagacagaagatggcaaaaaaatagcagaagttactttgacggaagcaacccctgctgatggatacgtgattaggttaacccctaattatgactaacctttaggtgggaatggatcgttaccatagctgttacgttcgcgaattcgtccatttttgccatggataataacttcactgctattgtttttagcgataccagtagcgatttcgacagcttcggcttgggttgttgtgtgtttggtcgcacgactgttgcctgcaccttttatatcccaaccgccattagggttaggtacgacatgttgatttttagccattagcttatcctcctttcgttaaggataagttgattataacatttttaggaggtacaaaatgaattggaaaaaactaatgctaggcgatttagaacacacgtttactagtcgtgatggcaaggaaaaaacaagcgttgaatttgaaggcggcgtattgccagcactgttagtgctaggtggtatcacttggctgatcgcttggcttattacaaaataaaaactcccatgagggagtaggaggaaggtatggagtttatttatttactaattataccatcaatagtttcatttgttgtatctatcttttggtcaaaactagtcttcaaaaaagtagtagaaattatgacaaaaatggatgttgatcaacaagagctgaatgaaacaatgagagctcaaattttagaagaaatcaaaacattacgaaacgtcaggtaaacaagtttttgaaaatctaacaccaaataaagtaagagttatcattcctagatttgttagtactcttttgttttgttcttttaattcactgttctttttagttataaagctattattaagaatgttgtaatattctttctcatctacgtgtgctttgtaattaatttgaattagtcctagtctttctaaattagttaatgatgaactttgaatagctatatcattttgttctaaattatctacgaatacatgactagcaatatgctctaacggcttatcttgaccaattattgtcgtatagtaggtaccagttgcaacgaaaccttttttaaagtataaatctgagataattttgaaattttgtgcatcaattttatcaaactgttttattatctcaataaaagatggatggttgaattcattttttgatttatccatagatgaagcaatcaattttgtaaataaatttctaagttcttcttcttctaaataaaatttagatgcttctaaagccggtccagctatcgaaagactaggttcttgtagattttcaatatttttactaacaacatcttgtatttctttagctaatttttgaataaaatcgtttctgttagtaatgtacttatttcttcgattttcagctatttcatgtaatttttcaaaaccaattaatgtcattaaatcatcaatagctcttgcaggattttcagctttctttatggcagtagttcctaagagagtagcagaaccaagcaaaatcgtctttatatcaagactttcaatcataatacaactccgttttttatttcaattataccacagaaagggggtgggggaatgcaacaatttaatctaaaacaactacgagagaaaaaaggatttactcaaaatgaattagctgataaagctaacgttagtcgttcgctcgtggttggtttagaaacaggttcatattcagagacatctacagcatctctgaagaaattggcgaaagctttggacgtaaagattaaggatttatttttttaactaatcgtctaacatgatagacaaaatatttgttaataaaactaacaaaccgctagaaaggaactatatgaatcaactaataaacatcaccctaaacgaaaatcaagaaccagttgtcagtggtagagatttacacaatgtacttaatataaaaactcaatatactaaatggcttgaaaggatgtcggaatatggttttgaagaaaacgttgactatatagctattagtcaaaaaagactaacagctcaaggtaaccgtacagaatatatagaccacgttctcaagctagacatggcaaaagagattgctatgttacagcgaaacgagaaatcaaaacaggtacgcaaatacttcatccaggttgaaaaagacttcaatagtcctgagaaaatcatggcgagagccttgctcatggcagataagaaaatcactaacttaacgatggaaaataatcaattgcagttagatttaaaagaagctcaaaagcaagcgcgttatcttgatctaatcattgagagcaagggagctttgcgagtaacacagattgctgctgattatggtatgtctgtcaataaattcaataaaacactattagaatttggtgtgcagcacaaagtgaatggacaatggattctctataaacgacatatgggcaaaggttacacagacagtcacacatttgactatcaagacaaaaacggccatacaagagccaatgtgacgacgacgtggacacaaaaggggcgtctattcctgtacgagttgttgaaagacaacaatattttgccactaattgaacaggaagacattgtatagaaaggaaacatatgagaccaaaacaatatccgtatagcggaaataaaaaagaatctattgcggtaacagtagattccaaaacgctagccgagaaactagagattactgaccaatcgaatatttcccaagcgaaacaccgattatttggtctgtaaacaagtagacaaacggcattttgaattcttgatgtgaagatgaaatcaaggtatcagcttagacgaatttagataagaaaaaaagtccgacgggaatcggactcaaaacaaacttaatttacttaattatatcacagaaaggaaacaatatgctagcaaaacttaaaagcggtatcgaagtaccttacgaagagctttggcttaatgataacgacttatccgaatttattggaaagtcatttgaccaaacgcagcgattactaagaaagatgtacaaagacagaaattatcgcaaatacattgacaaggttggcggtcgttcaacaaaagttaaaaaatttgaagaatggagaaaattacaaaatgaaaaaattatttaactttattttcgcaaaacaaaaaagaagaaagaccaaaatggacaattgaaacacatgtctaaacgggaaagtgctatatgacctagcagacgtcaatagatctctacgaacaagtggatcgagaaaaggagtatgatatggaaaatccaatgacaggagtagcaatactagcatttatcgctttacttgcatatctcggcaatcgtaatagcaatcaaaagacaattactaagactgttgagacggtgttagataactaccaagttgtgcgaaaggttgagagaccaaaacgcacggattttatagagttacctaccccaggatcatgcgggaaagtttggggcaaggatagacctttttaaggagtattgaatggcagataacaaaaagtattactatctaaaattaaaagaaaatttttttgaaagtgatgaagcaatcattttagaaagtatgcctgacggctatatctatagcaatattttgctcaagctatacctaagaagtttaaaaaatgacggtttattaatgtttaacaaccttatcccttacaacgcacaaatgcttgcaacgattacaagacatcaggttggcactgtcgaaaaggctattcaaatttttagagacctacaactaattgaaattcttgataatggtgctatatatatgacaaatattcaaaattttgtcggaaaatcaagcactgaggctgacaggatacgaaaactaagagcaaaaaataacagtggtgtacaaatgttgtacaaatgtacaccagagatagagatagagaaagataaaaagatagatataaatatagataaagagttagaactagaacaagataaagaagataggtttgttgatgttgttgaagcaaatcttggtagaggtcttgtaaagtttgagttcgacatgattaatgactatctcattggacaaaatgtctcaaaggatttgtttttggaagctgttaaagtagcagttgctaataatgtccgcaaatttaattacatcgctcgcattttggataattggattaatgatgggataaagactcctgaacaagcatatcaggctcaaagagactttaaagctaaaaaagctaacaaaacaatgcaatcacaatccaacgttcctagctggtctaatccagactacaaaggaccagatttaaaagaatttgcactaggaagcatagacgatatagaagatggatcaggagatttttaatttttttaacaaacaaatcaaaaaagattttggtaaaacggcgagtaaagagacttttgctaagtttgctagttactgcgccgaaggaatcgaaaaaaatggagttaagccaatttttaattggataaacctatacgcttttggaaccggtatgacaacagcagaagcagaccgattaagaatagagcgatataaacaggagaatacgttatgacaaaacaacatagagaaacgcttatctggtaccgagcaagtcatcaagagcgtgagaagctgcttgattttgggctagttgataaatcacagtacgtgacactattgcggcaattgcgcaagaaatatgcgatttaggaagggatatatggttgaaatcagaattaacggtgagtcaatcacatttgatagcaattttagggatgcgcttatatttacggtagatcacctaaaaaattatgacgatccttctttgaggcagacttacaacgagtttaaagattatacagacgaggacttgatgggatatatcagcacagaatttgatgtagacccggaaatgtttgttgatactaattcagacagcagatggaaaattaaacaacgaattttagaggactgactgtgaacgaagaaatatatgagtctagtcgttactggcaaagtagatacagcgacttgatgtctgattatcttaaagaagctgaagaaaatatagagttaaagaaacagttgaagagattaaaagccgaaaattggcagctgaaacacagaaagaggaaatgatatggcttatttatacgaattagaaggtatttacgcacaattacagtcaatggatttagacgaagaaacattccaagatacacttgacagcattgattttcagtcagacttagaaaataacattgagtattttgtcaaaatgttaaaaaatgtgcaggctgatgctgaaaagtataaagccgaaaaagaagctttttataaaaagcaaaaacaagcggaagccaaagcggaaaaatacaaagagacgatcaggcttgcaatggaattgagtcaaaagaaaaaagttgacgctggaatgtttaaggtgtctttgcgaagaagtaaaaaagttgagattttggacgaaacaaaaattcctcttgattacatgcaagaaaaaattgaatacaaaccaatgaaagctgaaatctcaaaagctttgaaatctggaattgatatatctggagttgaactaatcgaaacagaaagtttgcaggtaaagtaaatgaggaaatcagaaagtataacagaatatgctaaagccttttgtaaagctcagctagaggtaaaacaaccactaaaagataaggataacccatttttcaaaagcaaatacgtgccgcttgaaaatgttacagaagcaatcacaacagcttttgccaataacgggatatctttttcgcaggacccgacaacaaacacagaaaacggttatatcgatgttgcaacgcttgtcatgcacacgagcggcgaatgggttgagtacgggcctttaagtgttaaacctacaaaaaatgatgtacaaggcgctggttcggctatcacttacgcaaaacgctatgcactatcggcaatttttgggataacaagcgatcaagatgatgacggcaacgaagatagtaaaccaaacaattccaggcaatcgccaaaagctacaactaaaaaaacacaaaagacaggatatcaaacaccaaaaatcagcaatatccaaatcgagacttacaagtctgatttaaatgatattgcgaaagccacaaaccaaaacgttgaagagttaacaaaatggctaaccgatactttaaaagtgggggaactagaaaatttgcatacggaacacattgtttcagcagacgaattaatcaataaactcaaaaagaaagcaggactaaaaaatgattaacaacattgtactagtaggtcgcatgaccaaggatgccgaacttcgttatacaccaagtaatcaagcggtagctactttttcacttgcagttaatcgtaattttaaaaatcaatctggcgaacgtgaggctgattttattaactgtgttatttggcgccaacaagctgaaaacttggctaactgggcaaaaaaaggtgctttggttggaattacaggtcgtatccaaacgcgtaattatgaaaaccaacaaggtcaacgtatctatgtaacagaagttgttgcggaaaatttccaattattagaaagtcgcaatagccaacaacagactaatcaaagcggcaatagttctaattcttattttggcaatgccaacaaaatggatatttcagatgatgacttaccattctgagtgtttcgctaagcttctctcaatctaacaggtgaaagtcctgtcctaacaattaaccagttcggttaggtagctatggcatacgtatgcggagtaatccaaatgcggaagcaatgccgactaacgttatccccagtaggctgatattcattggtcttatctcagtccgtgggagcgagcaaacctacagtccgtaacgaaagtgaacttccgctaagtgtcgttaaggtcattccaatgagtataactgagagagttggaaatagagttgtcgagcctttagaatgggggcgaagactggaattgttgtcagttctaactggtatatactggcaataaagctctcggcatatagaagatggaatgtaggtaaagatgagcgaggaacgaaagagacccttttctatcatacatatcccatgtatgtaaggttagatataaggaaaacaccgaagttctaattgacgtaggaatagggagtcggagaggttcatagtaccgataatcatacgagacaacaaaactcgatgtagagaaggagccttgcctttatcggtcttaccgatgaaagaggaactagatgattgctcagaaagctataaacatctttgaaaaggttcaagtatttcaacggaagatatatctatcgaccaaggcagataataagcgaaagtttggtgttttatacgacaaagtatatcgtaaagatatcctgaaagttgcgtggttctatgtaaaaaggaataaaggttcggcaggcattgatgacttcacgattgaagaaattgaagcctacggtgtacagaaatttcttgatgaaatagaagaccagttgagaaacaagaaatatcaacctaaggcagtaaagcgagtttatattccaaaagcgaatggtaaaaagagaccgttgggaattccgacagtccgagatagagttgttcaaacagctgtgaaaatagttatagaaccgatattcgaagcggactttcaagaattttcttatggttttagacctaagcgaagtgctaaccaagctataagagagatatataaatatctcaattatggttgtgagtgggttattgatgccgacttaaaaggttactttgacacgatacctcatgataagttactacttttagttaaggaacgagtaactgataagtctattatcaagttacttagtttatggctagaagcaggtatcatggaagacaatcaagtgagaagtaatattttaggtactccacaaggaggtgtcatatcaccgttgttagcgaatatctacctaaatgctttagacagatattggaagaacaatcggttagaaggaagagggcatgatgcccacttgatacgttatgcggatgactttgttattctatgctcaaataatccgaagaaatattatcagtatgcgaaacagcgtattgataagctaggattaacattgaacgaagaaaagacaagaattgtgcatgcgacagagggatttgattttctaggctatacgcttaggaaatcaaaatctcacaaaagtggtaagtataaaacctactactatccttcaagaaaatctatgaaatcaataaaaggcaaagtaaaagatgttatccaaacaggacaacacctgaaccttcctgatgtcatggaaagattgaatccaatgttgagaggatgggctaattatttcaaagctgggaactctaagcaacacttcaagagtatagataactatgtcatatataatctaacaattatgcttagaaagaagcacaagaagtctggaaagggatggagggaacatccgccgtcatggtactataactactttggactggtttgtttaaggaagttgagtaccaatatcaatgatgatagtcagagatatggtagataacttgtgaatggctataacgtcgaagaaagaagatattgggaaagccgtgtaagggaaaaccttacgcacggtttgacgaggggtttctgaggagatggctcaaatcagcgacctactctacaaaaatgacgaagccgaggaaacaaaggatatatgcaatatatgatgacgacaaatttgtcgacgttggcacaaaagaagagttatcggcacggcttggaattaaaaaagcaacaatagaacagtacatgactaaatcatatcaagcgttagctagctcaaaacgaattgcattgttggtagggattgaagaggaatatgacttttaagacagaatttgaaataccaatcgaaccaaaacctcaaactagacctaagttcagcaaatttggtacgtacgaagatccaaagatgaagagatggcgaaaagaggtttctggatggatagaaaaaaattatgatggaccgtttttcgatgattgcataaaggtagaggtaaccttttacatgaaagcccccaaaacgctatcaaaagagcctacacaacgttctaaaggtaaaacaatacaaatatatcagaacttcgtgcgtgagcttatatggcacgctaagaagcctgatattgataatctgattaaagctgtttttgatagtatttccgatgcaggttacgacagaatacagaaatcaggtatcgtttggtcagatgacaatatcgtatgcgatttaagagcaaagaaaaaatacagtcagaatccaagaataaaagtgaggattgaagagattgacagatgaattaataaatcaattttacaaaatttttgacaatgggattgtaaggcaaattaaaaagctagatgtagattgtaaaaaagccgagcaaataagatgtagcgttacaaataacagacgtcgaaaaaccctgccaagaccgtacgttatcgaagcgtttaaagattattttgacgaagatacctatgcacagatgtatatcaaatcatatcgtgagtatcacaacccaaatgaccacgagacggaactttttgtaaaactaaaaagagcgcacaaagatactaagttagagcattacaaggaagttaagcgattgatgtacgcagcaatgaccttttgaggaggtatagcatggcagataaaataaacgcagagagtatgcaagctgcatacaacgaaaattatcaaatgtttttagctaaaaatgcggattatggaaattcgttcgaaaagtctttggatgacttcggatttatcgctggtgtcgtccgtataagcgataaatacaacaggttatataatcttataaacagtgacaaaaacgtctcagaaagcctgtcagacacgttaaacgacatggctaattattgcgtgatgttagcggtttggttggaggaagaggaacgacaccgaaatttagagcatgggggataaccgatgttaattaataaaaatttagtaagagacattagacttgctatcaatgaatacgatgataattatgacgaagataacgcagaagtttgtatagaagtcattagacgattgattgaacaggaggaattctgatgataccgaattttagagcgtttaataaagagaccaaaaagatgtatggtgttgacggctttgaattaagtgtgcgcaaaatatatagatgcagcttagcagatgatgagtttcgttgtggtcgcttagagacgtttcattttgtcgaggataactttgacgattatatcctcatgcaatcaacaggaatgtttgacaaaaacggtgttgagatttttgatggtgatatagttttaacaacacgtctcatagattacacatataaaaattttaaaggtgtagtaaaaatgttagaaggtcgctggttaattgacacaggtaaagatgcggttggtttgtggactgaagttgatgagaacgaagcaatcggaaacatatatcaaaacagcgaattactagaaagcgtggaagaatgacaaaagaagaagtaattgcatttctgacagaacagcgtgatttgcggcttgttggatatgagtggggaaaagacaatctgtccgtttttgcgagatggcaattagaacaagcaaatatgtatttagatgtcattgagtggatagaggagatgacgaaatgactgaacaacagatgattgattgcttgctttatgagttagcaaaaaaagacaaattgaacattagacgaaacaatatcataacgtttttatcgattgtgctgatggctatatctattttaaacgtcgcactgcaagaccactacaagtcgcaaattacagaattacggacacagttaagcaggacacaaaagcagcttaaacgtgctagtgatgatagagctagacagacaaaacggattgctgagctgactggaaatgggggataaagttgtcattaattgatgaagtaaaagaatgcggttcagaatctcacaaaaaatggtttgataggtactttgatggtttaaaaatcgaggagaaacttaaacagtctgcgatgaaaggattctctggttataaaatctctattccaaaaaatgatgaatacttagctagacgacttgatagccaaaaaacaatagatttactaaaataccgacttggtgacggttttgatgtcgaaataaaaaatcttgaatcatcatataaaatctttggtaaaccagttgtactaagtagagatttatttattttttggaggacaggagataagaatggatgataacacagcagttgttttgatacttttaatattatttttaccgtttattatcggaagttttagagattaagcgaggtaacaaatgaatattgaagacattgaacgtattatttcagaatatctaatttttaggtctgacattgatggttgtgcagtaattgacattgaagattttttaaagcatattcgtttttcgtatgagcgactaaaatagcaaggataatcatgtttataaatgggtaaatgacaaaaaaggttatagaattgagtacaatgaatgcagtgaagtatttttggaggtagcaaatgaatattgaagaagcgaagaaattgatagacaaacagtctattggtaaaggtggtgtcggcgacattccagtagtgaaaacacatattgtaaaagtattactcgaccagattgaccaacctcaaccagaagtgccacggtttgtggctgattggtacgagaagcataaagatagcttagagtgcgatttatatttatatcacatgtcgatatacgatgaagaagtcgaaaaagatgacttctattactggatgcaaacatcaaaaaatccagtctacacacttattaatatgcaccaattcggctacaccatccaaaaagagaagctgtatacggttgagatacctaatccgaatgaaagacagttaagttttgtgctgatgagacaacttagcggaaatgtaagtatcaaagttatgcatagagataacttagacttactaaagacagataatgatttacaactaacagaatccgaaatccgcaaagatttcgactgggcgtggcagtttagagaagaggtggtggaatgaaagaaaaaacaatttttatatcaaaaaaatatgcaaatgactttaacaatgacaaatataatttgtcctctggctattattttagaagtggtgaaaaacatgatattgctattgttaaatatggtgaaaaagattatttaaaaaatactgatttagcatatgttgtatgcgataagatcgttgacgcagactctataagcttcgtttatcatggtgaatatgaaacttggcattttaaactattaaacacagaagcaaattaaagtcccacgcaagcgcctaagagcctgcaatggctctgtgggtctacgagctggaatactcgttaaacttaccctggaagctttctgtaagtattcagctagcagatttggaataattagtctgctagttatagagcgaaatttttagaaagggaaatatcctccgacattttttcgtaaaaatctaaagtctgttatcgctcacagatgattatacaagcgtaatgctgcaaataaagtgctgacgcaaaactaaaaatttaatactcgacaatttaacaacaaaaataagtcagcagagaaatgaaaggagaacaataaaaaagccagctcacgtaagccagctccaatatatttgtctactaatattatatcataaggagtagcttgatgggtcgtaatcagacaaaagctgacattttattaaacgaattaagaataatcccaaaacttattaaagagcttgaacgtgataagattgcgagcaactcgctgctgtcaagtcctcagtggtcagacatgcgaacgagcggagggattagacaatcacaagaagataaaaacgtcagcttgattagtaaatgtgagtattacaacggacaaatacagacactagataaacgtaaaggcgagattgtcgaattaattatgcgtatacctgacatgctgcaacgtcatgtgttaattactacatttgtaaattgtcagacgtacgacgaagcgatcgacagattagagatgaatcgcaataactactatatgcttaagcgaaaaggtgtagaaagtctgaatttgatactaaataatactgaataatactatatcagtattagaaatgactgaataatactcacaaatactaatcaatgtcatataatagtattatcaaaatagcaagaagagataatcatttaccaactgactatttatttagtcgtcaactttaactactatcaaacttgctattttatgtatgtgggacgtacaggttcgaatcctgccgtctcagtagtggttatttcagccactagagcaatacagcgggcgtgggacatggatcggagttttaaccgtttttttgtgtagacctagtggtattaatcacgttcgattcgtgatgggtctataggcttactttaaaaataagcactggtatctctacggggacctttgcgccaagtaagactaaaccgttggaacatgaaccgtgattggaaaacggtagaggtagcgccttgataattggattgtcgacggtctgattatatgtgtcggttcgattccgactgttcctatagcgtgtattggcaacaaggttcaattccttgtgatgtaagtagctaacatctaggcgaagtggttcgaatccactcacacgctttactcagtcatcacattgtggtggctttttattacaattgtaagaggggatgttgcaaactgcgtgcagataaaaaaggtacccaccgggtcgcgttcgaaaaaaataaacgccggctgctaaaaaccgcccacctatgcggtatctgtggccggccagtagataagtcattgaagtatccacatccgctaagtgcagcaattgatcatattgttcctattgcaaaaggtggtcatccgtcatcaatagataacttacagttaacacattggcaatgtaataggcaaaagtctgacaagttatttatcaatcagacagccgtacgggctactgttgtaggaaatagaaacttacctcaaagccgagactggtcgtcctacgcatctaaagaataaatatgatgatttatattaagaagacttaaaatcgattagaattgattttaaggggcatatagaccctatcggctatgtggccgagcttcacgccgtcactgtacattttttctcgcgttaggatttagaattttttaaaggttggattatattgaaaaagaaatgtttaatttgtaaaaagactttccaagctaaaaccaacagaagtttatattgttcagaagaatgccgcaaaaagggcattcgtgagaaacaacgcaaattgatgaagcaaaaacgagccgataaaaagaaagagaaaattaaggttctaaatactaacgcagatgtgacagaaaagcctaaaaaaatacgtaatttggtacaacactataaaaaactaaagagggaaattttagacaatgagtctgaatttggttttacaggaatcgcgcttgttgagggtatagatattcacgaagaaaactttgtagatttagttatgcaaaaaataaaggagcaacaatgaactatatgggtatgggctatcttcagaggaagttagctctttttaagactggtgtagataaaagatatcgctattatgctatggacgacagagacaacacacgaagtattgtcatgcctgacaatgtgcgtgagatgtacaggtctgtgattgaatggaccgctaaaggagttgatagtctggcagatcgcattatttttagggaattcgctaatgatgattttaatgcttgggaaatttttaaagctaataacccggatatcttttttgatacggctattcaatcggcgctaattgcatcttgttgctttgtgtatattatgccagggaaggaagatagcctgcccaaaatgcaagttattgaagcgagtaaagcaacaggcattcttgacccgactacatttttgctgacagaaggttatgcagtcttagagtcggattcaaatgagaaccctacattagaagcttattttacaggcgaaaaaacctggtactatcccaaagatgagaaaccatatagcattgataactcgacaggacaccctttgcttgtccctgtaattcataggccagatgctgtacgtcccttcggacgtagtcgtataaccaaagctgggatgtatcaccaaaaggccgccaaacgtactttagagcgtgcggaagttactgcagagttttatagtttccctcaaaagtatgttctcggaatggatcctgatgcagaacctatggaaaaatggcgtgctactgtttcgacgttattagagatatcaaaagatgaagatggagacaaaccaacagttgggcaatttacaacagcaagcatggcccctttcatggatcatttaaaaatgtacgcttcattattcgcgggtggctctggacttactcttgatgaccttggtttcccttctgacaatccatcatcagtggaagccattaaagcagcgcatgagaatttaagagcggcaggacgcaaagctcaacgctctttctcttctggttttttaaatgtggcttatattgctgtttgtttgagagatgatttcccttatcttcgtaatcagttcatggatactgaaattaaatgggaacctctttttgaagctgatgcaaatatgctaactttggtcggtgatggtgctattaagcttaatcaagctattcctggtttcatggatgcagacgttattcgggacttaactggtgtaaaaggttctgacaatccaattccaaaagctacggaggtgacaactgatggttgatgatgtcttacctaagctactaaaatctgttcaacaggattttgaaaagcattttggcaaaagtgaggtcgttgctaaggcttttgcagaattgcaagctaaaaaagcgacttataagacagtcaacgagtttgctgtagaggttggacggcttttgtcgttggctctggcaaactctgttatttctgatgagttaccagatggtaaaatgtattataatattgctaatcgtctcgtgaatgatacactgagacataattataagttaatttctgattatgcaggcgatgtccagcaaaatttaaacaaacaggctaaaattagtttaaaaattcaacgtccaccgcttaatcaagataaaattgacgggttagtcaatcgtttggcgagtgaacctgtatttgacgatgtcaagtggcttctcgatgagccaattgttaattttagtcaatctatcgttgatgattgtatcagagctaatgctgatttccactttaaaacgggactgaaaccaactatagaacgtatatcaacaggtaagtgctgcgattggtgtgaccgattagctggtcgctacgtttaccacgaagaaccaaaagatttttacaagaggcatcaacattgtcagtgtgttatcgactatcatcctaaaaacggcaagcgtcagaattcatggtcgaaaaagtggacaaaagaaactactgatatactagaacgacgcaaacagatgaatattgacatcagagacaataaccgtaagtctgatatcaaagaatataaggaaatagtatccattttaggtacaaaagcccctatttctctagctaaattccaagacttgaagtataatgatggtataagatatgagcgattaaaagaccaagcacacatccaaggaaactttaaaaacggaagttggctagataaggtaaatcctgaaaaacaagctcggcatatcaaatcaaccgctggagaaggtaagagttatttcttcgatgatgtggataccgatgttttataccaaaagtataaacagactggtgaattaatcaagaatagaaggggacggactcataaggaacttattgatttaccagaagatatttcgataggtattgatatttactcaggaaatttagtaaatggcctgactattcattacggaaagaccggatcgcacattgttccaacttatcatgaaaggagagagtaatggaattattgcagtacaataataagaaaatttcacttgttgacattgatgatgagatatggactggaacagcatactattgcgatgctgatacaaatgagacccccgaggacgtcttagtcgtaaaaaacgagagaggatatacagaaatttctgaatcagaaatcaaatcaattgaaatcatttaataagcgcttagctagtgttgcaagtgctttttttatgctcgaaacaaggaggtggtttgtctcccagcgagagggttatcatgcagtacgattgaaaggaaaaaagtatggttactaagacgaaagcaaagcttggcaatcagcgacctactcaatcggtaaatttacattttgctaaaactctagctcatgaagccatcaattactacaaaaaaacaggtctaagttgctacttgtggcaagagaatatgctcatacctatgatggctatcaacgaagataacctgtgggtgcatcaaaaatacggctacgctattcctcgacgaaacggaaaaacagaagtcgtttacatacttgagctgtgggctttgcataaaggattgaaaatcttgcatactgctcacagaattagcacttctcactcttcgtttgaaaaagtaaaaaaatatcttgaaatgtcaggatatgttgacggagaagattttatatcaaacaaagccaaagggcaggagcgtattgagtttaaatctagcggttctgttatccagtttaggactaggacatcaaatggaggtcttggtgagggatttgacctactaattattgatgaggcgcaagaatacactgccgagcaagaatcagcgttgaaatacacggtaactgatagcgataacccaatgactattatgtgtggaacgccaccgaccatggtatctactggtacagtctttgaatcttatcgtaaagagtgtttaaaaggtgacagacgctactctggatgggcagaatggtctgttgacgaaatgcaaccaatacatgacgtaaaaagttggtatgttgccaacccgtccatgggataccacttaaatgagcgtaaaattgaagctgaattaggtgaggatgaaattgatcacaatatccagcgcttaggatattggccgtcatttaaccagaaatcagttatatctgaaaaggagtgggctaaactaaaagttgagcaagtaccagaactcaaaagtaagttatttgttgggattaagtttggccaagacggtaacaacgtatcattgtcaattgcagcaagagcatcagaaaataaagtatttgttgaggctattgactgtttatccgttagaaatggaactcaatggattattaactttttgaaatcggctgacattgctaaagttgttgttgatggcgcaagcggtcaagaattacttgctcaagagatgagagagcatggtttaaagaaaccagaattgcctaaagttgctgaaattatcacagctaacacgatgtgggaacaaggtatcatgcaagagactatctgccacaacgaccagccatctttgacagcggtagttacaaactgcgaaaaaaggcaaattggctcgaatggtggttttgggtataaatcgctttatgatgatagagacattagcttaatggacagtgcattgcttgcgcactggatttgttacacaacgaagccaaaaagaaagcaaagaaccagctgttaaaaaacgacatccggaagggtgtttttttactgctaaaaaatctaccgaactgccgggaaagcaggagaaaggacgttaatatgtcagaatttaaagttattgaaacacaagaagagttggacacgattgtgaaagctcgcattgctcgagaacgtgagaagtatcaagattacgaccaactgaaaactcgtgttgaagaactagaaaccgaaaacagcagcttacaaactgctttgaatgatgctaaatcaaacactgatagctatacagagaaaattaccactttggaaaatcaaatcgctggttatgaggcagcaaatttacggacaaaggtagcgttacagtatggcttaccaatcgatttagctaatcgtttgcaaggcgatgatgaagacgggctcaaggtggatgcagaacgcttagcatcttttatcaagccgtctcaaccacaaccgccaacaaagtcaaatgaaccgattattaccgaccaaaaagaagcaggttggattgaaatggcacgtaatttagttaacaaaggagaataaacatggcagaatcaattaaagcaggaacgttatttaaaccagaactagtaacagaaattatgagtaaagtgaaaggtcactctacgcttgcgaaattatctggtcaaacaccaatcccgttcaacggagtagaacaatttgttttcaacttggatggtaatgctcagattgttggtgaaggtgagcaaaaattagggaataccgcaaaggtcacttctaaaattattaaaccgctgaagtttgtttatcaggcacgtatgactgacgaatttaagtacgcctcagaagaaaaacgattgaatttcttaaaacattatgctgacggttttgctaaaaaaatggcggaggcttttgatattgcagctattcatggccttgaacctcgcacaatgacagatgcctcattcaaagctacaaactcatttgatggggtcgtgactggtaatgtcatcaaatacgaagcagataaaattgacgacaatattgatgcagctgttacaacgattgtagcaaatggaaatgatgtgacaggtatcgctttgtcaccacaggcaggacaagatatgtctaaacgaaaagataaatttgataatgtgatgtatcctgaatttcgattcgggcaacgtccaagcaacttctttaatatgactttagacatcaacaagacacttactatgaaaggtggcacagctaaagatgaccatgctattgtcggagatttccagaatatgttcaagtggggttatgctgaaaatatcccaatggaaatcattgagtatggagacccagatggctctggacgtgatctaaaggcttataatgaaatcctgctccgtacagaagcattcataggatggggaattttagatgagaaagcattctctcgcgttgaggtacaaggatgatttatagagacaaaaacacaggagcagtagtcgttactgactgtgcgctgttaggcgactgggagattgttcctaacacagtagataagacaccgacaagtgatgaaaaatcttggaccgttcaaactctgaaagaacatttgacagggctaggaattgagtataactcgtctgctacaaaatctgagttattagaattactccctaaataagaaagggaagtttatgacaaattttgcgacaacagatgacgtcattttattatggcgtcaattatccgttgacgaaatcaagcgtgctgaggctttgttagagactgtctctgacacgttgaggttagaagcaagtaaagtgggtaagaatctagatgaaatgattttggaaactccttactttgctactgtattgaaatcggtaactgtagatattgtagcgagaacgctgatgactgctacacaaggtgaaccgatgtcgcaagaaagtcaatcggcacttggctacacttggtctggaacttatttggttccaggaggtggtctttttattaaggatagtgagttgaagcgtctcggactaaaaaaacagcgatatggaggaattgagctttatggggaaattgaaaggaataacagttactttagtcgacaagacgattagcggaaaagaccctttcgggaacccgataaaagttgattttgatattaaaattgagaatgttcttgttgcaccggcaactaccgaagacatcaccaatcagttatctttgaccggaaaaaaagttgaatatatcttggcaattccaaaaggagataagcatgattgggaggataaagaggtttgcttttttgacaaaaagtggcgcactgtcggcctagctcttgaaggtattgaagagcttattccgcttgaatggaataagaaagttatggtggaaagatatgagtaagtttaaattcaagctcaataaagctggtgttgctgaattgatgaaatcatcagaaatgcagcaggtattaaccactaaggccacagccatcagagaacgttgtggcgatggttacgcccaagatatccatgtcgggaaaaatagggctaatgctatggtcagcgctaaaaccataaaggccaagaaagataactcaaaaaacaacacattgttgaaggcggtgcgatgattgattgaagtaattatcaaaaaatatttagacgagcatttagatgtgccgtctttttttgaacatcaaaaagatgaacctgcacgattcatcattttagaaaagactagcggggctaagcaaaatcatttgctaagttccacgtttgcttttcaaagttatgccgaatcgttgtatgaggcggctttacttaatgacaaagtaaagcaagtaattgagcagcttgatgtcttgccacaagtttctggtgtacatcttaacgctgactacaattttacagatacagcaactaagcgctatcgctatcaagctgtatttgacattaatcattattaaggaggaaatatggtagcaaattcatcaaacgttactacggctaaacctaaaattggtggtgctatttatactgcgccgctaggaacagaattacccaaagacacagcatcagagttaaatgaagcttttaagtcattagggtacatttccgaagacggcttatcaaacgaagataaacgagaatcagaagagatccaagcgtggggtggcgatgttgtagaatctgcccaaaaaagtaaagcagataaatttacatatacattgattgaagcattgaatattgaagtactcaaagaaatctatggcaaagataatgtaactggagaccttaaaaccgggattactgttaaatcaaattcaaaaccactagaggaacattgtttggttatcgagatgattttgaaaaacaatacagttaaacgtattgtaataccaaaagggaaagtatccgaagttggtgaaattaagtatgtcgacaacgaagcggctggttatgagacaacgttacaagcgtttcctgatgcggaaggaaacactcactatgaatatataaaaggagctggttaatgaaaacatcgtcaggttttgaatataagattgaagaatcgcgtttaaaaaattatgaattagtagaggcactagcggatttagaaagcaatccgctgtctttaccgaaagttctacgtttgttgctaggtgaccaagtagaaagtttaaaaaatcatttacgcgctagcgacgggactgtttcgacggaggcgttgatggaagaagtgaaagaaatttttgaaagtggtcaattaaaaaaataatagcccttgccacaatgctaaaaatggacgaagatgctcttgtctgtgatttagctgaaacttatcacatatatgattacaaacagctaccacctctaaaagtagctgttttttctttaggcttgagagaagaatcaagaatcaatcgagttatttcaggtaatagagtctcatttgaaagacgaatactagctgggatgtttgacagacttggaatgctcatttggatgaaaacgacagatggccaaaaaggtaaaaatagaccagaaatggtttcaacaatgtttgataatcaacagaaagatagtgaagttgtttcattcggcagtggcaaggatttcgaagaaactagaaataacattcttgggtttggaggtgatagctgatggctactaacttaggacaagcttacgtgcagattatgccgtcggctaaaggaatctctggatctataagtaagacgttagacccagaagcgtcaagcgcaggtagctctgcaggtagcctattaggaggtaaattgattgggatattggggagtgtcattgcagctgctaaaataggcgaaatggtcacaaaagcaatatcgtcatcaatttcagaaggagcggcgcttcagcagtcacttggaggagtagaaacccttttcaaaagcaacgcaaatttagtaaaaaaatatgcagacgaagcctataaaacaactggcttatcagcgaatgcgtatatggaaagtgtcaccggctttagtgctagtttgcttcagtcgctcggaggggatacggccaaagcggcaaaagtcgcaaatatggctatgatagacatggctgataactctaacaagatgggtacatctatggaaagtattcagtacgcttatcaaggttttgcgaagcaaaattacacgatgttggacaatttgaaactcgggtatggcggtacgcaagaagaaatgaaacgtttgctttcagatgcccaaaagctaactggaaaaaaatatgatatttcaaatctctcagatgtatatgaagctattcacgctattcaagggaaaatagggataaccggaacaaccgctaaagaggcagcaacaacgttcacaggttcttttgaagctatgaaagcagcttcgaaaaacttgttggggaaaatggctttaggtgaggatatcaaaccatcgctaaaagcgctgtttgatacaacaagcaactttgtattgaataactttataccaatgctaacaaatgtttttaaaggatttggttcggttatttcgttaactttctcagagctaatacctaaaattgttggttttatgcaaacaagcggtccgtcgctaatgcaatctggcattagctttattattagctttgttaacggatttctaacagcctatcctgcatttttaacagtggcaggaaaaatatttacagatttcgtatcttttgtaatgcaaagtatacctggactcttgcaagctggggctactctcgtcctgaatctaatagatggaatattagctaacttacctcaaatagcaacttcggcagtatctgtgatatcaagctttatatcaatgttgcaagcaaattacccggcaattttaaaaaaaggttttgaaattttaagttacttagtgcaagggattatagcaagattacctgatatcgttattactgttggaaaactcatagcgattttagcaggagcgatagcaagtaatctacctaaagtgctagctcttggagttcagttactcatcacttttgttaaagggattctgagtgtcataggtaaaataaacgaaacagctaacaatattggtgaaaagcttatcaatgcaatcaaatcgattgatttgttgagtgcaggtagagctataatgcgaggtttcttacgaggtttagaggatgtttggggagatattcaaaattttgtcggagatattgcagggtggattaaagatcacaaaggaccaataagttacgatagacgtttacttattccagccggcaacgcaatcatgcaaggtctgcatcaaggacttgttgataaatttaaaccagttaaaaacttagttaacggaatggccgaagaaattcagtcttcattcggaaatcctcaactagcttttgatatggatactaacgtaaacaatggctttgagcgaataggtactttaaataaaaatttatctagtcaagtgactagtacagataattacactagcggcaatgctgctttgttatctgccatcaaaaatttagccgatagacctattgttgtgtctgcgcaatttgataaaaatgaatttgccagagtcgttgctaagccaatagcagcgagacaaaaatttgacgaacagacagaagaaagactgagaggtataaacaggtggtagattacaaaactgtaagatgtcattttggcgatgtcgaattgactaagtggattactattacagacggctttactgtctttagtggcgcagactacgacccggagctaaaagaaattggtggcaaagatggtagcatttttattggaacgaaaactaagcataaagtaataaaagtcccattctgggtaaaatacaatacaatagaagattacgatgccctacaattggctttatcttctaaaaagcctaagatgttgatgtttagccacatacctggacgctattatttagctgtccaggttggggatttgaactttaaagaaatcaagatgaacggctttggtgagataacgtttatagttgcagatgcatatgctcattcaacgtcatacagacgcattaaagactatactcaagacggaaataaaatgaccttcaagattaaaaataacgggacagcccctgcgtttccgatatttagaattaagcacttgggtgaaaatggctatattggaattacaaatgagactggagcatttgcggttggttctcctgaagaagaagacgggactatcgttcatcgtaacgaaaccctttttgattactcaaaagcgattgcacaagctttagaaggtgcgcccaacgtcgcaaaactcaactatatgccaccaacatttgactcggaattaaagcgcatgcgccttgataatattttaggctctggcaaaggtggagagtatgtagctattggtgctagaggaactacaccgggttacggcgagcatgttggaacacggacatttattattaatcctgactcaaacggcgaatatactctcaatgaacacttgtggtggaaacagatttttattgctaccgcgcaggatcaaaaaggatttttaaagctttgcgtgacaggtgaaaatgatgaattcctctatgggattgaaacttacaaacgcaaaaacggctttgaaacagagtataacttttttgctcttgatgatgatggcgttggatggcgcttttataagcagtttgaattccaagcggatagaaattatcacaatcctttttcgatgaatagaagcagggcggttgagatttttagagaagaagataagtttcgtatttactttaacggtgcgcatcatcatgtaactgttccgtcccttaaaggaaaaaaatctcgcaagatacatcttgcgatggggacatgcagtgatagctctaaatatatcaactacaacctgtttgaaaaagtcaattttgaaaaaatgggagtgtctcattacaacaatattgtcaataagtaccaaccaggggatgaggttatcattaactttgaaaatgacactgtaagtacaaaagatatcgattcaatacaagatgtggtgttaggttctaagatgatttcgattccgccaggagagtcagaactagtcgtacacttgtctagctgggtcgcagcgctacctgatatatcaattgattttgaagagaggtacaaataaatgttaacaattcatggaccggatttaaaacctgtcctttttttggataatgataaacaaggagctttgaactactttaaccacaagtggtatagaaagcaaaagactggctcgtctgtactagaattctccgtttacaaaaaagatttgcttggcgatagcccacttagtcataaatatcacgtactaaacgatcaagcatttgtctcttttgtgcacaaaggtaaagtacaattgttaaacatcatgaaaattgatgaagatgaaaaacaaattgattgttattgcgaaaaccttaatttagagttgctaaacgagtattgtaacgcatataaagcaactaaagcgatgtcgtttgaagagtatctcgtgcagtttgacattttgagctggggggctttgacagttggcacaaacgaagttaaggacaaaaaacttacattggaatggactagtcaagaaactaagttagctcgtcttttgtcaattgctaataatttcgatgcagaaattgagtttgagacaaagcttaatttcaatcacacgtttaagcaactcatcattaatatttacaaagaatacgaggagggcaaatcttatggtgtagatcgtgataagaccgacgtgatattacgctatcaaaaaaatatttctgggataaggaaaacagttgacaagcgccagatttataacgctattagaccatacggcaaaaaaactgttagaggcgagcgcgttatttctaatcctgtaactcgtaaagtcactaaaacggttggttcaaatcgcacgtacttaggcggagaccttaaatattatggtcatacaatcaaaaaagctaacgtacaagctattattaactacgcagtgcaatataatattttgccaagtggaatcatcacgcaactttatttagagagtttttggggtgattcgacagttggtaaacgtgacaacaactgggcaggtatgagcggtggagcacagacgcgtccaagtggagtaaaagtcactactgggatggctcgtcctgcaaacgagggtggaacatacatgcactatgcaagtgtagatgactttttaaaagattacacttatcttttagcaaaacaagggatttataatgtcgtcggcaaaaagaatatagcagactatacaaaagggctttttagagctggtggagctaaatatgactatgcagcagcaggatatcaaagctacacaaatttgatgactaatatccgaaatggtatcaataaagtaactggaaatatcctcaatacgattgataagctgtggcagactcctgtaaagcccataaccgccgtaaacgtcgctagaagagccactaaaacaatacaagctattaatgaggctactaagctgaaagggcgcagaatcggttctggacagtgttatgcgctatctgggtggtatgcaaaaaaattggatggcgcttggattgacagctcgattggtggtattagaggtcgtatcggaggcggtatggctgctgccttaatcggcactgattataactggggtgcatatgggtggaaggtagataaatcacctaacgctggaaacttaaaagctggtggtatttataatgtacgagcaaatcgaggcgctcctttttataccacaggctgggggcatacaggtattatcaagagtgtctccaagaccagagttactgttttggagcaaaactttgttggtcgcatgtatgttgtcgaaaactcatatgacattaactctttcgcatctggattacaaacagtatgttaccctcgtgaaatagcgcaaggtatgtctgttaacggcgcaacaacacagcaagtaagtggtgggacacagatatcgtacgaagaagtcgtacaagaggctcagacagaatcatacgaagaagaacaaatcatctatattgacaactctatctacaaagagtggaaagatgaaaacggtaaagtagagtactatctcaaaaatggatttttgtacgcaccactttcaagagaccgctatccatctgttttaaccggtaatgagacacgagacaactggatacgaaaagacatggaagtcgagactgatagtcaagaagtcttgatgtcaacaggtctaaaagacttaaaagcacacgcatatccagcaattacatacgaagttgatggctatgttgacttagaacttggtgatgttgtgcggatacaggacgacggatacgagccaccgctgattttgacagcacgagtagttgagcaagaaatatccataacaaatcccagctctaacaaaactaaattcagcaattttgtcgaaaaagaaagtcagttagcttctgatttaatcagtgatatgttgcgtctatacgatgagtcaattccatacgaaatcaaactagctacttcgaatggtgtcgcttttaaaaatggcactggtgaatctgtcctaactcctagcttgcaaaagaacgggaaagactatgaagcagtttatttttataaaaatggtgactcgctaattgatatcggaccatcgctaatcgttaaagcaagcgactttaaccacgttttaaatataacagttgaggcatatttaaatgaggaacttgtagcaagcacacaaatatcatttacagacactgaagacggtgctgacgggaaagatggcgcaccgggaccacaaggacctcccggtgtaaacggactgcaaggtccaaaaggtgaccaaggcattcaaggtccagctggtgctgacggtaaagcgacttatacgcatatagcatacgcccttgacgagaacggatcaactggctttagtgtatctgataacgttggcaaaacgtacataggtatgtatgttgatgataatatcatagactcaaacgaccctaaaaagtacaagtggaatttgataaaaggcgcagatggtgctagaggtatccaaggtccagctggtgctgacggtaagacaccttactggcatgtagcgtatgcaaacagctcagatgggacagttgactttagcgtgtctgatagtgcaaacaagcgctacattgggcaatatactgactacgatgcaatagattcaagtgaccctaaaaaataccgctggactgacatggttgggacggttgtcgtcgggacaaacaatctgattgatggtacaaaatcattttttgggactgattggtttacttctgcaacgctagaagacgagaacctctctaattgtcctttcacgcttaaaaaatggattagtgggcaaaaagtgtcgcatgcaaaagatatcatggtcgagcaaggtgtaacgtacacttttagtgcttatgttaaacgtgaggtagctgggaatttatatttttatctttatgatatagcagatggttttattactagcgataccccacgagagacaattataaaaaacgttgactctagtctcagacgttttgaaatcacttttacaccaactaagacaggtaggattagaccaaggttcgcgatggtgtcatcggagcaaggtagtttcagctctggtgggtttatgctcgttaggggaaataaaacaggcgactggcaggaatcagaagctgataaagcaagtaatcttgattcaaaagctgatcaagaattaacccaagcacaaattctagctcttgaagaaagaactgctatagcaagagaaaatgcaattgctgaggctatgcagaatacactcagtgaagttgaaactaagtggaagctttggtatgacttaaatacgatagacgaaaagcaaaaagttgcaaacgacatcgctcaattgtttgatcgtacaactgagtttaaacaactattaggtgaggcaagtgcaagatttagctttatcaacaatgaaacgttgattggtgaagagggcgttgctatcggtgacaaaggcggaaaagcaaagttatttctatcaaatgacagcatttcatttgtgacaaatggtgttgctcagatgacattgacaggtgataccttaacaataaaaaatggactgtttacagagcgtatacaaattggaaattttgttgaagaagtctatgacagaaatccattatttaatgttatcagagcaattagaaatagttaggaggtgagacatgggaactgctacatatagtaggtcgtgggggaataacctgacacttgaaatattgtctgcttggaataagccaaatatcgcaagtaatacaagcacagtcaatgtacaagtttttttaaaaatgtctagttatggctatatttcaataggtgaaactagacctttaaaaataacagttgatggtagagctgagaccatcaatgttaatccatcgataaattacggacagagaaaactattatttgctaaagattacattgttaatcataattcagatggaaataaaccactattcaatatttcagcatattatccaataaactttagcaattatggtgaagcgactgcaaatcagtctatctcgctacctaaaattaatagacttagtgtatcaagtgctattagtggtgtgctaggtaatgcagtaactatcacaatcaatagatattcaacgtcatttactcacaatttgaaatatgattttaagggtagtacaggtactatcgcaactggcgttggtactagctatttgtggactataccgccaacgtttgctaatttactgcctaatgaattaactggtacaggtaatctgattgttgagacgatggatggatcagcaaagattggtgagacaaaatatactttatcaataacaatacctaatacagctacttataagccaaaattgtcaagtatcactctatctgatacaaatactttaactagtagcattgttagtggaaacaattttgttaggattataagtaaagttaaagttgattttggctcagctattggaaacaacggttcaacaataacaagttataatgctgaaattgtcgggaaaagtaactcaattatcggtaatggtagcgtatttgataaattggacttttttggttcagcaacaatcagagcaacggtaactgatagcagaggtctaacatcagaaccagttgacacaaaaattaatgtcattgattattttttaccaattgttacaagtgcaaaagtagtcaggtctcagcaaaatcctgacattttacaagtcttgccatttgttaagattgcaccaattatagttggtggaatacaaaaaaaccaactcaaaatgtcggtatctgttgcaccatacaatactggtatctatgcagttgatagtggcgcagctacaaatacctggtcaacaatttcccaaatgtcaggcgcccctttaaatcttggcggcacttatgacaagtcaaaatcatggcttgttaagatttcggtgagtgataacctaatgtcagcaacaccaataatacaaccagttgcaagtgagtttgtacttgtaactaaagcaccttctggtgttgcatttgggaaaatttgggaacatggcattattgatgccaaaggcgatgtttatgttgacggtactatttattgtggcgataaggcgatacagcaaaaaccacttgctttaaataatggtggctcttttagacatgacgacaccgacctaaatagcttgcaagacacaggtttttattgtgtatttagaggtgctaatagaccggctggggcaggtcctgggtacgtaacagttgtaagacatgagacagcaaactatgcttatcaacaattttacgaccgcacaaataaaactatatttacgcgcttgctggaaaacggtgtttggagcggttggagtgagtatgttaaaaaagatagcttacaaacgactggctggataacaattggcaacggttttaaatataagcggaaaggtgatgacatagacttgatgtataattttgcttctaatggattacagagatggtctgttggtaatatgccatctggtttaatacctcaagagttgatgtttgcgataactggatggacacttgctccagacaaatcaatccacttacaaatcaatgcatcgggattgattgagtgtataaatcctggcgcttactcaaatacttacagaggtgtcgtgcactggtcaatataacagtcaatataacaaaggagacgatatgtttacaattaacacaaaattcccacaagttcttgaggataaaagtattatgggagtgactgcaattgtgtcagttgatttaccacacgtgaaaggtaacttaacttttgatttaccacctgagtctgaaaataaatcttttgcagaaacgcttgaaaagtgtgagcagatattttacgacgaaaagtataaagataaagctcagtctgaaaaaatgactgaactaagtacatcaacatcaacaggcacacaaacacttatcaatctgataagtacgctttacgcaaaagaggttttaaaagatgaagatcttattgctattggttagaatttttttacaggaagaagggatagatatgatgattaaattatttgcgattgacttatattatggacgtatggcttggtcaagttttgttaaaaagggattttcagagtttattaataacaaaacaaaagagcaacttgcaattatgtgcgatgaagaattacttgctgaaattttagcaagttagtgaggtagtcggatgacagtagaacaagcagaaagaatcgctcaatcacaatttgtgtgggctattctctttatcttgctttttatgattgtggttggttatctggtgcgaacgtctgataagcgtgagaaaaagctaatggatttccatgaccaatcaaaatcagaatctaacaaacgtgaagagtggctcaaaggtcacttagataaaaatacagaacagttacaggacatttctcagaccattggtgttgtccaaaaggagatgtcttatatgagtgaccgcattggtcgtctagaaaaagaggagaaataagatgaacgaatttataacacaaatcattacagtatcagtaccaatttttggtatcatcgcaggtattctcacgcacaaagtaaaaaaattacttataaaaaaaggtggagaaaaagctgttaaaattgcagaaattgtcgctcgtaatgctgttgaggcagttgaacaaatatctgtggaagttggtattaagggacaagataagctaacagaagctaaaacagctgttattgatggtttatcgcaatataatatcagtttaacagagactcagttagaaacatttatcgaagctgcggttaaacgcatgaatgatgagtggaagaaaggtcaataatatggtaattaatattgagcaagctatcgcatggatggcatctagaaaaggtaaagttacttactcgatggactatcgaaatggtccttcatcttacgattgctctagctctgtctattttgctctacgctcagcaggcgcatcagataatggctgggcagtaaatacagaatatgagcacgattggttgataaaaaacggttatgttcttattgcagaaaatactaattggaatgcgcaaagaggtgatatttttatttggggtaaacgtggggcttcggctggagcttttggacatactggtatgtttgttgatccagacaatattattcactgtaattatggttataactcaattacagtgaataaccatgatgaaatctggggatataatggtcaaccttatgtttacgcttatcgttacgctaggaaacagtcaaatgctaaggttgataatcaatcagttgtatctaaatttgaaaaagagttagacgttaacacaccgctaagtaattcaaatatgccatattacgaagcaacaatttcagaagattattacgttgagtccaagcctgacgtcaatagcactgataaggagttgcttgttgctggtactagagttcgagtttacgaaaaagtaaaaggctgggcaaggataggcgctccacagtctaatcagtgggtagaagatgcttacttaattgatgcaacagatatgtaaaccaacagagcgacataaatgtcggtagcaaaaaattatggaggtaaaactccttaagataagacaaatgccctcgctttgcgggggctgtttttgttatcaatagtgaatgcaacaaaattttttcaacaatatattgtgctaaaaatgtatttttatatataatcatccaatatgttgtggttgcttgaatttataaatttcaagacacgattttgtggcttgacattatttttaaaaaaagtataattatcttaacaagacaaaccccccattcctttataggcagatacgttctgatatggggctttttttatatcgttaggagagttatgaaacaacctttagctttgacatgggaagatcaaattagactacttgaaaaacgtggattaattgttaaagctgatgatgtagagaaaatcaaacatatcagttattatagaattaaagaatttgcaaaaccacttgaaataaagcaacaagatggtgaggagcaggatattttatatgataatattgagtttgcagaagttttggcaagatattatcaggataaaaacttaagaatctatctactgcacgctattgaaaaaattgaagtgtctattaaaacaaaaatttcttttgttttgggggatagatatggggcgttcggatatttaaatttctcttcatgggctaataggaataagtttacaaaatatgatattgaaaaaagacaatttaggattaaaaagaatttattgaatactgtaagaaaatctcaactaactgagttacaaaaatcaattaaccttgatctagatggattcccaacagtgtggcttgctattgatttattgatgtttggtgacatcgtttcaatcttaacaatcatgagtgagaagaacattaaacagatttgtcaatattacagttgtacaccagaagaacttgtttcgtggcttaaatgtttgaatttcataagaaatgtatgtgctcataattcaaatgtactggatattcaaatcacaacaaagcctaaacttcgttcagaatggagaaattatattgatacagtaataattaaacataacgtgactaaaccttctaataagttatccgttattattgctattgtagtctatcttgtaaatactattaattccaaatatcaatggagaaatatacagtctagtttgaaggctctttgtaaagaagatgacagtagggcaaagcttttaggttttaaagattatgattctgttaaagcaatgattaatgggataaagtgtactacttttacaaattcaaaaaaatagaaatttttagcaagaatcgcctgatactagctgttcttgcttttttatttgctaaagaaagatatagatgttataattaataaaaataataaggagacacattatgtcacaagaaaaactaaaatcaaaagttgaacaagcatcaggtagcctaaaagaaggagctggtaagctaactggcgataaagagttagaggcaaaaggttttgtcgaaaaaacaattgctaaaggtaaagaactagcagatgatgctaaagatgctgttgaagaggcagtagatgttgtcaaagaaaaactgaaataaatattaaccgctctctattgagggcggtttttttgtgtgtctagagtttgctttcaattaattgttttaattctaataagtcttcttttgtagcatttttgttaataaaactacgagcagtagatcgttttgatagataggttctatgttctctattgttttctgcccactttttatttgctttttcttgaggtgttaattctttatccatttcaatcatccttgttaataaagtaaaatacaactaaacaaattgcgaaaataatcaaatatttcatatttgtcttagatatgatatactatcagtagtggcaaggggcttgagccccaaactactactagaaccttatttgaatctccgtggccggtttttctttttaggttctttttttattgctgtgattatgcttgctataccaaccaacagagttccgattgaagtaagcaaatcagcaatttctgatattctcatatcttcctcctttctatatataattatagtacatgtactatataaagtcaatacttttttttaaaatatttatctttttgtctatcagaacagaaaaatttaaaattgtctatttttaggattttttatcgaatagatagataggaggataaaatatgttatatatagatgagtttaaagaagcgattgataaaggctatatttcagggaacacagtagcgatagtgcgtaaaaacggaaagatatttgattatgtgttgccgcacgaggaagtgagagatgatgaagttgtgacagttgagagtgtagaagaggtgttgagggaattgaagtgaaagggtgcaaaaaaggggcaaaatagattaaaaatgaaactacattgaactttttactattataaacaaccattaaatcaacgcttggactattatgaactattgtgtacaatagtagtagattccggcaggggacatattcattgcatgtaaatagcggtttagagctattttgccccaaatccgccccaaatttctctgattaagtttatcgttcctatctttttgttcttgtaattgatgtgcgtaaacttctaaagtgatatttaaattctcgtgatctaaaacttgagagatggaaattagatagcttgcaaatgtatgcctgagagagtgcactcgtacctcgcgaccagttatttttcggatagttttattgactgcattatttgaaagtttgtcgaataatctgtcgtttttattttttgtaaattcatgcaaaaaaaataatgtatcattgtcaattggtatatttctgatactacttttgttttttgttggcaggtatctttggttgaaatgataatcccaagttttattaattgataaatatttgttagtgtaatcaatatcattaactgttaaacctaaacattcagcgaagcgcatgccagttttagcgatgaggtataacgctgcatacgattgatgttgtgatttttctttacaaatttttatcaagcgtaagtattcattggtttcaagaaattttatctctatttacgccccttattttttgctttaaccttagtgaataaacaaaaatttttttctatatatccctcgtgaacagccatggatacgcaggcttttacatgtatgttaaaacgctttactgtatcttgcacatgcgtttgactataatgatttatgacttgttgatatttagtggaagtaatattgcaaagtaatatatttcctattatatgtttatacgatattcgatattcccacccgttgtcgcgtttacggaaatacgccattgatatactccacattagctaaagaacagggtgttcaaggctaccttgatggaaaaggctctcttagagatatttgtaaatggtatgatatctcaagtcgctctgttctccaaaagtggataaaacggtatactagtggtgaagacttgaaagccactagtagaggatatagccgtatgaaacaaggaaggcaagccacatttgaagaacgtgtagagattgttaactacaccattgcccatgggaaagactatcaagcagctattgagaagtttggtgtttcctaccaacaaatttattcttgggtgcgtaagcttgagaagaatggctcacaaggtttggttgatagacgtgtgaaagggttggagagtaggcctgatttaaccgagattgagcaactttaactcaagattaaacaattggaggaacgtaatcgtctcttagaaatcgaggttagtttactaaaaaagttagaagacatcaaacgaggaaacagacggtaagactaggtaagcatttagcggagttccaagtaatcaagaattattacgatgaggaatctaatgtgcctattcaggccttatgccaactcttgaaggggtctcgttcaggctattacaagtggctcaatcgtcaaaaaacagattttgagacaaaaaatacaaagctaatggctaaaatcaaggaacttcatagactctacaatggtatcttaggttatcgccgtatgacaacatttattaatcgtcaacttgggacaacttaaaacaagaaacggattcgttgattgatgaacattctggggattagttcagtcattcgtcgtgttagccatgcttgtacaaaagctggtgacagattttacgaagaaaatattcttaatcgtgaatttacagccacagctcataaccagaaatggtgcacagatgtcacctatcttcaatacggtctgggagctaaagcttatctcagtgcgattaaagacctgtataacggttctattatcgcttatgagattagtcacaacaatgaaatccacttgttatgaagaccattaaaaaggggctagagctcaatccaggagccacacctatcatccatagcgattgaggtagtcaatatacttccaaagaataccgttatatcatacaacaagctggtctgaccttatccatgtcccggattggcaaatgtattgataatgcaccaactgaaagtttctttgggtttttcaagactgagtcttaccaccttaagaaatacaactcttatgatgagttggtcaatgatgtggcacgttatatcgaattctacaacacacaacgttatcaatcaaaattaaacaacctgactcctctagaattcaggaatcaggttgcataacttatcttttattatttgactgtctacttgacagggagccgttcagattgcttaacctttctaaatttgctaaaatagctacaagaaaacgagccatttaatgcttatttcttatactgtcttgcctcacgctctcctcgaccaaaaattgagcgtgaggctttttgtttcattaaacgatgatatttccatattcatcagtttgttttccgagagccatcaaagcttcgataaggtcgataattccaggaataaaggtaatactaaaaataatatataaaaaaacctggcctatttttcctgcgtaaaatttatgcgctccaatgccgcccaaaagaacgttaataaaacataaactactatgttagcataagactttatttttacaactgaatttcatataaatggattagagtaagggataaaagaaattagcatagctcttttgaaaataaaaaaattaatataatatggaaaaaattttatttcataaacgtttcataaaaggtatgtaatctagtatttaggcaacactattttgtcactggtgtctagtaacttatagattgataattttactagtaaacgtaattcttcgctttaagagttaaatgtctatttattgtaagctaaattgggaggtgaacttatgtaaaattagataggtactgtcaagtacgggatgattattgaaacagccagtatgcatcataaaatctgtattgcttaataactatttccttaaccagacatcagttcattgtttatcatcgctaccctaagtctagttttttcaatagagcattaggtagtttttgataataaaactatataaacatgagaattagatttcgtatcgcattcttcataatgagttatttgagattttcctttgaataaatagatacgaaattcagtaacttcatatataaacggctctatcattgagatagtttgtcaaatgaagaaattttaatggaaatagttttaaaaacattagttgtaggcgatgtaaaaatattaatccagtggatgcaatagttgcggagtaaaaatagagaggagtaattaggaagtgataaaaaatgctatagcatatattaccagaaaaaaaaatagaacacttattatatttgctattttaacaattgttctttcttgcttgtattcatgtttaacaataatgaaatcaagtaatgaaatagaaaaggctttatatgaaagttctaattcttcaatatcaattacaaaaaaagatggtaaatattttaatattaatcaatttaagaatattgaaaaaataaaagaggttgaagaaaaaatatttcaatatgatggattagcaaaattgaaagatcttaaagtagttagtggtgagcaaagtataaatagagaagatttatctgacgaatttaaaaatgttgtttcactagaagctacaagtaatactaaaagaaatcttttatttagtagtggagtatttagttttaaagaaggaaaaaatatagaagaaaatgataagaattcaattcttgttcatgaagaatttgctaaacaaaacaaactaaaattgggtgatgaaattgatcttgaattactagatacggaaaaaagtggaaaaataaaaagtcataaatttaaaattataggaatcttttctggtaaaaaacaggaaacatatacaggattatcatctgattttagcgaaaatatggtttttgtagattattcaactagccaagaaatattaaataaatcagagaataatagaattgcaaataaaattttaatgtattctggtagtttagaatctacagagcttgccttaaacaaattgaaagactttaaaattgataagtcaaagtattctattaagaaagataataaagcattcgaagagtctttagagtcagtgagtggaataaaacatataattaaaataatgacttattcgattatgttaggtggaatagttgttctttcattaatcttgattctatggttaagagaaagaatttatgaaataggtatatttttatctattggaacaactaagatacaaattataaggcaatttatatttgagttaatattcatatcaataccaagtataatatcctccttatttttagggaatctactattaaaagtaattgtagaaggatttattaactcagagaactcaatgattttcggtggaagtttaataaataaaagcagttttatgttaaacataacaacacttgcagaaagttatttaatattaataagtattattgttttatcagttgtaatggcctcttcattaatattatttaagaaaccaaaagaaatattatcaaaaataagttaggagcaaataatggatatattagaaataaagaatgtaaattacagttacgcaaattctaaagaaaaagttttgtcaggagtaaatcaaaaatttgaacttggaaagttttatgcgatagtagggaagtcaggaacaggaaaatccacacttctttccttacttgcaggacttgataaagttcaaacaggaaaaatcttgtttaagaatgaagatatagaaaagaaaggatatagtaatcacagaaaaaataatatatctttggtatttcaaaattataatttaatagattatttatcgccgattgaaaatattagactagtaaataaatcagtagatgagagtatcttgttcgaattaggtttagataaaaaacaaataaaaagaaatgttatgaaattatctggtggtcagcaacaaagggtagctattgctagggcactggtatcagatgccccaataatactagctgatgagcctaccggtaacctagacagtgttactgctggagaaataattaatatattaaaggaattagctcaagatagaaataaatgtgtaatagttgtaacacatagtaaggaagtagcagattctgcggatatcattttagaactaagtggtaaaaagttgaaaaaagtaaataaaatgaatttggaggttgaataatgataaaaaatgcatttgcttatgtaactagaaaaagcttaaaatcattaattattatattagttattctatcaatggcaactttaagcatcattagtttatctattaaagatgccacagatagagcttctaaggaaacatttgctaatataacaaacagtttttctatggaaataaatagacaagtaaatccaggaacacctaggggtggaggaaatgtaaaaggtgaagatattaaaaagatatctcaaacaaacagtatagactcctatgtaaaaagaataaacagcgtcgcagacctagttgatcatgatataattgaaactcaagatacacttgcaaatcaatcacctgaaagagcaaagaattttaagagaacagttatgttaacaggggttaatgactcagcaaaagaaacaaaatttgtatcagaagcatataagttagtagaaggaaagcatttagaaaataaagataaaaataaaattttaatgcataaagatttggcaaaaaaaaacaatctcaaagttggagataaaataaaaataaaatctaatttgtttgatgctgacaatgaaaaagttgcaaatgaaactgtagaagtagaaattaaaggtttatttgatggtcataatagcggtggggtaagtgcagcacaagaactatacgaaaatacactaatcactgacgttcattcagctgctaaagtttatggtaatacagaagatacagccgtataccaagatgcaacattctttgtaaaaggtgataagaatcttgatagtgtaataaaagatcttgggaaactagatataaattggagagaatataatttgattaaaagttcatcaaattatcctgcgctgcaacaatctatatccggtatctattctatttcaaacaaattatttgttggctcattaatatttgcaggagttgtagtttcattattacttttcttatggatgaatgccagaaagaaagaaatagcagtattactatcattaggtatatctaaattagaaatttttggtcaatttataatcgagatggtatttatatccattcccgcacttcttggatcttatttcttagctcaatatacagctgataagctagggaataatatattgaataaagttactggcgatatagctaaacaaatagctagacaatctgcatctagtcaattaggcgggggggcagaagctgaaggattcaacaagactctttcaggtttagatataaatgtattacctaaattcataatttatgtagttatatttatgagttttgtacttcttgtatcattgattctttcttcaatttatacattaagaaagaatccaaaagagttattaattgataataattaaaattttcggtgatttatatcaccgaatgttttttgacttataaaaatcaaataatatactgtataatattatgtatagatttaaatggaggtatctatgaaaatattaactgttgaagatgataagttgataagagagggaataagtgaatacctttcagaatttggatatactgttattcaggctaaagatggaagggaagccttgtcaaaatttaatagtgatataaacttggttatcttagacattcagataccttttataaatggtttagaagtgttgaaagaaattagaaagaaaagcaatttaccaattctaattttgactgcatttagtgatgaagaatataaaattgatgcatttactaatttagtagatggatatgtagaaaaaccattttcattgcctgttttaaaggctagaatagattctttaattaagaagaattttggacatttagagaagtttgaatataagaatctttcggtaaattttaatagttatacagctaaaataaatgatgaaaaaatagatgtaaatgcaaaagaactcgaaatactaaaatgtttattggataatgatggacaagttttaacaagaatgcaaattattgattatgtctggaaggatagcgaagagatcccttatgatcgagtagtagatgtatatataaaagaacttagaaaaaaattacaattagactgtataactactataagaaatgtaggatataaattggagagaaaatgaagaaattaaaaatattcccaaaaatgttcatacaaatattttctattcttggaatactaattatattagttcattcattattcttttttatctttcctaaaacatatttggagacgaggaaagtaaaaatccacattatggcagatgaaatttctaaaaatatgaatggaaaagagttaaaatatttagaccaaactttggagctttattctaaaagtagtgacataaaggtatttataaaaaaaaataataacaaaaatgaattacaaataaatgataatataaatgttaatgtaaaaagtgatagtaattctttaataattgaagaaagggaaattaaacttcatgatggcaaaaaaatacatcttcaatttgtttcaacagctgatatgcaaaaagacgcgaaagacttgagccttaagtttttaccatattctttatcgatatcatttcttttttccattgttatttctttaatttatgctaaatctataaaaaacaatatacaagaaataactatggttactgataaaatgataaaacttgacaaagaaacaagattgaaaattagttctaatgatgaaattggacaactaaaacagcaaatcaatgacttatattgtgctttattgaatacaattaatgatttggaatttaaaaataaggaaattttaaagttagaaaaattgaaatatgatttttttaagggggcgtcccacgaacttaaaactcctctttccagcctaaagatattacttgagaatatgaaatataatatcggaaaatataaagatagagacttttatatcagtgagtgtattaatattgtagataacttaacaaagaatgtctcgcaaatattatctttttattctataaaagacttgaataatgatgaagaatatttaaatgttggtgatacattagatgaagtattagaaaaatactctatcttagtaaatcaaaaaaaaataaatattaataaggaattattagactataatatttatataggaaaaacggcactaaatattgtattttctaatttgattagcaatgcagtaaaatatactaatcgaaatggaataattaatatcaaaatagctaatgattggttacttatagaaaactcatatgataaaaataaaatttcgaaaataaataaaattttagatgctagttttgatctaaaattggataatagtaatggattaggattaaatatagtaaagaatatacttaataagtataatataaagtatgaaatattacatggtgaaaattattttatatttaaaataaaaataatctcttgagtaataatcatactattggactaatgtcaaataagtagacagaaaaccgtgttattttattgcgttaaaataattttcttctttctgattaggggttagtcctagattagccgtatgtgggatgtaattgttataaaaattctcaatgtattcaaagcagtctaattgaacctgtttgatattttgataatttttttggttgatttgtctatgctttaaatacttgaaaaatgcttcagttacggcattatcataaggatatctaggtttagaaaaagaatgcatgatattgttgtcatcaattatttttctaaattccctggccttaaattgtgacccttggtcggaatgaaagagaagtgttccttcaatctttcttttattaagagctaattctagagtgtcacatgctaactttgcatccatacgatgactcaatttccaagcaatatattttctagaatagagatcaattattgcgcagagatagacatatttcttatatccaatagaaatataggtgaagtcagtagaccatacttgattaggtttatcaggattaaatttctggttgagtaagttttgaggatacgttttttgagtctttttaagagctgtttttgtcttaacggtagccattttagggagcgccatattcttcatcagacggtaaattcttccttcagagatttttgtgtcttttaaaacaggttataacacacaaagtgttgtctatttttatagtatacatccatactcgcataaccatgagataatcactaaaacaagagtcgcctgacactagcgactcttgtttttatttgctaaagaaagatatagatgttatgattaataaaaataataaggaggtgcagtatgtcacaagaaaaactaaaatcaaaattagatcaagcaaaaggtggtgctaaagaaggctttggcaaaataaccggtgataaagagttagaagcaaaaggatttatcgaaaaaacaattgctaaaggcaaagaactagcagatgatgctaaagatgctgttgaaggggcagtagatgctgtcaaagaaaaactgaagtaacaaataaccgctcatttaacgagcggttatttgttatctttttgtctatcagaacagatatagatgagtttaaagaagcgattgataaaggctatatttcagggaacacagtagcgatagtgcgtaaaaacggaaagatatttgattatgtgttactacacgaagaagtgagagaagaagaggttgttacagttgagagagtgcttgatgtactgaggaagttatcataataacggaccaaaattcgccccaaaaagtattttaaaatagaataaaataaaaaaatatgctttttattatggatgtatcgtgtattttaacctttaatatatcctattttaatggtagagaagttggcaggggacatattaaaaccttttttgagatgttaggaaggattttattctttagactagtgttgagaaaataacaaaacttaaataatcttatttaagttttgtttaaggtgaactttgtatactttaaatatcctaaataaacttttcttttcatgttctttgttttactgatgaagaacaatctcctaatatttgcaactcataatgatttgagttgcattttttattgcaaaaaatataagtcagattctgaaaaaatgttataataattaccatgaataaaaaaggaagtcctatgtcacaaaaatcaaactattttaaagggcaaattgattatgctgttgtgataccagtattttttttattaatgattggtttagcctcaatttatgttgcaacgatgaatgattatccttctaatatctatatcgcgatgtttcagcaggtgtcttggattattatggggtgtattattgcatttgtcgttatgcttttcagtactgaatttttatggaaagccacgccctatctgtatgctttaggactaaccctaatggttcttcccttaattttttatagtccacagctttttgcggcaacaggtgctaaaaattgggtgaccattggctcggtaactttgtttcaaccgtcagagtttatgaagatttcctatattttaatgttatctcgaataactgttagttttcatcagaaaaatcgcaaaacttttcaagatgattggaagttgctaggattgtttggtttggttacattgccagtgatgattcttctaatgttacaaaaagatttaggaacagcattagttttccttgccattttgtcaggtttaatccttttatcgggcatatcttggtggataatcttgccaattttatctactatcgttctttttatagctagctttttgatgatttttatctcaccaaacggcaaggaatggttttataatttggggatggatacatatcaaatcaaccgtttatctgcttggattgatccatttagttttgcagactcaattgcttatcaacaaacacagggtatggtatcaattggaagtggcggggtaacaggtaaaggttttaatattttagagctctcggttcctgttcgtgaaagtgacatgatttttactgtcattgctgagaattttggcttcattggttcggcgattgttttagggttatatctcattatcatttaccgtatgttaaggatcaccattgaatctaataatcaattttatacttttatatcaactggttttatcatgatgattgttttccatgtttttgaaaatattggtgcagcagttggtatattacctctaacaggaatcccacttccgtttatttcgcaaggtggaagttcattactaagtaatcttattggaattggattggtcttatccatgtcttatcaaaatacagttcgtcaggccaaggctaatggatcacatttgaagtatcgtagtatataacaaaaaaaggttggaaagataatccagccttttaataatcgaaatattttagaggagtgagttaattaagtaaggtggtagctataaaaaatcgtaataatatgatataataaagggtatgaattatcatgattatatttgggatttgggtggtacactacttgataattacgaaagttccacacgtgcttttgtagagactttgaaagaatttggatatcaagcagaccacgatagtgtgtatcaaaaattaaaagagtcaacagcagatgcaattgcatattttatccctgaagaagctgattttttaaaagagtataaggctaatgaagctaaggttttggaaacaccaattctattccaaggggcaaaagaacttttagcgaaaattcaaagacaaggtagtcgtaattttttggtgtctcatcgtgataatcaagttatagttattctggaaaaaacagaaattattgactattttacagaagtagtgactgctgataacggcttttcaaggaaacctagtcccgagagtatgctttatttgaaagaaaaataccaaattgataattgtttagtaataggcgatcgtgatatagataagcaagcaggagaatcggctggttttgataccttattagtcgatgggtcaaaatcattgatggagataatagagtaaatgacagaagaaacaaagaatatggaacaacgtgctcaagaatatgacgcaagtcagattcaagtattagaaggtttagaagctgttcgcatgcgtccaggcatgtatatcggttcgacttcgaaagaagggcttcatcaccttgtatgggaaattgttgataactcaattgatgaagccttagctggatttgcaggacatattaaagtttacattgaaccagataactctattacagttgttgatgatggtcgcggtattccggtagatatccaagaaaaaactggaagaccagctgtagagacagtttttacagttctccatgccggtggtaaatttggtggtggcggatacaaggtttctggtggcttacatggtgtagggtcatctgttgttaatgcattgtcaacacaattagatgtcaaggtttataaaaatggcaaggttcattatcaagaataccaacgcggtgttgttgttaatgatcttgaaattatcggtgatactgacttatcaggaacaacagttcactttacgcctgacccagaaattttcactgaaaccactgtatttgattttgataaattagccaaacgtattcaggaattagcttttttaaatcgtggactaagaatctccatttcagacaagcgagaaggtcaagaagttgaaaaagaatatcactatgaaggtggtataggttcatacgttgagtttatcaatgagaacaaagaagtgatttttgaaaatcctatttatactgacggtgaattagatggtatttcagttgaagtagcaatgcagtatactactggatatcaagagactgttatgagttttgcaaataacatccacactcatgaaggaggaacgcacgaacaaggatttcgtactgccttgacacgtgtgattaatgattacgctaaaaagaataagattctcaaagaaaatgaagataatttaactggagaagatgttcgtgaaggtttaacagcagttatatctgttaaacatccaaatccacaatttgaaggacaaactaaaacaaaacttggaaattctgaagttgttaaaattacaaatcgtctctttagcgaagctttcaatcgattcctattagaaaatccacaagtagctaagaagattgttgaaaaaggaattttggcatctaaagcccgtattgcagcaaaacgggcgcgtgaagtaacacgtaaaaagtcaggcttagagatttcaaacttacctgggaaactggctgattgctcatctaataatgctgagatgaatgaactttttatagtggagggagattctgcgggagggtctgcaaaatcaggacgtaatcgtgagtttcaagcaattttaccgattaggggtaagattctaaacgttgaaaaagctacaatggataaaattttagcaaacgaagaaatccgaagtctcttcacagctatgggaactggatttggtgcagattttgatgtatcaaaagtcagatatcaaaaattagtcattatgactgatgccgatgttgatggagctcacatcagaactttacttttaactctgatttatcgttttatgcgacctgttttggaagcaggatatgtttatatcgctcaaccaccaatctatggtgtcaaagtaggaagtgagattaaagcttatattcagccaggggtcaatcaagaagaggaattacgtcaagctctagatacctatagttcaggacgttcaaaacctactgtacaacgttacaaaggtctaggtgagatggatgaccatcaactttgggaaacaacaatggatcctgaaaaccgcttgatggcacgtgtctcagttgatgatgcagcagaagcagataagattttcgatatgctaatgggagatcgagtagaaccacgacgtgaattcattgaagctaatgctgtttatagtaacttagatatctagtccaaagatagctttgaaaaacagttcaagtatgctataatcttaacgttatagtagatttttagaaaattagaccattataaggagagttgaatgtcgagcggaatcatattgctgcttgtggctatagtcctgcttgtgattattgcctacgtagtcggcgtcgtaataagaaaacgtaatgatacattaattgcaaacttagaaactagaaaacaagagttagttgaccttcctgtgcaagaggagattgagcaagtcaaattgcttcatttgattggccaaagtcaatcaacttttagagaatggaaccaaaaatggactgatttatcaactaattcatttaaagatattgattttcatttagttgaagctgaaaatcttaatgattcatttaattttgtgcgtgctaagcacgagattgataatgttgatagtcagctaactattatagaagaagatattgtttcgattcgtgaagctttagaagttttaaaagagcaagaagagaaaaatagtgcccgtgtaacacatgctttggacctatacgaaacacttcaaaaatcaatttctgaaaaagaagataattacgggacaaccatgccagaaattgaaaagcagttgaaaaatatcgaggctgaattttcacattttgtgaccttaaactcaactggtgacccgattgaagcttctgaagttttgaataaagcagaggagcatacgattgctttagggcaaattacagaacaaattccagctattgttgctaaattagaagacgattttccagatcagttagatgatttggagacaggatatcgtcgtcttttagaggaaaactaccatttccctgaaaaggatattgaacaacgttttcaagaagttcgtgaggctattcgttcgaattcagatggtttagttagtttggatctagatcgtgctcgcgatgaaaatgaacatattcaagaaaaaattgataaactttatgatatttttgaacgtgagattgctgcttataaagtagctcataaggatagtaaaattattcctcaattccttgctcatgcaaaatctaacaatgaacaactggggcatgaaatcaaacgattatctgctaaatatatcttaaatgaaaatgaaagcttaagtttacgttccttcacaaatgatttggaagaaattgaaacaaaggttttaccttctgtagaaaattttggtcaagaagcttcaccttatactcatctacaaattttatttgagcgtacgttgaaaacattgactactgttgaagaaaatcaaatggaagtttttgaagccgttaaaactattgaaagcgttgagacacgagcacgccaaaatatggataagtatgttaacaagctccatatgattaaacgtttcatggaaaaacgcaatcttccaggaatcccgcaagacttcttaagcactttctttacaacaagttctcaaattgaggcacttattaatgaactcagtcgcggtcgtattgatattgaggctgtttcacgtttaaatgatgtgactacaaatgctatcgctaatttagagcaagctacatatctagttgttcaagatgcgactctcacagagcagttactacagtattcaaaccgttatcgtagttttgaacaaaatgtgcaaaagagctttgaacaagctttgtacttatttgaagttgaacataactataaagcatctttcgatgaaatttcatacgcacttgagactgtggaaccaggtgtaactgaccgttttgtgacgtcttatgaaaagacacaagaacgtattcgtttctaaaaaagaagagttagtactcttctttttttaattgctatctatgaaaggtgctaattttaaggtacaatagtaaaaaagttttggaggttttaaatgattaaaggtttgttagtcatggacgttgattcaaccttaataatggaagaagctattgatttattagctattgaagcaggggtggggaaacaggttgctgcactgactgacgctgcaatgcgtggcgagttagattttgaagaagctttgaagaaaagagtagcgctacttaaaggtttgcctgttactattttgacagatatattatcctcaatacattttactccaggggcttatgaattgattaaagagtgtcacaagcgtcagatgaaagttggtcttgtatcaggaggttttcacgagacgattgatatcttagctaagcaattacaagttgattatgtcaaagcgaatcgtcttggtgtcaaaggtggttttctcactggcgaagttgagggagagattgtcactaaagaagtgaaaaaaataaagttaaaagagtgggcttctgaaaatcacttagacctttcacaaaccatcgcaatgggagatggtgccaatgatttaccaatgatcaaatccgctggggtaggaattgctttttgtgcaaaaccaattgtcagagaagaagctgcgtatcagattaatgaaaaaaatttgcttaaggtatttgatattattgatgcaaatgaaaactaggcctttattaagcctagtttttagattaaggattttaagagttttatttgagagggtattaatttgtttttagataaaaataaatcaatatattctggttttaaccagatatagtcaacggtctctccttcttgcaatgtaattatatcttttgcaccattgtattttgcgataaaatggtctacaaagtaagaacgctcagagaaccactctctattaagaaaggttagacattgaggaacgataccagtttcttctttgagttcccttagaatagcttgcttagcattttctcctttaagggcagatccgccagcggtggcttcgaaataagcaggaaaagctttctttttagggtgccgtttcatcatcaatacgtcaccatcctcatgaaaaaggataacatcaacaactaagtggaataagccttgtgggatattttgatccctattaagtgtaagacctgtaatgaacccatattggtcataagcatcccaaatttccattagacctccttgttatttttgactaaagaaatgttgccatagactttttttaggagactcctctttttttggtgaattgaataaatcagggaattgtgtctcaaaatcgttccattcaacgttttcagccttatcactatgtataataataccaaatggagaattggcatttgcttcattaacaatcgtagcagctagtgatagacggttagctaacttcatgtagaacatttgaacatcagtagggagatttggtgataattttaaactaagattaggatattcaagtatcagattattaagagcagatgttatagcaagttgaaacttttcttcttgtgcctcttttaaacttaagtggagcacaactctttctttataagtaccaaggtagtaacgttgttgatcaggatcaagacgattttcaccgcttgctttttgtaggattttattgtcaagttcagtcataatttctccttgaatttgctaattttattataacctaaatgggttgcattagcacaggtaaacttgaaaagaattagtgatttttttatcaaaaaccacgtaataaagcggtttcactgggtttttccttgttattaactaaagattatgatattatgaatatgtaaaatattaaaactcataaggagagtattgtaatgtcaattattactgatgtttacgcacgcgaagtccttgactcacgcggtaacccaacacttgaagtagaagtttatacagaatcaggtgctttcggacgtggtatggttccttcaggagcttctactggtgaacacgaagcagttgaacttcgcgacggcgacaagtctcgttacggtggtcttggaacacaaaaagctgttgacaatgtaaataacgttattgcagaagcaatcattggttatgatgtacgcgaccaacaagctatcgaccgtgctatgatcgctcttgacggaactcctaataaaggtaaattaggtgcaaatgctattcttggtgtttctattgccgtagcacgtgctgcagctgattaccttgaagtaccactttacagctaccttggtggattcaacactaaagttcttccaactccaatgatgaacatcatcaacggtggttctcactcagacgctccaatcgcattccaagaattcatgattatgccagttggtgcaccaactttcaaagaagcacttcgttggggtgctgaagtattccatgctcttaagaaaatccttaaagaacgtggtcttgaaacagctgttggtgatgaaggtggatttgcacctaaatttgaaggtactgaagatggcgtagaaactattcttaaagctattgaagcagctggttacgaagctggcgaaaacggaatcatgattggttttgactgtgcttcatcagagttctacgatgcagaacgtaaagtatacgactacagtaaattcgaaggtgaaggtggagcagttcgtactgctgcagaacaaatcgattaccttgaagagttggttaacaaatacccaatcatcactattgaagatggtatggatgaaaacgactgggatggttggaaagctcttacagaacgccttggtggacgtgtacaattagttggtgacgatttcttcgttacaaatactgattacttagcacgtggtatcaaagaagaagctgctaactcaatccttatcaaagttaaccaaatcggtactttgacagaaactttcgaagctattgaaatggctaaagaagctggttacactgcagttgtatcacaccgttcaggtgaaactgaagattcaacaatcgctgatatcgcagttgcaactaacgctggtcaaattaaaacaggttcattatcacgtactgaccgtattgctaaatacaaccaattacttcgtatcgaagaccaacttggtgaagttgctcaatacaaaggtatcaaatcattctacaacttaaaaaaatagtctcagattattaaacagttgaaaatataataaaaaccatcttgcatatgcaagatggtttttatgtacacattataataatagaattgatttgataataaacagttctaccattgcaatccagcagcagcgatttctgcttttgaagcgtattgtccatttggacgatgccaccttcctctatagtcacgtttgtagccttgactagtttgttcttgtactagagtttcttgttttttctgagtttcagctgcgagccttgcttgctcctctttttgcttcctttgagcttcagcagcaagccttgcttgttcttcttccagttttttctgagtttcagcagcagctttttcctcttcaactttcttttctgcaagtcgtttttcttcttcgtgcttagcgataagttttctttgttctttagctgataagacagtattttgagcctttccgctgaggtagtcaatggtagcatttggtgaggtattctctaaggtaacagtgctgatgccgaattgatcttgagtggatttgtttccgataaaaataggtaataatttcccagtcttatcaataccaacatattttaattcaatttttcttggaattagttcattattttgataaattggtgttactttataatctaagtagtagtttttatgagtcgaaagccaagtctttagttgtttttcatagaatagcatgctctcagggttagatgaattcgtgctattgtagtttccagtatttagccaattcgtcattggaactaaattctttctttcattgtttagtccactaaattggtggcaaataagacggcctcggctcattagccaagctttttgagtaccatcattataatagaatttaaaattgtgccatccaacaggggttgtttttaaacgttttactctctttttcttgggttcatctttaacttttagctgaatatgtgcgaatgtggcacgacctttgtcatccaactctcctaaaaccaattgtcgtttgtgtttaaaaggtaaagtaccattctcttttgttttatactcttgagcagtaacaatattttctgtggtatgatttgtagctaggtttattggtgtgtaaagcgaaataaccgttagtaaggttgcaattcctaattttataaactgttttcttttcatctgttaacctctaaaataacataaaatagtagctgtttatttttaaatgcattctgaaaattaaaatgtgatttttgtaacaatattataacataatgatgtatgacatgtgaagttaatttataaaagatgttacagctatatagaggagctatagtataaataaaaaattcaaaatatagcatatattatgatacaataatagcaaaatagattttgggagttatcatgaaattactgactaatgcaaatactctcaagggaaccatccgtgttcctggcgataaatcaataagtcacagggctattatttttgggagtatatctcagggagttacccgaattgttgatgtcttaagaggcgaggatgttttatcaactatagaggcttttaaacaaatgggggttctaattgaagacgatggcgagataatcactatctatggcaaaggatttgcaggtttaacacaaccgaataatctcttagacatgggaaactctggtacttcaatgcgtctgatagcaggtgtgttagctggtcaagagtttgaagtgacgatggttggagacaatagtttgtcaaagagacctatggatcgtatagcattgcctttaagcaaaatgggagctagaatttcgggagtaactaaccgtgatttaccaccattaaaacttcaaggtacaaaaaaattaaaacctattttttaccatttacccgtagcttctgcacaagtaaaatcagctttaatttttgcggctttacaaactaagggagaatctctcattgtagaaaaagagcaaacaaggaatcatactgaggacatgattcggcaatttggtggacatttggatattaaagataaagaaattcgactcaatggcggtcagagcttagtaggacaagatataagagttcctggtgatatttcgagtgctgccttttggatagtagcgggtcttattattcctaacagtcatattattttagaaaacgtaggtataaacgagacacgaactggaatccttgatgtcgtcagtaaaatgggtggaaaaattaagttatcttcggttgataatcaagtaaaatcagcaacccttacagttgattactctcatctacaagctactcatatttctggggctatgattccacgtctgattgatgaattacctattattgctcttttagcaacacaagctcaaggcaccacagtcatagcagatgctcaggaattaaaggtgaaagagacagatcggattcaggtcgttgtcgaatcgctaaaacagatgggtgctgatattactgctacagcagatggtatgattatacgtggtaatacccctcttcacgctgcttcacttgattgtcatggagatcatagaataggaatgatgatagctattgctgctctcttggtcaaagaaggcgaagtagatttatctggtgaagaagctattaatacaagctatcctaactttttagaacatttggagggattagttaatgcctaaggtattattgggattcatgggagttggcaagactagtgttgccaactgcttagaaaatgaagtaattgatatggatagtctgattgaaaaacatattggtatgtcaatttcccgattttttacagaagaaggagaagcctcctttcgtgctttagaatctcaatttttaaacgaacttttaaagaaaaaaaatgaaggacttgtgatagctagtggaggaggtattgtactccttgaagaaaatcgtcgtcttttaactttaaatcgtcataataatattcttttaacaggaagttttgaagtcttatatcatcgtataaaaaaagatgagaagaatagaagaccattatttttaaaccattcaaaagaagaattttatgatatttatcaaaaacgcatgttactctatagtggtttgtctgatatgattattgataccgattatcttacaccacaaaaaatagctactgtaattggagagtcactggttaatttatctaactaagttatcacagtttggtagtatgaactattattattgaaagtaaatcacctgaaaatatgtcaagaaataattacggtcagctaaatcatcatgaagagctacgatataactatcttttaaaaaacatccattatcttaatgaacgtgaaaagatggaatttcagtaccttcattataaaaaaacagcagtacgaccacagagaaggacagaaagtccaccaactaattcttattatgaggaaccttattctgattcttattatcaagatgacgatttttactcagagcctcagctaacctcacaaggtttaccaatttatcaagaagagagagctccgaagaagaaaaaacaaagggccagaaaagaaaaacagagggtgaaggttatggcgcctttccctccaaaggctataaccccccctagaaagaaaaaaaaatttaagggtttcctaaagttcataggtattatattactaattgttttatcaggtatggttttcatgtttgttaaaggaatgcgtgatgtgaataatgggaagtcacattatagccctgcaattattgaagattttaagggaaaagatgctgttgatgggactaatatcttaattttaggtagtgataaacgtgtcagcgagagatctactgatgcgagaacagataccataatggttgctaatgttggtaacaaggataataaggttaagatggtgagttttatgcgagatctcttagtcaatattcctaattatagtacggaaggttactatgatatgaaattaaatgcgtcttttaatttgggagaacaagataatcataaaggagcagagtatgttcgacaaacgttgaaaaatcattttgatattgatataaaatattatgttatggttgactttgagacatttgcagatgctattgatacactgtttcctaatggtgtcaagattaatgctaaatttggacttgtcggtggacaatctgctgattcagttaaagttcctgatgatttaaggatgaaaaatggcgttgtacctagccaaaaaattaaggttgggattcagtacatggatggaaggacccttctaaattatgctcgtttcagaaaagacgatgatggggactttggtcgaacacaacgtcaacaacaagttatgagagctattgtctctcaaataaaagacccacgtcgtctctttacaggttctgctgctatcggtaaagcctatgctttaacttcaagtaatttatcttatagctttgtcctaacagatggcattccaattttatcagatgctaaaaatggtattaagcaaatgacaattccaagagaaggagattgggtagatgattatgaccagtatggtggtcaagggttaacaattgattttgctaagtacaaaaagatcctaaagaaaatgggactgcgttaacatttttaattatgatataatagagtgatttattgtcactctatttttatctttagtgtataaactaaagacttcaaatgatagatataaaaggaaaattatgttacataaaaatgatattattgaaactgaaattagcgacattagccatgagggaatgggtattgccaaagtagatggctttgttttctttgttgaaaatgctcttccaggtgagattattaagatgcgcgtcttgaaattacgtaagcgtataggatatggaaaagttgaggaatatttaacgacttctcctcaccgaaatgaaggattagactatacctatttacgtacagggattgctgatttgggacatcttacttatgaacaacagctgttatttaaacaaaaacaagtagctgataacctttataaaattgctcatatatctgatgttttagtagaacctactcttggtatgacaatccctttggcatatcgaaataaagctcaggtaccagttcgtcgtgttgatggacagctagagacaggttttttcagaaaaaattcacatactctggtatccattgaagattatttaattcaggaaaaagagattgatgctctgattaattttacacgagatttattaagaaaatttgatgttaaaccatatgacgaagagcagcaatctggtttaattagaaatctcgttgttcgtcgaggacattatacagggcaattaatgttggttttggtgacaacacgtcctaaaatattccgcattgaccaaatgattgaaaagttggtgtctgcctttccttctgttgtttcaattatgcaaaatattaatgatcgtaatagcaacgttatttttgggaaagaatttcgtactctatatggttctgatactattgaggaccaaatgttaggaaatacttacgctatatcagcccaatctttttaccaagttaatactgaaatggctgaaaaactgtaccaaaaagcaatcgatttttcagatttaaactcagaggatatcgttattgatgcctattcaggtataggaacaattggcttatctgttgctaaacaagtaaaacatgtttatggtgttgaagttgttgaaaaagcagtaagtgatgccaaagaaaatgctactcgaaatgggataactaacagtacctatgttgctgattcggctgaaaatgcaatggcaaagtggcttaaagaaggtataaaaccaactgttataatggttgatccaccacgaaaaggattaacggagagttttgtatattctgctgcccaaacaaaagcagataaaatcacttatatttcttgtaattcagcgacaatggcgcgtgatatcaaactatttgaagaattagggtatcatttagtaaaaattcaaccagtagacttattcccaatgacacatcatgtggagtgtgtggctctgctcgtaaaagcctagaaactttttaacgaaaggaatattaaaaagccttagataatcgactgacctattaccaaaaaatcgaaggggctctacttgccattgcacaaacaccaggaaatagtttgccaactatgcagctgttagatgagttagttcttccaaaagacattaccatagcagatgtcagtcaaagtatccaagaatttgaaatagaaagagatgcccttcaagaattttttgacgatatgctgaagacttatacaacctaccaagaaatgaaagattatattaaatctcgtgaagcgaacactcctaagcaagagacagaagaaaaatcactttgaagactgtagacttaacataagtaaaaaataaccatatatgatatcgctttcattcttatgttttttgtgataaactaattaaagaaataatttttatactttattatggaggttcttatgaagaaagtgttagtgagtagtcttttggttttagggattacgataacgttacaaacagtagttgaggctaaggggccaaaagtagcttatacacaagagggaatgactgctctttcggacacaaataaagataaagtcactactatttctattgacgagattcaaaaaagcttagaaggtaagaagccgattactgttagttttgatattgatgatacactgcttttcagtagtcaatattttcaatatggtaaagaatatgtaactcctggatcgtttgattttcttcataaacaaaaattctgggatcttgttgcaaaacgaggagatcaagattccattcccaaagaatatgctaaaaaattaattgctatgcatcaaaaacgaggagataaaattgtttttataacaggtaggacaagagggtcaatgtataaggagggcgaggttgataaaacagctaaagccttagctaaagattttaaattagacaaaccaattgctgtaaattatacaggcgataaacctaaaaagccatacaaatatgataaatcatattatattaagaaatatggttcagacattcattatggagatagtgatgacgatattcatgcagctagggaggccggtgctagaccaattagaattttaagagcacctaattctacaaatctacctttaccagaagctggaggctacggtgaagaggttctcgaaaattcagcttactagtatctttattagttaacatagtattatctatcaatttttagatttgtaataagaagtgctaaaaaagtagcaaatcaatgatatgctaataagggaagttggagtagtttagattgattattaatgactgatcttctcccctctcggtaacaagaagtttttctaacaaatgcctgtctaaaaaaattgaatcataattttttaataactcttttggcgtgaacaaggaatttgtaatcagtcatctaattctataatacaatactttggggttgtttccgtatcattattaataatatgtatcagaaaggagatgttttttgagagtttatgaaaataaagaagagttgaaaaaagaaataagtaaaacatttgagaaatacattatggaatttaataatattccagagaatctaaaagataaaagaattgatgaagttgatagaactccagcagccaacctttcttatcaggttggctggaccaacttggttcttaaatgggaagaagatgaaagaaagggacttcaagtaaaaacaccatcggataaatttaaatggaatcaacttggtgaattatatcagtggttcacagatacctacgctcatttatctctgcaagagttgaaagcaaaattaaatgaaaatattaattctatctatgcaatgattgatttgttgagtgaggaagaattatttgaagcgcatatgagaaagtgggctgatgaagcgactaaaacagcgacttgggaagtgtataagtttattcatgtaaatacggttgcaccttttggaactttcagaactaaaatcagaaaatggaagaagatagtattataaattatatttttaactttaaaaaatttcataaaaatggttaccaaaggcgatagaagaaaaaactatcgtctttttctttataaagtattagatgaggaaaagaaatattattttttctaatacaaatattaaattctcacgacagatgtaatatatcttgctatttcttcaggctcttcagtaaagtcatgatctatccaatttaaaataatactttcaattgttgagatataaataccaagagcgaaagaatatggaacttgatatgctgtttccagttgtttttgtaagtctggtatatcggaatgtgtaatcatctctttgatatagtttttaattatgttgtcaatattcggaaaaaacaaaggatttaataatttctttatttatatacatatagctaagcatctcctttaagaccacttcttcatataataaatcattatttaaaatttttgtgatatcatcaaagattattaaaatagactccctaaggaagtcttcttttgaattgtaatgattatagaaagatcttctactaagtcgagctttttttgctaaatcgctaactttaatttgctcaaagctcctcatctttaacaattctgagaaagcttttaaaaattttaaattagtgttatctgaacttaccaatatactatcacctttatataaaatcttaaagttataaatcttatcgaatgtgattatacaatacaaattcaaataatagttcacatttatcgagataatgtaaaacagtaaaactttaaaaaaagtaaaaatagataactttattggttaatctatttttacttttgaaaaggagagaagttatgcttaggaagtataagcaaagaaattataatgtcgcacatacgaaacagcgtttttcgattaagaaattcaaatttggtgtagcatcggtattaattggattgacatttctaggaatgagtagtcattctgttttggcggatgagtcaagcattatgagtactgaggtaccacaaacagctggtgtaaaaccggaagttactgttacacagcctacttcagatgtaacaagtcttgcgacagatacgtcaacttcagcagtgttatcaacagatgcatctcattctaatcctacagaatcagcggagcatgctgtaggattagaatgagatgcagcggttccagtgacacacgaaaaagaagcaaataaaacattgcgagttacttcttcttccacatctgaattcacagagtggactaatgtcaaataagtagacagaaaaccgtgttattttattgcgttaaaataattttcttctttctgattaggggttagtcctagattagccgtatgtgggatgtaattgttataaaaattctcaatgtattcaaagcagtctaattgaacctgtttgatattttgataatgttttcggttgatttgtctatgctttaaatacttgaaaaatgcttcagttacggcattatcataaggatatccaggtttagaaaaagaatgcatgatattgttgtcatcaattatttttctaaattccctggccttaaattgtgacccttggtcggaatgaaagagaagtgttccttcaatctttcttttattaagagctaattctagagtgttacatgctaactttgcatccatacggtgactcaatttccaagcaatacattttctagaatagagatcaagtattgcgcagagatagacatatttcttatatccaatagaaatataggtgaagtcagtagaccatacttgattaggtttgtcaggataaaatttctggttgagtaagttttgaggatacgttttttgagtctttttaagagctgtttttgtcttaacggtagccattttagggagcgccatattcttcatcagatggtaaattcttccttcagagatttttgtgtcgtagtctctttgaagaatgactttgatagacttcacaccaagtcttttgtttgctttggtataaatctcaagtatttgttttttataaatttgattatccaattctctttttgagggcttatgttttagaaatttatagtaagtggagcgattgacacgtaaaacacgacacaaggttgttgtggcgtgttcaaagcgtaaccgatagacagcgaggagtcttactttaagttttgcatgaatatggcacttgctttttttaggataaggttctcctcttcaagctgcgcattacgtttttgtaactcttgtatttgcttggcagtaagtacagaattatcttcgagtttgaattgagagtactgtttgatccattttgcaagcgcagaagtggataccctatagtctttacagagttcagactgagtttttccagtttgataaaggttaacaagagattgtttgaattcttcatcatagcgtttaaatgttgacataggttgtcctttcgtttttgtgtcttttaaaacagattgtaacacacaaagttttgtctacttttatagtatacatccaccctttggcaataccaaaagtttgagcagattagttgagatgtgcaggaagttttgattatcgcaagagagaatcatcaagtgactcatgaacacgtgtcaatcttattgacctgcgttcaagaattgattgtggaagtcaatcaaacacagccactcagtcgtgagtttcgtgaaaagtatatgggttaggaggctgcaattgtttatcgttatcgtaccaatctcaaaaaagtctttctaacagattcagaattgaatcaattaaatgagcggattgctaagagcaattgtcaaaatttctcagtctatgctagaagagttcttcttaatcccaatatgtcatttgtcacgattaacacggattggaaataacatcaatcaaattgcgcgtgctatcaaccaaagccatctaatttctcaggctcagtatcactttcatcgagaagcacgttaagcccaacagcaggggggttgctctgattcggttaagtaataagcaaaatcctcaccaattttcccagtaataagaggcgttgttgaggtatagggattacctgtgccatagtcgatgatggtcacaaaatgaccattccccataaaagggccaaccaaaacttcacctgtgaccgttttttgatgtcaacaccagtattttggatgtaccccttaacatgccctttggtatctgcaacagagataatatgaccaaaggaagaatcaccgatgactttaaccgtaatcttgctatcgcctttttgattagccgctaatatttgattagcaatcagggtgcgaccaagagcaactgttgaagacgacaaggtatgatgtttttcctgagccaatttaacagtctcggtgctatcgaggacataagacctgaaggcaccagaggcagaaattgatttaataattttatccataacctatgttatagcacaaagagagagtttgtatggactggattagctgaaaattttagactaaaaagtagtgccagtggattttgaaaggtaacaaaagagtcttccgtttaaacgagaaggctctttttagtcgtttcagatgaaggcaaaaggacgatgaaataattccgtaccttcatggattgctatgttactggcatgaggtctcacgatatttagtaagatattcgtttgaagatattcccacgtattttttaaaggttttaagaaaatgtgtggtgtcgtaaaaatgtaataatttcgctacttccccaatcggtacccctctttgcagtagtaattgtccctccttaatttttgcctttagaatataactttgcaaggaaatgtcagagtattttttaaaaactgagcgtaagtgggaatctgagatatataggtagttggcaatatcagatactttgagtttggagtagaggtggttgtccacataatggagaatactattgtacatttgctgcttgtcagagatgctcttattggttaaggattctgaaaaatcaataagagctgcacagcgaattcttgaaacatcaataagatcaggagcctcttcgtttaaagccatatagtgctttaccagcgcataacttttagccacatcagtattttcctcgaaacttaattctagtaattttgttaagtaaacaacagttaagttcttttcagctcttagggcagggattgaagatgaggtaacactggatgatgggaggcgattaatttcttgctttaacagttgagtgttacccagcttaacgagatcaataatgtgattgagatggtttaaaacagtgggtaactgaaaagagtttttcttagtatgttttaggtgaagaacaatatcaggatccgcaacaatctgttctgactcttctaataaatgattgatgacttgttggcaactagcctcaaactgtgtttggaaaaaggcatcgatagacacaagaagactacgtatactggtagtaggaaaacaagggacaagctttatataggataagatttcttttttattacgatgagaaaattgttctagaaagcgactggataactgttcttgcctattgatatcagggctatagggataaaatggtccaatagcaataagatattgacagacaggaaaaattaagaatgattcttcaaaaagaccctcataaacagtgatatcttggttataagggatagctaaatgttttaaaaactgatagtaaggcaacagatagtcttcgttaccatataactgaacgagttccttgtctcgtgacatgactgaaataggtagttgagatatggtatgcaatgtttgaacatgtttaaaatcgaatgtaaccatttgatagaccgccttcattatcatttctagaatttttctttaggtttgtaaagactacaaaataaaatgatgaaaacaactatcttgtggatacactaaaaagacacgctaattagcaaactctctcttcatcatctctcaccattattatactactatttatatgacaaataaaggtgattttgttaaaatataactttgaaaatccacatatatttttaatcttccgtctgaaaaaataaataaaaatagtaaaaataaacacgaatttaaaataagcaaattttttaagaaaatctgtgctaaactttaatagttttgtgcttaataataatcagcacttacaaagaacaaagggaaaagcgaggagagaacttttaatgaaattatcgaagaagttattgttttcggctgctgttttaacaatggtggcggggtcaactgttgaaccagtagctcagtttgcgactggaatgagtattgtaagagctgcagaagtgtcacaagaacgcccagcgaaaacaacagtaaatatctataaattacaagctgatagttataaatcggaaattacttctaatggtggtatcgagaataaagacggcgaagtaatatctaactatgctaaacttggtgacaatgtaaaaggtttgcaaggtgtacagtttaaacgttataaagtcaagacggatatttctgttgatgaattgaaaaaattgacaacagttgaagcagcagatgcaaaagttggaacgattcttgaagaaggtgtcagtctacctcaaaaaactaatgctcaaggtttggtcgtcgatgctctggattcaaaaagtaatgtgagatacttgtatgtagaagatttaaagaattcaccttcaaacattaccaaagcttatgctgtaccgtttgtgttggaattaccagttgctaactctacaggtacaggtttcctttctgaaattaatatttaccctaaaaacgttgtaactgatgaaccaaaaacagataaagatgttaaaaaattaggtcaggacgatgcaggttatacgattggtgaagaattcaaatggttcttgaaatctacaatccctgccaatttaggtgactatgaaaaatttgaaattactgataaatttgcagatggcttgacttataaatctgttggaaaaatcaagattggttcgaaaacactgaatagagatgagcactacactattgatgaaccaacagttgataaccaaaatacattaaaaattacgtttaaaccagagaaatttaaagaaattgctgagctacttaaaggaatgacccttgttaaaaatcaagatgctcttgataaagctactgcaaatacagatgatgcggcatttttggaaattccagttgcatcaactattaatgaaaaagcagttttaggaaaagcaattgaaaatacttttgaacttcaatatgaccatactcctgataaagctgacaatccaaaaccatctaatcctccaagaaaaccagaagttcatactggtgggaaacgatttgtaaagaaagactcaacagaaacacaaacactaggtggtgctgagtttgatttgttggcttctgatgggacagcagtaaaatggacagatgctcttattaaagcgaatactaataaaaactatattgctggagaagctgttactgggcaaccaatcaaattgaaatcacatacagacggtacgtttgagattaaaggtttggcttatgcagttgatgcgaatgcagagggtacagcagtaacttacaaattaaaagaaacaaaagcaccagaaggttatgtaatccctgataaagaaatcgagtttacagtatcacaaacatcttataatacaaaaccaactgacatcacggttgatagtgctgatgcaacacctgatacaattaaaaacaacaaacgtccttcaatccctaatactggtggtattggtacggctatctttgtcgctatcggtgctgcggtgatggcttttgctgttaaggggatgaagcgtcgtacaaaagataactaaataaaaggctacttcttaagtaaccatgtttaagaaaagagaaatagccttatttctctttttgtcgtttttaaaataaaggaacatcatgaaacaaacattaaaacttatgttttcttttctgttgatgttagggactatgtttggaattagccaaactgttttagcgcaagaaactcatcagttgacgattgttcatcttgaagcaagggatattgatcgtccaaatccacagttggagattgcccctaaagaagggactccaattgaaggagtactctatcagttgtaccaattaaaatcaactgaagatggcgatttgttggcacattggaattccctaactatcacagaattgaaaaaacaggcgcagcaggtttttgaagccactactaatcaacaaggaaaggctacatttaaccaactaccagatggaatttattatggtctggcggttaaagccggtgaaaaaaatcgtaatgtctcagctttcttggttgacttgtctgaggataaagtgatttatcctaaaatcatctggtccacaggtgagttggacttgcttaaagttggtgtggatggtgataccaaaaaaccactagcaggcgttgtctttgaactttatgaaaagaatggtaggactcctattcgtgtgaaaaatggggtgcattctcaagatattgacgctgcaaaacatttagaaacagattcatcagggcatatcagaatttccgggctcatccatggggactatgtcttaaaagaaatcgagacacagtcaggatatcagatcggacaggcagagactgctgtgactattgaaaaatcaaaaacagtaacagtaacgattgaaaataaaaaagttccgacacctaaagtgccatctcgaggaggtcttattcccaaaacaggtgagcaacaggcaatggcacttgtaattattggtggtattttaattgctttagccttacgattactatcaaaacatcggaaacatcaaaataaggattagcatgggacaaaaatcaaaaatatctctagctacgaatattcgtatatggatttttcgtttaattttcttagcgggtttccttgttttggcatttcccatcgttagtcaggtcatgtactttcaagcctctcacgccaatattaatgcttttaaagaagctgttaccaagattgaccgggtggagattaatcggcgtttagaacttgcttatgcttataacgccagtatagcaggtgccaaaactaatggcgaatatccagcgcttaaagacccctactctgctgaacaaaagcaggcaggggtcgttgagtacgcccgcatgcttgaagtcaaagaacaaataggtcatgtgattattccaagaattaatcaggatatccctatttacgctggctctgctgaagaaaatcttcagaggggcgttggacatttagaggggaccagtcttccagtcggtggtgagtcaactcatgccgttctaactgcccatcgagggctaccaacggccaagctatttaccaatttagacaaggtaacagtaggtgaccgtttttacattgaacacatcggcggaaagattgcttatcaggtagaccaaatcaaagttatcgcccctgatcagttagaggatttgtacgtgattcaaggagaagatcacgtcaccctattaacttgcacaccttatatgataaatagtcatcgcctcctcgttcgaggcaagcgaattccttatgtggaaaaaacagtgcagaaagattcaaagaccttcaggcaacaacaatacctaacctatgctatgtgggtagtcgttggacttatcttgctgtcgcttctcatttggtttaaaaagacgaaacagaaaaagcggagaaagaatgaaaaagcggctagtcaaaatagtcacaataattcgaaataataaaatcagaaccctcatttttgtgatgggaagtctgattctcttatttccgattgtgagccaggtaagttactaccttgcttcgcatcaaaatattaatcaatttaagcgggaagtcgctaagattgatactaatacggttgaacgacgcatcgctttagctaatgcttacaatgagacgttatcaaggaatcccttgcttatagacccttttaccagtaagcaaaaagaaggtttgagagagtatgctcgtatgcttgaagttcatgagcaaataggtcatgtggcaatcccaagtattggggttgatattccaatttatgctggaacatccgaaactgtgcttcagaaaggtagtgggcatttggagggaaccagtcttccagtgggaggtttgtcaacccattcagtactaactgcccaccgtggcttgccaacagctaggctatttaccgacttaaataaagttaaaaaaggccagattttctatgtgacgaacatcaaggaaacacttgcctacaaagtcgtgtctatcaaagttgtggatccaacagctttaagtgaggttaagattgtcaatggtaaggattatataaccttgctgacttgcacaccttacatgatcaatagtcatcgtctcttggtaaaaggagagcgtattccttatgattctaccgaggcggaaaagcacaaagaacaaaccgtacaagattatcgtttgtcactagtgttgaagatactactagtattattaattggactcttcatcgtgataatgatgagaagatggatgcaacatcgtcaataacgatgttgtgaatggcttacttatcaaataggtgactaatgatgattgtgaataatggttatctagaagggagaaaaatgaaaaagagacaaaaaatatggagagggttatcagttactttactaatcctgtcccaaattccatttggtatattggtacaaggtgaaacccaagataccaatcaagcacttggaaaagtaattgttaaaaaaacgggagacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaattacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattgtaaggtgtcgttgaaattattaaataatagaaaatgactagttttggcctttccctattgtcagtcagattagttattatcaagcttctcatgccaatattaatgcctttaaaagaacagttacaaccattgaccgtacggagattcaacgacggttaggtctggctaaagcctacaatgctagtatttctggaacaagtagtcagtcgactcaatctgtgctgagagattcttattctgaggagcaaaaaaggcagggtggactgaatacgctaggatgttagaagtcagagagcaggttgaccatgtgatgattccaaaaatcaatcaggatttaccaatctacgctggttcagaagaggacaatctgcaacggggagttggtcatctagaagggataagtttgccgattggaggggcttctacacatgcggtcttgagcggtcaaagaggtatgccagctgctcggttgtttgcggatttggataagatgaaaaaaggtgattatttttatgttaccaatctgaaagaaaccttggcttatcaagtggatcgtatcatggtgattgaacctagccaattggatgccgtgagcattgaagaggataaagattatgttacccttctgacctgtacaccttatatgggctctttgtcaactgtaatgggtgacttatcattaacaacgagagagaatcagcttggttctctctctttttggatgttcaaagcgatgagaattttgcttttaaaatttttaaagttgcgaaagccaaaggcttgtcgcttgatgtctttgataagcttgttggtcgcttctaatttggcattggaaagggatagctgagggcgtttgtgatgtaagttttgtacttcatgaaggtcctaaagaccattttaaaagcagaattgccagttgttacgttatcatctatgaagctaaagaattcagttgttcgcttttcttagaaatgaaagagtatgagctgataaaggtcgttataatagcggagctcatctgagaaaacttttatacctcaaagtcagtctagctttgatatcatgaagccattaggagttattccttatcttttagtggcgcgcgatccatatagtgatagatcgagatatttagatccaaaagttctatcatcctcttttggcgccttttttccagcagataatattaaggtagcttggtctaacaactccagcactttatttacaccacctattaatgcaaactacaccactcagattcaagctattgggacaacgattaagtcacaaattccggaatcgattttgacggttacggataaaaagagcaggaagttcagcattaacaagattgacgaagctaaagaaggcttagtaggtgcgaccttcaccttgtctaaacgcacaacagtagcggcagatcatcaagtacaaggagatttcattcctgtcagcaaagagacgacagtcggtcggacaacccttacctttgacaaccttaaacctggattttatgaccttaaagaaacgaaagcgccgaatgcttacgtacttgatcctaagacttatgttgtggtcgttcaaaattcaggaaaaacgacaattgtggatgaagctaacttcaaagaggctgattacccaatggctgataataccagccatgtggagtgcgtagcgttgctacaacgaagcaaagggtaaaaatcctttattttaagcactttttcaagcattttgtctttattgaaaagagtgattttaacataaaaaaggtattaaaaaacatattgacgtgaccgtttgttttgaagtggcttgcgtagacaaaaaaatagatacgtcagataaatttctggcattacgagaacatttttagagtgttctctttttttagtttacggaggaaaaatatatatggaaaaacaggattcacgagttctcatccattgggaggggaattctggggacaagctcattgaacaccaaaccagcgcaacggggtggtactaccaagtcgatcgtagctttagtcaaccaaaaggggaaccgcccagaatgatccaaaggcactagaaagtgtccgtaatgattcgatttcgggcggtgatgatgtcatgggttatgcttatagcaaatgtacttggggagttgcggcacgaattaatcagtgggactgaaactcaaaggttgaaatggtgagaagattaccattaccagttcaatgggaaatggtcaggattgggttggaacagccgaaagactagatggtgaaactgatacagttccaaaagaaggtactattctctctttttaggaaagtagttatggttcgtatataggctacggaactatatctttcgtcacattacatctacagatagtaccatgaattttgcttatatgaccaagtaaagtgaggatatactaacaaatgaaatatttattatcgtatttgtccattttatcgaaaagtttgcatattatcattatgtttgataagatgcaaatataatgatagtaggagctaaatatggatatttaaaaaatcaagagtatcctaagtgctttccattttgaaattcaaatatagctaatagttctagaacttctaattgtttttcgtcgacgatatgaattttcaatcttaactgttaggattccacctccctttggttaaagaaaaaaggtcaggtcgtttagataactttgtcaaacaagctcaagctatctaaaaatagtttgaaatgggcattactctagtttttaataagctatctgatgagcagaaggagaagttaatgcatgttgggaagtcttattttgactatcaagaaaatgctcttatcccacaattaggttttctatattctaaattaactaaaaaaattgaacttgataatcggttgtctccgactgaaaaaaagttattgattaccttattattacatactaaaggtttaatcattgatatgtaagaagtaagtcagctaaccgatctttctattctaaaacttatattgttgctttagaaattttaaagagcgtggatggcttcataataaacagaaatcttaccaatttgcgaagccaaaaaatatgatatttgaagagtccaaagatctaatagatagtccagttagagaagcgttgattataagtgataaggattttcaaaaattaaaacaagagctattattttaaccgacttattttaaagacttatcatatctaggcttgcttgatgattcggaaaaatacggagactatactatttcaaggaaaagatacaaaagtttcgaatcaagtcttcaactatacatccttcaaagtcatcggctagagatttggaattatgaaccaatccctttgattactagaaaaataaatagcttggagaggctaacgtgacactggttgatccaatctcgctttatttaacactaagaatgatgaagaccctcgtattgaagaagaagttgagcagctagaagataagattttgagaatataatcgttttttcgtgctacactaacttgtcagggttgcaacagacaaaaaaataatttaggagggattcgttatgcgtacaaagtatataggatatgaaattgttttaaggggtggttattaatatggataagaaaaaggttgtttcaactatcgtatctacagggtttcttatagtttcaatatcaaatttttttagagagctatcacctatactttttctcttgaatattattggatttttctgcttcctattattattttctgccaacataaataaattgttcttaaaacgatagccgttatataggatatggtatgtatgcatttggtgaaattataggtaaaacgaatggaatagtacttactcctcaaagctatcgtgagaggtataaaaggatatcgaggagtcactagatagttggatctcattgaaaaaatttgtttaaagtatctcatataagcataaaacgaggaatcaatcaaaatttcttgattgattccttgttttttggctctttgtcaactgtagtgggttgatgaaaaattatattctggagaaaaccaaattggttttctcctttttgatattcaaagtgatatgaattctctttttaaaatattcaaagtttctaaagctaaatgtttgtgcttgatgattttgatgagattattggttgctcaagtttggtgtttgaataaggcgattcaaggacattgataaccttatctctgtctttaaaaaatgtcctaaaaacagtttaaaagattggagtgacactagagaaagtgttttaaacagggtaaagaaatggtgagcttgcttctcttgaaagtaaagcaggaggagttgatagagtttcataatgttttttatagagaagcgatatcttcttatcttgaaacagaaaattttgagaaggctaaagtgactgaagagaattaccaagtttttttaggaatccgtacttatcagaagagttataactatcaagatcatagtgagaatctaaaaggaaatattgaggtagcaatgataggagttgaaaataatattagcgacgaacatattttttgctagaatatataaaatgtctttgaaataatttagccctgtgttatgatattaaggaggttatttatggtacgtaaatttttaaaatcgctcctatctctctttcttatagcagtaatcgccaccggtatttcagtggcatgtttcttttttattccagaaaataaagggaatattacaccgattttattgcatcgctttatgcgaaaaaataatgttaatggaatgatgattgttagcgataatactggtaaaccgattaccatctcgcatgggattaaccgtggggaagttgaaacggatattgaaaataataaattatttccaatggcttctctccaaaaactcatgacaggaattattatccaaagattaattgatcaagatgtcttgagtgaagacgaccgattgtctcagttctttccccaagtaaaaggtagtaatagtattaccatccaccaattgttgacccatacgagtgggttaagagaaaaaggtgttaaggtgtctccttatctaaaaaatgagagagaacaattacaattttgcttaaaacactataactttgttaataagaaatcgtggtattattctaatatcaactttagtttcctaacaggtatagccactcaagttacgggaaggacctacgctgaacttgttgatgatgtgataaaaaatcctttgcgattagatgatacccaaagttaccaatcagttgttaatcatgacttagttagcccaatgcgaaagaacggcaagttaaataaaattaatatctttaatcaagtatccacagcatatggagctggagattttttcacaactccgctgaacttttgggtgttgatgcggtctttttctaaagggtactttttcccaacggatgaatataccaaacatcaaaatgatgcgatatcacattattatggtgggctttacatgcatggtcgtatagttaattctaatgggacctttttccagtattcaagttttggttatgcagatctaaagacgcatgatacaatggtgctttttatgaataacaaagtctatagtgatgctagtcacgtggcaccaaaagcatttgaatattatcaaaaatttatgttccttaataagattttccacttagtcttttactttgtattttctttctttttaatgcttttaatacgtcattcgtttaggaaaagaaggtataagaaacgtctctaaatcacatgaataaaaaagaaggctaagttggccttcttttttattcaatattaagcagtaacaccatctaagaaaacgtttgcattgaatttttaattgtgctataataaatagctgttaatcattattatagtttaataatctaactgtcgagctgatttaagctataaaaatactgttgagtaaaagaggtattaatatgtcaatgattgaagtttctcaccttcagaaaaattttataaaaaccgttaaagcaccagggttaaaaggagcatttcaatcatttcttcgtcctgaaaaacacacctttgaagctgttaaagatttaacatttgatgtgcctaaaggacaaattctgggatttattggagcgaacggtgcaggaaaatctacaacaattaaaatgttaactgggattttaaaaccaacttcgggcttttgccgtattgatggcaaattgccacaagaaaaccgacaaaattatgttaaggatattggagtcgtttttgggcaacgtacgcagttatggtgggatttagctctacaagaaacctatacagtgttaaaagaaatctatgacgttcctgataaagaatttcgcaaacgcatggcttttttaaatgaggttttggaactaaatgactttataaaggatcctgttagaactttgtctctcggacagcgtatgagagcggatatcgcagcttctttattacataacccaaaggttcttttcttagatgaacccaccattggcttggacgtttcagtgaaagataatatccgacgtgcaatcacacaaattaatcaagaagaagagacaacgattttactaacgacacatgacctcagtgatattgaacaactttgtcatcgtatttttatgattgatagaggacaagaaatatttgatggcacagtttctcagctaaaagagacatttggaaagatgaaaactctttcttttgatttgcgcccaggacaagagcatatcagctctagtttaattggaaagtcggagattaatattaaacgtaatgacttagttttagatattcagtatgatagttctcgctaccaaactgctgacataattcagcagacattagcagatttttctgtacgtgaccttaaaatgacagatgcggatattgaagatatcattcgtcgcttctatagaaatgagctataaggatgaacagaatttggagacgttataaaccttttattagtacaggaatccaaggattaatcacatatcgtgttgatttcatcctttataggataggtgatgtgataggagcatttgttgcattttatctatggaaagcagttttcgattcctcaagtcaatccttaatccaaggttttcagctgtcagatatgattctctatattattatgagttttgtgactaatttattaacaagaactgatagttcatttatgataggtgacgaagtaaaagacggttcaattattatgcgactcttacgtccagttcactttgctgcttcctaccttttcatggagattggttctagatggctcatctttttaagtataggggtaccgtttttgcttgttattacgggggtacgcctcttcttggggactgatttgattcaagctatagtgttagtggtattttatattattagcattattttagcttttttgattaacttcttttttaatatttgttttggcttctcggcatttgtttttaaaaatttatgggggtcaaacctgttaaaaaattcgttagtcgcatttatgtcggggagcttgattcctcttactttttttccgaaaatcgttgctgatattttaggatttttaccattttcatctttaatttacacaccagtaatgattattattggtaaatatgatggcagtcaaattgtgcaagccttacttttacaaatattttggctaatagtaatggtagctttatctcaattaatatggaaaaaagtacagttgcatatcactatccaaggaggttgagatgacaaaatatcagcgaatgcactttatttttattaaacaatacatgaagcaaatcatggagtataaaatagacttttttgtaggcgttttaggagtatttttaacacaagggttaaatcttttatttctgaatgttctttttcaacatatcccttctttagaaggatggacttttcagcaaatagcttttatttatggtttttctctcctcccaaaaggaattgatcaccttttctttgataacttgtgggctcttggtcaaaggcttattcgaaaaggagaatttgataagtatttaaccaggccgatcagtcctttatttcatgtcctagttgaaacctttcaagtagatgcattgggggagttattggttggttttattctgttatctaccacagtatctagtataagctggaccgtgccaaaagtattattatttatatttattatcccctttgcaactttgatttatacctccttgaagattgctacgtcaagtatcgctttttggaccaaacaatctggtgctgttatctatattttttatatgtttaatgactttgctaagtatcctgtcgcaatatataataatctattgcgttggatcattagttttgtcattccatttgcttttacagcttattatcccgctgcttacttcttacaagatagaaatgtctattttaatattggtggggttatcttgatttccttgatttcttttatggtatcactaatactttggcataaaggagtagaagtatatgagagtgcgggttcttgattagtaaggcaagccattaatttttttgagtgtttagaagttttaggcttactaacttagctttgttagtgatgatatactccccttatagtgtctagtgaatttttgtttttttactgtccactataaggggagtatatcaggtgaagagggactattagtgttgagaataatgtccctcatagaacaataattaccatatctttaccaaaataaagttaaaaacgctcttagatgtgctttctaagagcgttttttggtctataaaaggtaagcaaaaagcagatgtcatttatgaaagtgttgacaaagatgaaatactttgttactattttaacataataatgatattttaattagagtgtgaatttataattaatttttataatgtttattttaaatttaaactaatgtttatagcagtgttttactcatgattttgtgaattcaacacttaagtcatgacctcattttaaagagtttcagacgacacagaaaggaagaaaacataagaaaggcaatgcacggcttgtccatagtagtgtttgaagtagatgtttagaaatattttattttccaacagtactgatatcagagcgaagatgattagttgaaggtgataatatgggacgttctaatattttgagtaggtgtgaacaatgttctgataatcaatgtggcttgtataaaacgcggcttaaagacaagttactattagtagtccaactggttggaaatattaggtattctgagtttcttacggaaggtggtgtatatcataagggagaaaccttgttggaagttataaccttaggaatttcttatgaatataaaagttatggggatatcaaagtaatcaagaagtactgtgctgatggcagtgtcgttgattataacatgccaatactattaatggaaaggattgaataatgaaaacagtaataatatatggaggacagggtaatgttcagtcaaaacacctttgtcaactagttaaaactccaaaaggtgaaattcttttttcaaagttacaagcaactgatttagaatcatatcagttaatgatggatgtcattaaccacaaggtaagtttagacaatgttcatgcgtctatgttagcaaattttttatataatgattggctaacaaacgatgaaaaaatagtatctgggataggattttcagctcatagcgccggtattttcaatgtgttatatgctagtggtagtactagttttgaaaacattattcactttattaaacgtcgtgcccaacttatagaaaattgtcatgtgtctgaagagctttggcttttgatggttgaaaacattgatatgtttagtaaggatgttttaaaagaacagtctgagaaagtaaaattagctattattactgatgatagagctggtgtaattgctatggatcaagtcaaccgttctttctttgatgacgtgatgactaacaaaggttatttttataaattaaagcagttaggcgtaaaagcaccatatcatactgattttttaaatgaatctaaagagcagtataaacaattgattgaaagcctagatatttcgcaaaatgatgactatgactatatttttcattgtgatcaattggtagatgaaattttatatcagtggaccaatctctttaactggcgtgcgattaaggaaactatcatagaaaaggatgcggagattattgatatttctcctaataggtttatttctagtcagttgcaaaaaatgaaaaagagggggaggaaacagttatgaaagtagcaatagttactggtggtaccagaggaattggaagggctattacaaaagagttatacaaagaaggttacaaagtcattgctatttataatagcaatgatgctaaggcaagagctttacaagaggagttaccaaaattagacgtttataaatgcaatatttcagatgcaaaagcagtacaaaaattggtgactaaaatttttagagaatatggcggtattgattgtttagttaataatgctggtattgttagagatggctttttcttgatgatgtctaaggaaaaatggatggatgtcattaacataaatattatggggctagttaacatgagtaaagccgtgttaaaaatcatgaaggctaagcgtatacagggaaaggttatcaatatttcttcaactagtggtatagcagggcagatagggcaagcgaactattcagcaacgaaaggcgctatcatttccattactaaaactctagcgaaagaatttgcatcagatggtattacgattaattgtgtaagtccaggattcattgaaacagatatgacaaatgaattgcaaaataaagaagagctaaaagagcatcttattcctctaaaaaggtttggacaacctgaagaggtggcttggctcgtaagctttttagcaagtgagaaggcaaactatattacaggaaaaaatattgtgattgatggaggaatgattaatgattaactgggctgaagaacgtaaaataataaaaacacgtcaagaagtagttgatgaaattaaaggtattttgattgactctttaatgttggatattgataaagatctgattatgaatgatcaaccattatttggtcgtggattagagctagactctattgatgccctagaactgtcaatagggatttcaacaacgtttggtgttgaactaaatgatgatgatatttcaatattatcatcagtaaatagactagcagattttgtgattgaaaatagtgaggatatagatgaccaagctaagtagtgaagaaattataaaaatgttacctcatcgctatccgtttctaatggtggatagagtgcagagttataaaaaaggtatcattgaatgtcgtaagaatattactatcaacgaaccttactttcaaggacattttccacaacgtcctatagttccgggtgttttgatgattgagatggcagctcaatctgcagctttactttatattttagatgcacttgatggtagcctcccctctcttgatgaattaacagcagagaaaatagcagaaaaagtaggttatttagccagtgtgaagaatttcaaattcaagaaaattgttactccaggagaccagctaaacattacatgtaaatctcaatcaaaattggggcatcttttagaaattcaagtcgttattagagatgagaataaaaaagaggttgcctcaggaaggatgttggtatcagaaaatggaaattaaactcaaaaatattggaaaaaaatatggttcttttgaagcattgagagacattaatctcatctttgaagagggaaaattttatggccttcttggacctaatggagctggtaaaacaactttatttaaccttttaattcaaaattttaagcaaacgtcaggcgatattaagtgggaggtggatggaaaacctctatctattaaagatttttatcgtcacattggtattgtcttccaaagtaatcgcttagatgataatttaacggttgaggaaaatctaatttctagaggtgctttgtacggtttatctaaatcacaagtacgtaatcgccttaaagatcttcaaacgtatctagatatcacagcaataaaaaaacaaaaatatggcagtttatcaggaggtcaaaaacgaaaagttgatattgcacgcgccttgctgccacaaccttctctattattattagatgaaccaacgactggtttagaccctcaatctcgtcgcgatttatgggatgctatcgcacaactaaatcaacaatcgcagatgacagttgtactaattactcattatcttgaagaaatgtctgcttgtgatgttttaaatgttcttattgaaggaaacatttattattcgggagatattaaaagctttattgagcaacattccacaacaaacttgaatgtggtattgaaaccagaaaagtcattagaccaactttcgatagctgattttgttaataaatgtcaagtcctttcagaaagggagatagtatttaaggatatttctgttgaggaaatgatgcaggttatctcagacaatcaagataaatctattattgagacatttaatgttgaatattcgaacttagaggcggcgtatctcaacttgcttagagaaaaagaaaggaaaaacaatgtttgaactaatttctagaaatcgtaaagtttacacgcgagatcggttagcgtttttcatgtcttttttatcagttattatcttaattttggtctatcagattttcttgggaaaaattcaattagatgctataaaagcagcattgaggagtaatacagtatccagtgatactattcacatggttaattattggctcattgcaggtttgacgactattatttcaatgactagtacattaggtgcctttggagttatggtgtccgacaaagaaaaaaaattaaatgaagattttaaggtcagtcctatatcaaatatcaaaattgaattgtcctatgctatatttgccgttttatttggtattgtcatgacgatgttctcttgcatctttgctatcggtatttttaacggctttaattccttgctagagtattcagctatggattatttaactattttagggatcgtttccttagggactgttttatctgcggcgatgattttacctattttagcctttattcatactagttcagcttttacgactcttagcacaattgtagggacttttattggttttatttcaggagtatatctctcaattggctcggtaggaaaagcattacaacaggttatgacatggtttccattgactcaaatcaattctcttttgaaacaggtcttaatgaagggttctattgcgaaggtatttgacaaagccaacgaagccactgtctctaactataaagaatcatatggtgttgttttgcgtaatgctgatggagaaaggctgagtaatcactttatgttgatttatatcattgccctcattcttattttattggcaattcattttattattaaaaaggttaaaaaatgaaagatgataataaattaaagatttctgaagcttccttagaagattattctgaagtggttcatttatttaataggaatcatgtttatcaatttccagacggtaggcctttaactgttgatgaccttgatttaacgttaaaagttaaagaagtgacacatttatttttactgaaaaatcatggtgttttgattggaacatcagctttctttaaatttattacctatggttgtttagattggaatagtagctttagtggttttcttttaattgattcgaaaagtcgtagtggacaggcaatcacttatctatataaaactatcttaaagaagataacaaaactgaagttttctaatatctataccgaaatcagtaactacaataaaccctccttagctttatcaaaattgaatggcttcaaagagtatgataagacatatgaagacatactgcattgtcgatcattgcgtagtcacctccctaagatattgaatacgtttcgtatttcgaattattatggtaaaacatacgacatatcaacttttcaaattatggaggaaattgaaaatcccttggaagaggagacagaaattaggaccaaagtctctgatgaagaaatattatttaaagcagaagatagtgcttcacttccttattatttaaaaatgagcttgtttcaaatggaaattgctaagttagataaccgttatgttttacaagttgactttttatcggaacaagtaaagagggttcgggttaaaactggaaaatatcacttggcaaacttaacgagggctcaccctagcctaactttaagtcgttttgccaattattattacattcaagcaactgtggaaaccctttatggtaatatcgatgttcaactggaacgtcgaaaaaagcattatagagatgcaactatttgtcttaagagaacttttcaaggttatgatttacttatctctccaaatggcagccttatttttgaaaagcagaaaagaaagatacttgaagatagttttttgatttttagccaacctttggacaagaaattagttgtaaaagaagaagaaaatcacattacaatcaaatgtttctatcaaggtgctttaattgagaaaatcatgacatttacaagtgacgaagaaatcacttgtgtttataaatgtaatcaaaaggctaaagagatgttcccaaaattattgaaacagactttcaagttacactgccaagagcagttgattagagatagtgaaggttatcttgtgaatgttccaggaagttacccgattgagcatgatgattttcttcgagcagataagtttgaagatagacaattccattattacctcccgaatgaagataaaatgatttcctattctcctcctggcaaagccagcaatcaaatgcaatttagacccttatgtcttattgatacagatagcctttcttttccactgacttatcattttaggatttcacaagcatcatcggaggaggcgttaatcaatctaaaaaaacagccaatatgggacagcaactaccaagcgtcagcaactgaccttttaaaacatatctctaacctaacattagaagaagagaaggattatggcatcaagagaatgatagctaacagaaagcattatcctagtcacaaactggttttagcctataatcagattgttttgcctaagaatgaaattccaagagacagtgaattatattctatttcttttgattatcgaattagaggaaagtttgtccaaatccgccaaggggaacatgtcaaatatgataataaatcctatgttttggaaaatagtcaacaattagtattgtatgtagctagcgatgataaatatatactaatttctgctaaaaatggaatattttattcttacaaagagaacaatcatttaaaaataaggtgcatgtttaaaaggaactcaccttatgctacaaatgtgagcattacagaatatagaaagtgtgaagaaaaatgaatactatttataatacattgagaacagataaaggttataaagtttatgaggggtatttatatgaaattactggtgaagaatgtgaagaagccttagaccttgtgattcctaagaatattgtatttgcagatacagatacttgtggctacacttttttactcaatgaagatggaacagtttatgatgatgtgactttctacaaatttgatgataaatattggttggctagtcataaagctttggattcttatttagacaacatcaattttgactataccgtaacagatatttctgacgagtataaaatgctgcaaattgaaggaagatattcgggagaaattgctcagtcattttatgaatatgatatttcaacacttaattttcgtactttgatagagatgacttataaaggtgagaaaggttatcttgctagatttggtttttctggagaatttggctatcaatttttcctaccatcttctatttttgctacttttgtttcggatgtctgtgaaggtatagcagagtatggggatgaacttgatagatatttaaggtttgaagtgggacaacccattactgatatttatcaacaagaagaatattctttatatgaaataggttattcttggaatctagatttcacaaaggaagaatttagaggtcgcgatagcttgttagagcacatcagatcagcaacagttaaaagtgttggattctcaacgaaggaaaaactcgcttcaggaacaccagtgctatttgatgaccaaattgttggaaagattttttggatagcagacgagaaagactcttcggaaaattacctaggtttgatgattgttaaccaaacatatgctcattcaggagttacttttgtaacagaagatggccaaattttgaaaacacaatcaagcccttattgtatcccagaaagttggaacaaagaatgagcgtatatgttagtggaataggaattatttcttctttgggaaagaattatagcgagcataaacagcatctcttcgacttaaaagaaggaatttctaaacatttatataaaaatcacgactctattttagaatcttatacaggaagcataactagtgacccagaggttcctgagcaatacaaagatgagacacgtaattttaaatttgcttttaccgcttttgaagaggctcttgcttcttcaggtgttaatttaaaagcttatcataatattgctgtgtgtttagggacctcacttgggggaaagagtgctggtcaaaatgccttgtatcaatttgaagaaggagagcgtcaagtagatgctagtttattagaaaaagcatctgtttaccatattgctgatgaattgatggcttatcatgatattgtgggagcttcgtatgttatttcaaccgcctgttctgcaagtaataatgccgtaatattaggaacacaattacttcaagatggcgattgtgatttagctatttgtggtggctgtgatgagttaagtgatatttctttagcaggcttcacatcactaggagctattaatacagaaatggcatgtcagccctattcttctggaaaaggaatcaatttgggtgagggcgctggttttgttgttcttgtcaaagatcagtccttagctaaatatggaaaaattatcggtggtcttattacttcagatggttatcatataacagcacctaagccaacaggtgaaggggcggcacagattgcaaagcagctagtgactcaagcaggtattgactacagtgagattgactatattaacggtcacggtacaggtactcaagctaatgataaaatggaaaaaaatatgtatggtaagtttttcccgacaacgacattgatcagcagtaccaaggggcaaacgggtcatactctaggggctgcaggtattatcgaattgattaattgtttagcggcaatagaggaacagactgtaccagcaactaaaaatgagattgggatagaaggttttccagaaaattttgtctatcatcaaaagagagaatacccaataagaaatgctttaaatttttcgtttgcttttggtggaaataatagtggtgtcttattgtcatctttagattcacctctagaaacattacctgctagagaaaatcttaaaatggctatcttatcatctgttgcttccatttctaagaatgaatcactttctataacctatgaaaaagttgctagtaatttcaacgactttgaagcattacgctttaaaggggctagaccacccaaaactgtcaacccagcacaatttaggaaaatggatgatttttccaaaatggttgccgtaacaacagctcaagcactaatagaaagcaatattaatctaaaaaaacaagatacttcaaaagtaggaattgtatttacaacactttctggaccagttgaggttgttgaaggtattgaaaagcaaatcacaacagaaggatatgcacatgtttctgcttcacgattcccgtttacagtaatgaatgcagcagctggtatgctttctatcatttttaaaataacaggtcctttatctgtcatttcgacaaatagtggagcgcttgatggtatacaatatgccaaggaaatgatgcgtaacgataatctagactatgtgattcttgtttctgctaatcagtggacagacatgagttttatgtggtggcaacaattaaactatgatagtcaaatgtttgtcggttctgattattgttcagcacaagtcctctctcgtcaagcattggataattctcctataatattaggtagtaaacaattaaaatatagccataaaacattcacagatgtgatgactatttttgatgctgcgcttcaaaatttattatcagacttaggactaaccataaaagatatcaaaggtttcgtttggaatgagcggaagaaggcagttagttcagattatgatttcttagcgaacttgtctgagtattataatatgccaaaccttgcttctggtcagtttggattttcatctaatggtgctggtgaagaactggactatactgttaatgaaagtatagaaaagggctattatttagtcctatcttattcgatcttcggtggtatctcttttgctattattgaaaaaaggtgataaaatgagtaaatttttatttgctcctttcatgatgaatttaggagagagccaaagattatcaaaactggctaattgtttatatgaacaaggacatgatattcatatccttggagacaattattatccatttttatttaataatgatgcttatcgctatcaccactgtgtagaagataaatctgtttataatagtaagcgatatgatgctttcttttctctttcaacagactttaattttttatcagaagaagaaattgaacgcatctgttctattgaaagagacttgttacgccaagaaaaatttgatgctgtattgacaggttaccgtctatctattgttacaagttgtcgtttagaaagcataccattaatttggattatttcaggggcaacgcatatcagtgaaattgttgaaaactcagaaggaatattgcctaatgggaagataagtaaagctagtaagcctcaaacaaaggattttatcaaaagagtaatcactacttattcaacaaatgttaaaacgtggaataactatattaaaaaatatggtggcaaaacttttaataatgctttagaattatttactggtgatctaaacttggtaacagattactctttgttttatgaatttgataaagattcgtcctataaaacgataggacctattttgatagataatgtaggtttttcaaaatgcagccaaattaatcaagacaataagactgtactgctcagctttggtacttcatttaaacgagattgggtggaatcttttttaaagacattaccaaggcattatcattatttactgacaagctgtggtgaggctataaacattccaggaagttatattgagatagttgattttattgattttaaaaccatagataaagagatttatttcgctattatacacggtgggcaaggaacagtttatgcgatggctgcacaaggtattccctttataggtatccctttctttaacgaacaattttggaatattaagaagttcagtaaagaaaagtgcgcttatttggtaaagaaacctgatgtaagagagatacgtaaagcaattagctgtcttgaaagagactatgatatctataaaagttatatgataagactaagccaaggaattaaagaagaagcagaggcatctttacaaaaagcggaggcagaaattgaatcctttatcagaaaaagacaaagttaactatattatgatttataaaaataggcagtctacattggagaataatttatctggcgatcggttgatgagatatcaacaagcaaatagacaggtaagcaaagataaactgttaacagggagttattttgtgtaccaatgcttaaaaaagttaggttttaccaataagatttgtcaggaatctttttctagtgttagtagttatttaattggtttgccaaaggggaaaattagttactctaattctggtgactatcatattctaacctatgctcccagtggttcaactggggttgatattgagaaatacaaagatagatcagaacaaacctaccaaaactacctaggagaatcagttagtagtgatatggattctaaattattattttataaggcatggttacaaaaagaaatttcctataaatgtgggaaatctatagatattacctatcaaacaatgatagatggctatatttatggttatgcttttgataatacttttaaagtagaagcggtttacttaaaagaattattaccagataactaactcgcaacatgttgttcctacatatgcatctataaaaagcactttgaagtatttcaagggctttttataataccttgggtagtctttaacaattatggttagagttgatatgataaactgatcatttccacattttatgagaaaatcagaaaatagaggtgtttttttgtgataataattagaaataataaaaactgaaatattttctaatgtaaaaaaagataaaagaacttattgctgaaaacgattttaacttaacatttgccattgacaagtacttagaggagtgctaaaatttcgttagctggttaacaaaccggttaagtaatgtgaggttcttttatgagtgaattcctttcagccaaacctattggtcataatgattcatctaatactattttaagaattatagagaatacgaaatatattcatcactatgatggaaaagttgttgtcgaaattcctcctcaaaaagagcctatcaaagtcttttttatggattcacgtcttcattatttagaattttcagacatatgtcggtatgtaactgttgttttgaaaaatagtaccgttgataatataaccaatttagggccagataatcatattgtttatgacaatggtgatgatatggttgatccgttgccgagtattcagcatggattatttcttaatgatgattaaagatgtagacaaaaatttagaaacgaggaagccatgacattttataaaaagacggacaaatttggatttaggaaaagtaaagtgtgccgcagcctatgcggtgctttattgggtacagtagcagttgttagtctagctacagcaagtacagagattcacgctgatgaagcaacaacctcacctaccactgtaacgaaagtacctcagccagttcaagcagacacaacagctctaaatacctctaagactcacagtacacaagcaactacaactcctgttgaagctaaggagaataaggttgtcaaaagtgaaactgttcaatctgagagccgagtaatgcctagagataaggtagtagaaaggccagaaacagtaaaagctagtgttaactcagacgttagccaacctattacaaccacacccccaacaattaatgaaaaaacagttgagattcctaacttagctcaagatactaagaaggtagctccaaaagtaactgttacaccagaagttgttaatcagccaaagcagttgcctaaatacgagtaagaaaactcagagaaaggcaataagagtacagaagcaactaaggcagttactgtgactaaaccacagggggcggttgctgagaaagctactccggctgtgccaaagcctcaaaaagtaagagtaattgttgaatttaataaggaatctatcttagattatgcgacagaacagaaaaaaacagttgcacagttaaatcaagctgatgttgagaaaaaattacaaagcatcaagcaagagcaagataaagttcttaagaatattgaaaaaagtgttcactttgattcaagcaaagtgaagcgttacgatgctattattaatggtgtcgcacttgatattcaagctcaagaaattgaaaaattaaaaacgattgctgatgttagaagggtctatgtctcacaagaatatgttcagacaaaacctttactatcttcctcagggcaacttattggtttgccagaagtttggaacaactcccagtataaaggtgagggaactgttgttgcagttattgattcaggggttgatttcaaacaccaagcactaaaaatcaaagaaccaaatcgtgctaagtataataaaactagtattgaaaaactgattcatgaaaagaatctcaaaggaaaattctattccgaaaaagtaccttatggttataactattatgactataatgataacctcaaggatagctacggtgtaatgcatggtatgcatgtaacaggtatcgtaggagctaatgatgataatcaaaaattgtatggtgttgcaccaaatgctcaaattttagcgatgaaggtattttcagatgaccaacaaaatcccacaaccttcacagatgtgtggctaaaagctctagacgatgctattttactaaaagctgatgttgttaatatgagtcttggaacacctgctggatttgtacatgaggggaaagactatcctgaacttgaagttattgcaagagcgtgtaaggcaggaatcgtcattgcagtagcagcaggtaatgaaggaaatatcactgacggtaatacttatggtgttaagccgctagcagaaaattatgatacagccttgattgccaacccagccctcgatgataataccttggctgttgcctctatggagaaccttaaaaagcatgctcatgttttgaaatttaaagataaaaaatctggaacagaagttacagaagtcattaatcttcatgttgccccaaacgcttcaaaaactattattggattggctgtagatttgggagcaggagctccttcggaattgtcaaaacattttgatttaagtggtaaaatcgccatgcttgaaattccagaagataataaatctaatggatttttagaaaaagtacaggcgattactaagttaaatccagctgctatcttgctttacaataatgcgaaggttaaagatgatttaggcagtcaattattagttgaatcagaagcagctaaatttaatattgctcgcattaccagaagcacgtataacaatatcaaaaataatagcaataaaattattactattttaacagagcgtcaagctattgataatagtttagcaggacaattatcttcttattcttcttggggacctacaccagacttacgtctaaaacctgagattacagctccaggtggtcatattttctcaactgtggaggataatcaatatgctgataaatcaggaacatcaatggctgcacctcaggtagctggggcagctgcagttttaaaacaatacattacagataaaaaaattcctgttgataatgctgctgattttattaaattactcttgatgaacactgcacagccaattatcaataaacaatcaaaagatggcaaaacaccttactttgtgcgccaacaaggtagcggagcaatgaatcttgccaaagctcttgttacgacagtcgttgcaactgtaacagggactaacgataataatgcagatggtaagttggagttacgtgaattaaaagagaaaaaatttaaagcacgcattctacttcgtaactttggaaaaactaataaaacgtatatcatctcatcagaagcgattgcggacccagttgatgaaaaaggatttcgtacgcaaaattcagaacacctagtatcaaaaaaagctgatgcagttacaaggaaagttactgtagaagcaggtaagacattagctgttgaccttgatgtggattattctgatgcagaggctttaactcgcaataatttcttggaaggttatcttaacttaaaagatactgaaggtgtagccgatttacacttaccatttttaggtttttacggttcatggacagagcaaaaagctattgatgcttttgaaggcatttctgaaattggtaacggtgacaaaaaacgtcgcgttcaattctatgttaataaagaaaccaacaagacctcatcaacctttacaactaacggcatgttgagtcttccaatctataacaatacagtatttttctctcctaatagtcctttctatgacaaagcaggagttcgtattgcagctttgcgtaatatggagtatgttcaatattctattatagatccagataccaataaagaagttcgtgtacttggtagatcacacgacgttagaaaactttatcgcctagattatcgtaatagttttgccatgatgccagattctatttgggatggtaagattaaagattaaattgcaaaaggggataaacaatacatttatcaaattaaagtacagttgaataataaaggtgtcggtggcgatggtgtccaaatttatcaatactatatcaaaatggacaacaataaaccttacttaagtcccaaagataagactactgtagagaagttagaagatcgctggaaaaaaattactttcaaagttcaggatactggcattggtttgaaagacgtttatcttcaatctgttaagtatgttggtggtggcaataataatttagaccttatcacacctccaggatttaaaaaagaagataaaaaagttgaaaaaccaaaattagaccgtccaccaggaattgatttaccagcaccaacttcaatgagaagttttgattattcaaccccaccgggaactaagccaagcaaacccaaagatagtttatcaactcctccaggtttcccagatttaaacacgccgccggatgaagcaccaaaggatagtaaaaaagacgctattgaagataaatcaggagcaattaaatatgctaagtctcttcaacttagctttgttgatggccctattttagctagcaaagtaaatggcaaaatattacaagtcgaatctgatggcaaattagtcattcctagaaatgctttgtcagctaatcaatttgatgacactagtcttaaaatttatcgtaataataatcgcaataaagaaattactatcacaacagattattttgcagatacaaaatatgtcaatatcacagcggttgactatttgagcaatactacttttgagcaattagctactggtgaaacagtagattaccatgccattgtattttcaagctttgctgctattaaagacaagggtggtaagatttatgttaacgataaattgcaagaaacttctcgtatagcgcttaaagataaatctgttaagattggtattgaattaccaaatgatgtcagacatattgatagtttatctgttcgtcgtttgaatgaggttaaaactgttgataatatcttgaaaaatgatgaacaagacattaatctcagcaaaacttaccaattaaaatacaacccgacaaatcgtcgtctagagtttactattaataacattaactcaagttcagaaatcatgaccactttcaaagatggaaagatgccagaattggttgaacaaaaagatgtttctttggatataaacgatatggacatgagtaagtttaaaactattcgacttggacgaaaggattctgaatttaagggacaacttattgcaaaaactggaacagttgaattagatatgtttttcaaacaatctcaagacccagcttcaattattaaaaaaatataccttatccaaaatggtgttccaaatgaattgaaaaaatttgactctagttttggtttaactgaaagtcagatagatggatactatatttataaagatgcaattaaccttaaatttaaattaaccagtggtgcaagtcttaaagttgtttataaagggcaagaagatccatatagtcatcagaaagaagatatgactaaaaaaggtgaacagctcagtcattcaactcaagccaatgaaaatacagcaaaagtaacctttgctaatattgactggtcacattatagtaaggttactgtgaatggaaaagaagttgttaaaggtagtgagttacctttaactaaaggatggacaacatttgtattacataaaacagaaaattcattaaatgttaaaagtttgattatggagacgggtagtgtaagtaagaaagttcaacaacttcctttaagtcctagattatctaaaaataagcatatgagggatatgctacttactatgcaaaaagattcagcgtattacgaaacaagtgacagtctagtccttcgaattaatctcactgcagatactaaacttaattttaatgctgttaaaggagcgagtgctcttactgaaaatatgatgatgagacagtttgcagttgctggaccacaagatgatcctgttagtgaacataaatacccatcagtatttctcttaactcctgccttattggaaactgctagtgaggcaactctaaatggtaaggaaatcacagcatctggtattatcggtcacatcaaggatggtgataaaagcaagcatgttgaagtcaaaatggtgaatgaaaatggagacatgctaggaacccctgttattattcaaggtaaagacttgactaatcgaacaaaaccattaatgagtggacgtagagtactttatgccggtaaacaatatgagttccgggctaaattaccacttagtcgttttaacacttggattagggttgaagtggtaacagaagcaggagagaaagcaagtattgttcgtcgcatgttctttgaccaatcagttccagagcttaacacagcagttgctaaacgtgatttgacttctgatactgctcttatccacatcgttgccaaagatgactctctaaaactaaaattatatcaagatgattcattacttgaatctgttgataaaaccggtctttatagttttagaaatggtgtagaaatcactaaagatatgacagtaccactagaatttggagataatattattaagttatctgctgttgacttatcaaattatcgtcgtaatgagacccttcatatctatagaaaccgttttgatgttaaagcaagccaaatgacagctgacaaaggagctaaagtaactgtggatatgttgatgaagcacttagttgttccagaaatggcaggagcttatacattaacaatcgacgaagctccaaacacaaatgaatcaggaatgttaacaaacgctaaagtatcgattcattatgtaaatggtggtgttgataaagttgatgttccgattaaagtagttgacttagaagctattcgtaaagctgaagaagcacgtaaagctgaagaagcacgtaaagctgaagaagcacgtaaagctgaagagggacataaaacccaagaagcacctatagttgaagaaggctacaaggttaataacgttcatcaaactgatactacagttaaagcgtctgatttaccaaagactaagacagtttccgcagttcatatggctagaacagacaataaacagataacttcacatcagacacatgttgaaaaacaaattaaaaatacattgccatccactggtgacagcaaacgtggttattatatcactggaatggctatcgttatgctgagtgtattatttagtttagctaaaaagtttaaaagcaaatattaatgataaaataaaatctatttagcaacattaattgtgatggataaaaggttttatctcttaaatcaaaagtagtagctcattagctactacttttttgtataagtgtaaaaaagtgaattcttaacaagaatttaacaccctacttgctatactaaaagtgaataagaaagagaggtgtcatttatgcaaagaaaatcctatttaaaatccatgagtgttcttactttaacagcttgtcttatatcaggatatgtggttaaagatattgctatgttacatgcagtatctgccagtgagaagaaagcaaataatgtcagtccgagagaaaatctctacagggctgtcaatgataattggctagccaatacaaaactcaaacaagggcagactagtgttaatagtttttcagaaattgaggataaattaaagcaactgttagtgtctgatatggctaaaatggcctcaggaaagattgaaacaaccaatgatgaacagaaaaaaatggttgcatactataaacaaggtatggactttaaaacaagagataaaaatggtctcaaacctctaaaaccagttttacaaaaacttgaagcagtctcttcaatgaaagactttcaaagtttggcccatgattttgtgatgagtggttttgttttaccatttggtttgactgtggaaaccaatgctcgagataatagccaaaagcaattggtgcttcgtcaagcacccgcattacttgaatcacctgaccaatataagaagggcaataaagaaggtgaggctaaattatcagcttaccgtacttcagcaatggctttgcttaaacaagctggaaaaagtaacattgaagatagaaaactagttaaacaagctatagcatttgatagactcttatcagaaaaaacgcaagttgatcaaagtaaaatcacagctgaaagtgagacagctgcggggcgatataaccctgaaagtatggaaacggttcacaattacgccaaggaatttgactttaaagaattgattgaaaaactagttgggccaacgaataaggcagtcaatgtagaagataaaacttattttaaacaggttaatgatgttataaatagtaaacaattagccaatatgaaagcatggatgatgatttctatgctagttgatcaatcagattttctaggagaacaaaatcgtcaagcagcgagtgcttttaagaatgttgcgtctggtttgactcagattgaatcgaaagaaaaaatgcttacacccaattagaatatacttttggccatattttgggtgattattatggtaagaaatattttggtgaggcagctaaaaaagacgtcgaacatatggctaagaaaatcattaatgtctataaaacacggttaaaaaacaacacttggttatcagaaaatacaaaagcaatggccattaagaaacttgataacatgagattaatgattggctatccagaagattatcctgatctttatcgtcagtaccaatttgatagtaaagcaagcttctttgaaaacaatgataactacagaaaattatcgaacaagaaaacatttgaagaatttaaccagtctaatcaacgtgaacattggcaaatgagtgccaatgctgtaaatgcttataatgatcctaataccaattccatagtctttccagcagcgatttttcaatcaccactctacgataaaactaaaacagttagtcaaaattatggagctatcggagcaattattggtcatgaaatttcacactcatttgatattaatggtatgaaatatgacgagaaagggaatcttcacgattggtggactaaagaagatttaaaacattataagaaaaaaacacaagctatgattgaccaatgggatggccttaaagcagatggcggtaaagttgatggtaaattaactttagcagaaaatattgcagataatggtggtgttatggcatctctagaagctcttaagactgaaaaaatccaaactataaagaattttttgaatcatgggcaagtatttggcgtcaaaaagcaaccaaagaacaaagtaagtcctcaattcagtcagatgttcatgcaccatatgaattgagagctaacatcccagtacgtaatttccaagaattttatgatgcctttggtgttaaaaaaggcgattcaatgtatctaaaaccagaaaaacgtttgacactttggtaaagctatgttttccagacaataaggagaatgcatgaagaatataacaaagctatcaactgttgctttaagcctactactttgtacggcgtgtgctgcatcaaacacgtctacatctaaaacacagtctcatcatcctaaacaaactaaactcacagataagcaaaaagaagaacccaaaaacaaagaagctgctgatcaagagatgcatccccaaggcgctgttgatttgacaaaatataaggcaaaaccggtcaaagattatggtaaaaaaatcgatgttggtgatggcaagaaaatgaacatttatgaaactggtcagggaaaaattccaattgtttttattcctggtcaagctgagatttcgccacgctatgcttataagaatttaattgagcggttaagtaaaaaatataaaatttatacagtagaaccattaggctatggtctcagtgatattcctactaaaccacgtacgctagaaaacattacaaaagaaattcacacaggcctaaataaaattggagttaaaaatttctaccttgcagctcactcacttggcggtatgtattctttaaattatgctaaaaattatccagaagaagtcagaggatttattggtatggataccagtacaccttggatggaaggggaacaaaaaacaaagtatgaccctgaaagtgctaaatgggcaatgaaattaccagatgttgatgataagactaacgaacagtatctgtcaattgcgaaaaaaattaacggcaataagtctcaacgagatgaagatgagcgcttaggtgataatcttggtaaattgaagaatgtaaaattccctaaagggatgccaactaagtattttcttgctgatcaatctgtggagggaatcaagctacgtcaagcagattttaaaggtttgaaaaattgggatcagcagcatattgatttatctgaagatccaaaagatgcttccgttgaaatttttaaaggtagtcacaatattttccaaacacaatatgaacatatggctaaagctattgatggatttatccaatcccatcaaaagtaatcgttgaatgaaatacctaagtcaaggagaaaaaatgaataaaataacgaaattatcaaccgttgccctcgctttgatgctttgcgttggatgttctgccaataaagataatcaaaaaactaaaactgagcagcctaagcaagaaaagtcaatcgctaagcaaaaacaagagagagaagcagaaaaagctatgattgctaaaggtgctattgacctaactaaatataaagcgaaaccaattgaagattacggacaaaaaattgatgtcggtgacggtaaaaaaatgaacatatatacaatgggtcaagggaaaattccgctagtagtcttccctggtcaagctgaaatttcaccacgttatgcttacaaaaacttgcttgatagattagggaaaaaatataaaatttatacggttgaaccgctcggttatgggcttagtgatatgacagataagccacgtacgattgaaaatattaccaaagagattcatacagctcttgaaaaagtcggtgtcaaaaatttctatcttatggctcactcgttaggtggcatatacggtctaaattatgctaagacatattctaacgatgtcaaaggtttcattggcatggatacaagcacaccaaatatggaaggtgatggcacaactggagaatcttcagcttcaaccttaaaatgggcagaatccattccagaagttgataagaaaaccaatgaacaatacttatcaatcggtgctaaaaaatcaggtaataaaacagagcgcgataaagataggcgtgttagtgacaatcttcataaaatggaaaaagttaagttccctaaaggtatgccagctaagtatttcttagctaatgagtcagcagaagatataaaaatgcgtaaaaaaatattccctaagcttaaaagctgggaacaacaacatattgacttatctgaagatccaaaagacgtttctgttgagacactagatgctagccacttgatttatcatacgcaatataaacatatggcgaaggctattgacgagtggattcaatcgcatgaaaaataattattccccccaattattttactaaggagaaaagatgaataaaataacgacattatcaaccatcgccctgactttaatgctttgcgttggatgttctgccaataaagataatcaaaaaactaaaactgaggatcctaagcaagaaaacgtaactgcaaatccgaaggaagacaaggcaacagcagccaagcgaatgaagttaacgaaagaacttgaaaaatataataaaggcacagagagctttattagtaacaaacaatatcaaaaatatatcaaaacacctatcaaagaatatggtcaaaaggttgaagtcaaaggcaagaagatgaatgtctatactgttggagaaggtaaagtaccaattgtctttattcctggtcaagggacggtgactgccaaacatcagtaccataatttgattagtaatttaagtaaaactcataaggttgtggtagttgagccatttggttcaggtttaagtgatgtcattgaccaaccacgaaatctagctaatattacctcagatatccacgaagctttacaaaaagttggtattaccggaaaatatgtaattgcctctcattcaattggtggtgtttatgcccttaaatacatcagtacttatccaaaggaagtgctaggattaataggtttagatacatcaacgccgggtatggaaggtggtaagcaagttgatttcgctgctccagtgttaaaagaattacctaaaattcctaaagtatccgacgatattaatgcacaattttttgctattggacataagatacttaataattctaatatgaaagaagaagcgaagaattcttctaatatgattaacgaaagtgccaactataagattccaaagggaattcctgctatgtatttattagcacgtgaaagtgacttagggcttcaattacgtagtttagatataccaattaaaggcagttggcaagagcaacataaggagttatcagaagatccaaaagaagtctctattcatacactagacggaactcaccaaatttatgatactaaccttaaagaagtaattgattatactaaccaatttatgaaaacatttgagaaataattgtttttagaaacagtgctataaaatcactaattgatagataacgtagaagtcgatagagaatatctaacgacttctatcgttattctagagattattaagatagaaaaaggagggaaaatagtgaacctatggacattaagtttagcttatttgaaacgtcaaaaaatgaaaacagtaaccttgttcttagtttttctaactataggcacatgtttaatcagtctgatgagtattcagcattctttggaaaaaaatatcctaacaaaacaagggaaaagcatttatttaacctccaaagaaaaggcttattggcctgaacaagcatacgaagctttgaaaaaagcaaaaatggttgagtcagtagaggcaagtttaagcattgatgttggtagccgtttaaaatctgtatcaccatataactcttctaaagaagagaatcaagttacattagcaggttatcaaagtacagaagatttacgagcttttcagacaaaagcattggtcttaaagaaaggaagccatttagcggccgataatacaaaacaagtactagttccattgaagttagcacaaaagaatcatttaagtgtgggtaacaaattgagattaggcaaagaaaatgttactattgcaggaatttatgatgcgaatagtgctaagtctaaaaatacttttaatcccaatattgataatacattgattgctcaggcaacattggttaggaagattagtaaacaaaaaggttatcagacggttgcagtgcgcttaagtgataaacgtttagtggatacagttatccaaaacatcaaacaatggccgcttgatttcgggaaattagatgttcaaacagctaaagagttttatggagattcttatcgtaatatcgagacattgcatcgtctagtgggacgaatcattcttattgttagtctcgtggcgatggcaatattagttgtcatgctaacattttggattaataaccgcattaaagagacgggaattttactcgctatcggaaaaactaagtttgaaatcataggtcattatctgatagaagtactgttagtagcaggtgctgccttcacactatctattattggtggtgtctttcttggaaaaacatttgcagctggccttttatcacaagttaatggtggtgtgagttcacaaattgtacaaaatagtagtctaattattgatagaattgataacctcgctgtttctgttggagtaatggatgtctttagactctatgctcagggtgctttaatttgcttatttgcagttgtattatctagttattctattcttaaactacaaccaaagcaaatattgtcacgaatgtcataggaggttaatatgaatttatttaaacgttcctttttatatgttagccgtaaaaagcgtaagagtatcactttattcgtatgtttatggctagttgcttctacattaattagcggtattgcggtaaaaaatgctggtcttactgctaagaagacattttcaaggcaaactggatcaattttgcatatttcatcggatagtactgaccttgttggtgatggttacggatctggagaaatccctgaaaaagcaatagttaacatagcaagtaatccaaatgttaagcgcgttaataataatttgatggcttatgctggactaacctcggaaaaaatggttacacgaccaaatgataaagaacaatataaagaacaagttttacaagttcatggtaatagttactccgatacagatcctaaatacacagcggggatgatttctcttaagggagggtgacatatcacgccgaaagatcagcgagttataattgttcatcaggcttttgcgaagacaaatcatcttaaagttggcgataagttaatgttttcaaaagaccccgttagaaacagtaaggataaaacattagttgaagcaactattgttggcatatataaaggtaaaacggtacaaaaatcaaattacccttatgagatgctagaaaatacagccttttcagatacgcaattgattaaggatttatacggctattctaaaggtaaggccttttatcgccaaacaactgtatatcctaaaaagaatgctgatatagaaactcttaaaagttttatcaaaaaacaatcctattgattggaataaataccaactgacaattacagcaaccttgctaacaagttatgcaaaaagtatagatgtcttgaatcaattaattacttctctacaaggcggcatgttagtagtatctattatcctagtgatgatggctctgctattctggattggtggtagaacccatgagacaggtattttattagctattggtaagtctaaagcaattatcattgtcagtacgcagtagaagtactaatgattgctattccagcctttgctttatcagtacttatcagtcaatttattggtcaaaaattagcagactccttagtgtatcaggcctctagaactgtcagagcagactttatgaaagggtttgggaatatgcagcttggggctgatagtgatacagatatgtttatgcaaacgattaagacgttaaatgtacaagtgaagcctgaggaagtctggttagtaattctagttggtttagcaatcgtcttatttgctattattactactagtttaattattgctcgctacaaaccaaggggaatcttatcaaaactgtcctaaagtgccataagtataccgaccaatagtgacatctatattaacggttaaaatgaatatgctctgctattgaatacatagctcaagaaagagaaatctatgctcgaattaaaaaatattgcttatcgttataaggggaacgacaataaaacattagaaaatatcaattatagttttcagtcaggggtattttatactatattagggaattctggttcagggaaaacaacccttctatccttgatggcaggtcttgattcgcctactgagggacaagtattatttaacaaaaaagatattaaagaagcaggttatgctcagcatcgcaaaaagaatatagctttggtctttcaaaattataaccttttagactatctaaccccattggaaaatgttcagttggtaaaacctactgcagataaacaattattgttggatttaggtttaaaagaagatatgttaacgcgaaatatcttgagattatcaggagggcaacaacaacgtgtagctattgcgagagctttggttgtaggaacaccagctattttacttgatgaacctacggggaatttagattttgacatttcgcgtgatattacgatgcgtcttaaagattttgcgcataaggaaaaacgatgtgttattatggtgacacatagtagagagatcgctcatatggctgatactgctttacaattgataggagataacttaaaagaattatcaaaagaaagtatagcacagtctatattacaacaaaggaatttataataaaaaaatacctccctttcttaaataataaaagaggaggtattttttagaaatggttatttattatcagaaaaggctcgctctgccatttgttgaattttaattgtagagttattctgataaacgacaccattaaccagtgcaccatgcgcatataaacctggcattggaccatattttggagacaaaacttgtgcattttcagttaaaatagtaatccctccttgatcgtcaatttgacaaaattcttgattgatgagcgattttagaagtggattggcttttgtccagtttttagtgtttaactggtaaccagtagcgttaatgacgcgatcgacagatatatgattttgtttttctttttctattgaaaatccttcgtcattttttgtaattgtcttgacgttattgatcagagaaaaagtccctttttgtgcagctttcaaaattactttagcagattcatcaggcataggatttcgcaagttaataatcgcttttccatagagtgctttatactctttcttatctgataatgacatgagtggccaaaggtcagttaaccagacagtgattcgtgaagctaattgttgtaatagatagagttgcttagggtatttaaaggctaacttgagaccatcaattcctggggataaaaaagtttctgttgtatttttccagtttttaaagccaagatgctccaattcgccagacatcaaatcattaaaatcggcaatagtgaaggtttttgaaggatgtgatagaaatgctttaaggttatcattggtaaaaaagtgccaagtaagtggtaaatcattaacaatacggacgctagggaagtagttggttcttgaaaatgctttaacagaagattgtgtattgagtagcaaccattttataacatcaattgcagctagaccagtcccgatgatagcaactgtttttcccttccaattttcctgagccaagtatttgataggataagggtctttgatataatcggtcttcccttccaaatgataaggttctataacaggcagagcaccacaagctaagtgtaattcatcaaatgtgacaggaaaaagcttatcttgaatatagacttgccattgttgctcatctgataaatagtttagtttatccactcttgttttaataaccgtgacagggagtttatctaaaagtaacttagttctttctgaaaggtattgtccgtaaagtgtccttgatacataggttagatttgtgtcatagtaattttcttctaaccaatccatgaagtcagacatatggcgataatcaaatgaaatatcgttgattggggaattgattaaagctgagtcaacgtcttcttgaaaaggaattcctcgtccaaagtggacagtatcatcaaaacaaaaaatagctaactgttttaactctttctcttttttacgagaaagtgctagtagaacagctaaaccactaactcccatacctataataccaattgtttttttcacagaacaagcctccttaccactatcatagcataaattttgatttaagttaggggatgaacaaagctattatttgcagattttctaatttaatgagtaaattaaatttaaagtaatattaaattaatataagattaaataaatgattgacatgcttaaataataggcatatgatatggttgtgacaaaaggagagcaattagctaaaacggatatcaatatggtagacgcttgtttaatgtaattagaaagaggtaaagcttatgaaaagattacataaactgtttataaccgtaattgctacattaggtatgttgggggtaatgacctttggtcttccaacgcagccgcaaaacgtaacgccgatagtacatgctgatgtcaattcatctgttgatacgagccaggaatttcaaaataatttaaaaaatgctattggtaacctaccatttcaatatgttaatggtatttatgaattaaataataatcagacaaatttaaatgctgatgtcaatgttaaagcgtatgttcaaaatacaattgacaatcaacaaagactatcaactgctaatgcaatgcttgatagaaccattcgtcaatatcaaaatcgcagagataccactcttcccgatgcaaattggaaaccattaggttggcatcaagtagctactaatgaccattatggacatgcagtcgacaaggggcatttaattgcctatgctttagctggaaatttcaaaggttgggatgcttccgtgtcaaatcctcaaaatgttgtcacacaaacagctcattccaaccaatcaaatcaaaaaatcaatcgtggacaaaattattatgaaagcttagttcgtaaggcggttgaccaaaacaaacgtgttcgttaccgtgtaactccattgtaccgtaatgatactgatttagttccatttgcaatgcacctagaagctaaatcacaagatggcacattagaatttaatgttgctattccaaacacacaagcatcatacactatggattatgcaacaggagaaataacactaaattaataaaagagcaactaattgctctttttttgttgtcattcttagtgattaatagtgttaaatagaaatttttggatacattacttagtgttccgatatgatttgacaccagaaataaggacaggaattaaggtaacaaatacaattcccaagataataagcgagaagtgctgcttcacaaaaggaatattaccaaagagaaaaccagaacctgttgcaataactgaccaagataatgctgcaatgaaggcgcgtttgataaatacttttggagggagctgactaatacctgctacaaaaggaacaaaggttctgataatagggatatagcgccctaaaatgatggcagcagtaccttttttctcaaaataaagctcagcatctcggatatttttttctttaatgaaacgacgaaagaaaggatgtttgataaaacggtaaccaaatgtacgaccaatcaagaagttgcaactatcaccaataaatgctgcaataaagaaaataataagaaaagttacaatattgaaggacatttttggatttgcagcaagggctccagcagcaaataataaactatcacctggtaaaaatggaaagatgacagccccagtttcaacgaaaataacgaggaagagcaatagataggtccaattaccaacagtgttagccatagcatagatatgagtatcaatatgtaaaataaaatcgattaaaaacataggagtctcctttattgatcaactaaagtgcagagacttggatgataactatcttgtttataaggcctcttacaaagcctattttatcagaaaatttttaataagaggtaaaataagtttacttattaatttagaattattctaaagagcttttttttgatttttatgttagacttaattataatgattataaataagaaataaaggagcttaacaatgtcctatttaacctttaaacacgttgattttaaaacggatgataagttggttttaaatgatatcaactttgcaattgatgaaggtgattttgtttctattgtagggccatctggaagtggtaagagtactgtattaaaattagccagtggtttaatgagtcctactgcaggtcatattttctttgatggaaaagatttgaaccaattagaaccgattgaaagtcgaaaaatgatttcttactgttttcaaacgccacatttatttggtaatacagtggaagacaatattagttttccttaccacattcgacacgaaaaagtagattatagacgcgttgatgatttatttcaacgttttgaaatggaccagtcttacctgaaacaggatgtcaaaaaactatcaggaggagaaaagcaacgtattgctctgattaggcaattattgtttgaacctaaagttttactcttagatgaagttacttcggctttagacaatcataataaagctattgttgaaaaggttattaaatcattacatgacaaaggaataacgattttgtggattacgcatgatgaggaacagagtcgtcgatttgccaataaagtcttaaaagttgtcaatggtagtattgaagcaatggaggttataaaatgagcggtgaaaattctatttctttaatgtcattactaatggcatcgtcattagttttgattactttatttttttcttactggcaaaagttaaacctagaaaaagaagtgattattagcgctatccgagcagtgattcaattattagcagtgggttttttgctagactatatatttggttatcaaaatcctattttcacagctcttttaatgctattcatgattattaatgcttcttataacgcagctaagcgtggtaaagggattaataaagggtttgttatttcatttatagctattgggtcagggactataatcactttatctgtcttgattttttcaggaattttaaaatttgttccgaatcaaatgattcctgtaggtggtatgattattagtaattctatggtagcaatcggtttgtgctataaacaattattgtccgaatttagaagtaaacaagaggaagtggagacaaaattagctttaggagcagatattttgccagcttcgattgatattattcgtgatgttatcaaaactggtatggtacctacaattgattcagctaaaacacttgggattgtatctttgccagggatgatgacagggttaattcttgctggaacttcacctatccaagcggttaaataccaaatgatggtgacgtttatgctattagcaacgacttcgatagcttcttttgtagctacttatttggcttataaaattttctttaataatcgtaagcaattagtagtaacaaaagattgattcattttaataaacagtatgttagtctggtaagtatagtccaggcttttttggtatcttaatcttatttttgatcgaaaattgaccaagttattgagtcgattacgtttaaatgctactatttaatagaaattgttgtagggattatcaaaaggaggaagaaatgattttaaaaatttgtcgtgcagcatatagtttacaatggggaggtgtttaccaattagctttgctggattatcctcgaattaaggcgtttgaattggaaaggataggagctttcatagcttacgagaaacaatataaaagaaaaactgagatacaatgtgacgataaacatctcctcgcaaaaattgttcattttttaaaatacaatagttttacttttccctatattcccaaatatagagaagcggcagctacttttaatgaggatggtattagtttaacttctgattttttaagccatacatgtacgattgaaactgcaaaactaatttttaaagaaggtaaaatcttatcagcagttaaagcctttaataagcctgctgaagtactggtaaaagataagaggaatgctgctggagaccctaaagattactttgactatgtgatgttgaactggtcaaataccaattctggttatcgtttagtaatggaaagattgttaggcaaagcaccatctgaacaggagttaacagtaggttttaagccaggggtcagttttcattttacttatcaagatatcatcaatcatcctgattctatttttgatggttatcatcctgctaaaattaaaaatcagctttctttagcagaacatttagttgcatgtgttatcccaaaacattatcaagaagattatcaaagccttgtgcccaatgacttgaaacacagggtttattatttagattactgtaacgaaacactttatgagtggaatcaaaaagtttatgattttctttgtcatttggaaaataaataaaaccaaaaagtttaaaactttttggtttaactgctattaattggtctttaaaagacttaaaaattcttcaatcataggactaaaagaagtatcatttcggtaagcaataccaatcggataaaaattatttttatccttaagtgggacccagcataaatcttgaacttggctaatgctttcaaattcacttggtaaaatagtgactgcattgaggtcttgtaaactatgaataagaacttcccagtcattgtgtttaaagacgatatgggggtcaaatcctaaagcacgacatttacgaggcaacatctctcctagcatataatgttcgttgagtgaggcaactttataatctcttaaatcattaagttcaatttcaggaagtgttgcaagaggatgcgattttggcatgacaatgcttactttatatcctttagttgaggtttgcagtggttcgatagtgatatcattgcgggtacttggaaaggacaataagccaatatcgatctttccttttgctaacaattcttgtaatttacgggaaccatcttgaatcaaagatacttcaacatttgaatgtgtagccataaaagttgaaatctgtttcataaattgaatagcaaaaagagaagtaagccctacacggataccttcctttttttcttgatttaattgctggatctccgtaaccatttgattaacattagtcatcaacaattgtcctttctcatagagaatttctcctgcttcagttaaagcgagttgacgaccattttgtaagaataaaatagtatttaattctgcttctaattttttaatggattgtgaaagtgtaggttgggtcacaaaaagactttttgcagcgcgtgaataattttttgcttctgcaacagcaataaagtaagtaagttgtctaatatccataatatctgtccttttttcttagtaatagtatagcacaagtctatcaatctgacctttatgattatttccacaataatattagtaaaagctatacttatataattttttccaattttccttttgcaaatagctatgatatagttaatatagttagtgaaatcacaaacaatcattattagtaggaggcatcttatgtcggatgttgtcgaaaaacaaacaactaaatcgtttataatgaacgtattaaatggtttagctttagggactgttattgtcttgataccaggagcaatccttggagaattaatgaaagctttactgccaatgtggagcggctttgcaactttaatcgctgcaacagcagttgcaacaagtatgatggggcttgttattggtattatggttggtctcaattttaaatttaatcccattcaatcagcatcactaggattagcggttatgtttgcaggtggagctgcaaccttccttaaaggcgctattatgctaaaaggaacaggcgatatcattaacatgggaattactgctgccttaggtgtccttttgatccaatttttatctgacaagacgaaatcattcactttgattgtcattccaacagtaacactcttactagttggaggagtaggtcatgtgttattaccttatgtcaaaatgattaccaccatgattggacaagggacacgccgtacgcatgaaaactttctcttcatccttttgtgcccggacatcaattttgaaaagattcctttttaaatcaatgatctgcttagcctctttctccaaataattggactaaataatcttccaaatggacagaaatataccgttgtttgcgacgataactgaggtcttttttaggaaataccatcactttgagaaaatataagcacatttttcggataagatttaggttaaatgcggctcttttatccaatgtctgatgatgatcttcatgataaacaacgtccaataaccagtgcatactctctatctgccaatgacctcgtacacaattggcaaatgtgaggacatccggcttaaagctaaagataaaataacgattctcttgactcagctgaccatccttatcaatcgtgttacgagtcatcccaataccacgtaacttatgccatttgggatggttttgacacaaccatttgatatcggaagacacccagtattctctaacttcaatctgtcccctagatttttcaacagtctgataatactgcgcattttcttggagttcttccaataagttgacatcactaaaataaagagcaatatcatcataaagtgtttcttgatttcctttgacggctaagcaatagtctgctttaccttttataatcgtatcaacgatagccgtctgcgtgcccattgcgtctatcgttacaatgcttttacggatatcaattgtccgcaataactgaggaatggcaacaatttcattacttttctcctcaaccgctacctgtcccaaactaagatgatgacccccatcataagccgttacaatatgaacaggcttctgatttttacctcgattgcctcgaatcgttttaccgtccactgaaatcagttgatgaacggcatctaagcttgtcaatgattgctcaaattgaactttaagctcttttaaacggtctgaattaacaagactaatcacacgctctaaggtatcatgagacggacaaccttcactcaaatcaacgtaggtcgcaaacaatggttcattcatttcaataaaatcttccatctccttccaggtttcaatgccagctaactgacaaacaaagacaagaaatagaatggttgataaggggtagcgaattttccaagattgacgactatccaattcaactgcgcaatcatcaatagaaataataaaatcaatcatcgtagtcacctcatctatagtgtactactttgattgattttgtcattatgaatctagttttctgaaaacaaaagtttcttcatgcgtttggcgtggacaagggattgcttcattacttggtttacaacctgttttgatgtcaattttaattgcgatgattttctgtttcttgatcgtatctccaatcacaacagttgggattgctttggcaattagtttgtccggaattggttctggtgctgctaatttaggtatctgtgctgctagttttgggctttgtatggctgggtggtcagtcaattctaaggggacagccttagcgcatgttttagggtctcctaagatttcgatggctaatgtattagcaaaaccgaagattatgctacctatgatatcttcagcagcaatactaggaattctcggagctctctttaatattcaaggaacaccagctagtgcaggttttggtatcagtggtttgattggaccgattaatgctcttaatttagcaaaaggtggatggtcagttatgaatatgttattgataattataatatttgttgctgcaccaattatattgaattttatttttaattacctctttataaaagtacttaaaattattgatccaatggactataaattagatatttaaggagatattagtgatgaaactcaaagtatttaatgttagagaagaagaagcaacattagcacaagattgggcaaaccgaaatcatgtggaactttctatgagtgaaggacctttgacattggaaactgttaatgaggtagaaggttttgatgggattgctaatgcacagattgagcctttagatgatgctatttatcctcttctcaaagaaatgggaattaagcaaatcgctcagcgcagtgctggtgttgatatgtataatcttgagttagctaagcaacatggtattatcattagcaatgtgccaagttactcaccggagtctattgcagaatttacagtgacaatcgctcttaaccttattcgaaaagttgagcttattagagctaatgttcgtgaacagaatttttcatggaccttgccaattcgaggacgagtcctaggtaacatgactgtggctataataggaactggtcgcattggtctagcgactgctaaaatttttaaagggttcggatgtcgtgttattggttatgatatttaccataatccaatggcagatggtatccttgagtatgtcaattcggtagaagaagctgttgaagaagctgatcttgtgtccttacatatgccaccaactgctgaaaatacgcatctatttaatttagatatgtttaaacagtttaaaaaaggtgctattttaatgaatatggcacgtggagcattggtggaaaccaaagatcttcttgaggctttagatcaagggcttttggagggagctggtattgatacttatgaatttgaggggccatatatacctaaaaattgtcaaggtcaagacatttcagacaaggatttcctaagactgattaaccatccgaaagtaatatacactcctcatgcggcttattatacagatgaagcggtcaaaaatctagtagagggtgccttaaatgcttgtgtagaagtgattgaaacgggaacaactactacgaaagtcaactaaaagatgcttaggcatctttttttgtggggtaacaaaacatatgatgatcatgacctttaaagcaaaaaaacatcttatgtatttatagctggaaagtcttttttataataaaaaaagatattttttataaaaatattgaaaaaacatcagatgaatagtattatttaatcataaaagcgtttacaaaatacaaggagggttctctcatggagaaaacaatggatatggaacaacgtgaagaagttgtatcttataaccgagcgaaagtatggcagttagttatgtttgccatgaacaatgcttctacaaatatatacttatttacgtttatgtttgttacctatttctcaactggcgttcttggctcggcagccatttttgtcagtcaaattatgggttatatccgtatttttgatggttttattgatccagctattggtattatgattgataaaactgatacaaaatttggtaagtatcgtcctattttgattattgggaacgttattacggctttgtcattgatttttcttcttgcattgagaggtgtcgatgaaaatattcgtttcccattatttatccttgttctaattatccataaaattggatactcaatgcaacagacaataactaaagcagggcaaacagcactgacaaatgaccctaagcaacgtcctatttttaatatcgttgatgcagttatgacaacatcattaatgacaggcggtcagtttgtcgtttcagttttcttagtaccaaaatttggtaattttacacctcaattcttcaatgtccttatttttggaacaattcttatttcagctattttagcaatcgttgcaattattgggatttgggcaaaagacagaaaagaattctttggtttaggagagaatacccaaaagactgctctaaaagattactggaaggtgttgaaaggaaataaaccgcttcagatattatccattgctgcagctttggtaaaatttgccatccaattctttggcgattccgttgttatggtgctattgtttggtattttatttggtaattatgctttatcaggacaattctcacttcttttcattgttcctggtgttattattaatattttgttctcaacaattgctcgtaaaaaaggtcttcgtttttcatatgtcagagcaattcagatcggtatgattggtttacttgcttttggtgcagttctttacgttggtaagcctggtgaccttagtttaacaagcctaaatctttatactattttatttatcgttactaatattattgcgagatacgcttcacaagcacctgctagtttagtattgactatgggagcagatatttctgactatgaaacttctgaatccggtcgttatgtatcaggaatgattggaactatcttctccttaacagattcgattgcttcttcatttgctcctatggtagtaggttttgtgttagcaggaattggattttcaaaatcatttccaactatcgaaacaccactgccccctgatttaaaaatggcagctattagtatccttgtggccattccatttatagctttgtctatagctcttcttttaatgaaattttacaaactagataaagaagaaatggttcgtattcaagagaagattcaagttatgaaagcagcaactactaaggaacgtgctaaagatattgctcgtaatgttcctttgacagatatggattatgttgatgtaacaaaatatcctattgataaagattaaaaagtttagctgctcttcaatagagcagctattttgttaaataagagctaccattggaggattcttatggcaaaaattatttcattaggtgaggttcttttgcgattatctccacctcaatatcacacactgatgcaggctaatcacctaaaatgccaattcggtggttcagaacttaatgtcttagcaagccttgctcaactaggttaccatgtaggattggtctcagctttgcctgataatgatttgggcaagatggcaagtcaatttatattgtcacagcaaattagtccagctgctataattaaaaaagaaggacgactaggaatttattactatgaacaaggattttcggtaagaacaaataaggttatctacgatcgtaactattcatctttttgggaaagtaccttgagtgattatgattttacttctatttttaagggagtggattggtttcatgtttctggaattactccagcactaaccaaggacttatatgaggtgactcggttccttatgacaaaagctaaagaaggaggtgtaaaagtatcgattgatctcaattttcgtgagagtttatggtcatcttttcaagaggcacgtgagcaattatcgccactattaggattattagatgtttgctttggcttagagccgatttatttagctggcgaaagtgaagatttaaaagatgagttgggcttatccagaccttaccttgatattgaattacttgaaaagataacccaaaagattgtccaagaatatgggttagactatattgcctttactcaaagggaaatggaatatactaatcagtatatgttaaaatcatatttgtatcataataatatgttatatcaaactgataaaactggcgttgaagtattagatcgtgtggggacaggagatgcctttgctgcaggtttaattcatgcgcttctggaaaaagaaactcctcaaagggccttagaaatagctatggctacatttaaatacaaacataccattcaaggagatatcaatatcatgacacgagatgatattgcttacctcattgaaaaagaaacaaatgatattaaacgatagtgtaaaaggagagtgtatgttatatccattattgacaaaaacaagaaatacttatgatttaggcggtatttggaactttaaattaggagaacataatccaaatgaattactaccttcagatgaagtcatggttatcccgacttcatttaatgatttgatggtaagtaaagaaaaacgtgattatataggtgatttttggtatgaaaaagtcattgaagtacctaaagtatcagaggatgaagagatggtgctgcgttttggctcagtgacacatcaagctaaaatttatgttgacggtgtattggtaggagagcataagggaggttttactccttttgaagttcttgttcctgaatgtaagtataataatgagaaaattaaggtatcaatttgtgctaataacgttttagactataccacgcttccggtcggaaattatagtgaaatcattcaagaagatggtagcattaagaagaaagtacgtgagaattttgatttcttcaattatgcaggtgtgcatcgtcctcttaagttgatgatacgtcctaaaaatcatatttttgatattacaattacaagtcgtctatcagatgatttacagtcagcagatttacattttttagtggagactaatcaaaaggttgacgaagttagaattagcgtttttgatgaagataacaaactagtgggtgaaacgaaggatagcagattatttcttagtgatgtccatctttgggaagttttaaatgcctatctgtacacagcgcgtgttgaaatttttgttgataatcaactccaagatgtctatgaggaaaattttggtcttagagaaatagaagtgacaaatggtcaattcctattgaatcgcaaacctatttattttaaaggatttggtaaacatgaagatacgttcattaatggcagaggtttgaatgaagctgctaacttaatggatttgaatcttttgaaggatatgggggcaaactcttttagaacatcccattatccttattctgaagaaatgatgcgtttagcagatcgaatgggagtgttagtgatagatgaggttccagcagtagggttatttcaaaattttaacgcttccttagatttgtcaccaaaagataatggtacgtggaatttgatgcaaacaaaagcggcgcatgaacaagctatccaagaattagtgaagcgtgataaaaatcatcctagcgtcgtgatgtgggtagtcgctaacgaaccggctagtcatgaagcgggagcacatgattattttgagccattagtaaaactttataaagatttagaccctcaaaaacgtcctgtcaccttggttaatattttaatggcaaccccagatagagaccaagtgatggacctggttgatgttgtctgccttaatcgttactatggttggtacgttgaccacggtgatttaacaaatgcagaagtaggtataagaaaagagttattagaatggcaagataaatttcctgacaaaccaattatcataacggagtatggcgctgatacgttaccgggattacattctacttggaatattccatatacagaagaatttcaatgtgatttttatgaaatgagtcatcgtgtttttgatggtattcctaatttagttggtgagcaagtctggaattttgcagactttgaaactaatctgatgatacttcgtgtacaggggaatcacaaaggtctcttttcaaggaatcgccagccgaaacaagtcgtcaaagaatttaaaaaacgctggatgactattcctcattaccataataaaaaaaatagtgtaaaataggggtagttattttagaagaggtgatgatatggctagacccttagtagaacaaacagcagatcgtctattgcatttaattttagaaagagaataccctgttggtgctaagctccccaatgaatatgaattagcagaagatctagatgttggtcgcagcacaatccgagaagcagtcagaagtttagcaacgcgtaatattttagaagtcagacagggctctggaacatatattagttctaaaaagggtgtttctgaggatccattagggttctctctaataaaggacacagataggttgacatcagatctctttgaactacgccttttattggaacctcgaatagcagagctggtagcttatagaattacagatgatcagttacaattactcgaaaagcttgttggagatattgaagatgctgttcacgcaggcgatccgaaacatttacttttagacgtggaatttcattccatgctagctaaatacagtggtaatattgcaatggatagccttttgccagtcatcaaccagtcaattcatctgataaatgcgaattatacaaatcgtcagatgaagtcggatagtttagaagcacatagagaaattatcaaagcaatccgagaaaaaaatccagtagctgcacatgatgctatgcttatgcatatcatgagtgttagacgttcagcattgaaagcttaatataagaagaaaaatagctattcttgaatagctatttttttagtattcttcttgacaattcatcagatgacttatataatatagttaaagataacggttacattttgggaggtattatgttaaatcaattgaaaaacaactatttctttgctgttattcgagggaaatcatctgaggatgcgctcgaaatcgcaaagcatgctattttgggtggtattcggaatattgaagtaactttttcgactcctgaagcaagcaaagtcatcaaacaattatcagatgactttaaaaataataaagaaattattgtgggggccggaacggtcatgacaactgaacttgctaaagaggctattgatgctggagctaaatttttggttagcccacactttgattcagatattgctaatttagctaatgaaaacaaggtttattatttcccaggctgtgcaacggcaacagaaatcgtggtagctagaaagtataaatgtcagattataaagctttttccaggtggagttgtgggtccaggttttatcaaagatattcatggtcctattccagatgttgatttaatgccatcaggtggcgtctctgtttcaaatgtagttgaatggagaaaagcaggagcagttgcggttggtgttggctcagcattatctagtaaagtagccacagaaggctatgatagtgttactaaaatagctaaacagtttgtttctgcacttgattagtgagtaagagaagaatatggcgtttaatactgaaacatttatgttaaaaaatcaagcagctatacagctgtatgaagaggtcaagagacaacctatttttgattatcattgccacttagatccaaaggacatttttgaagatcatatttttgataatattgtggatttgtggcttggtggtgaccactataaatggcgtcttatgagggctaatggtatttctgaagcagaaattacaggtccagcatccaaccttgagaaatttaaagcatttgctagaacactagaaagagcatacggtaatcctgtttatcattggtctgctatggaattgaaaaatgtctttggtgttaatgagattttgacagaatcaaatgctgaggaaatttatcatcgtttaaatcatttcttgaaagagcataaaataagtcctagacgtttaattgcagatagcaaagttatgtttattggtactacagaccaccctcttgatactctcgagtggcataaaaagttggctgctgatgagagttttaaaacagttgttgctccgacatttaggccagatgaagcttttattgaacatcgacattttgttgattttattactaaactgggtgacattactcaaaaagagattacagatttttcaacatttatagcagcaatggaagaacgcattgcgtattttgctcaaaatggttgtagggctagcgatatcagttttacggaaatcgtctttgaacaaactgatgaattggagttgaacgatttatttaataaagtttgtgaaggctatatcccaaatcaatcagaaatcagcaaatggcaaacagctgtttttatggaactttgccgattatataaaaaatatggttttgtaacacaggtgcattttggagctttgagaaataatcattctactatttttgaaaaattgggagctgacgtgggtgtggattcacttggtgaccaagtggctttaactgttaatatgaaccgtttattggattccttggttaaaaaagatagtctgcctaaaatgatttggtataatctcaatccagcttacaatatagcagtagctaacactttggcaaattttcaagctaacgaacttggagtgagatcttaccttcaatttggtgcaggttggtggtttgcagatactaaattagggatgattagtcaaatgaatgccttagcagagcaaggcatgttggcgaattttattggtatgttaacagattctagaagttttctatcttatcaacgtcatgactattttcgacgtattttatgtacctacttaggagaatggattgaagaaggagaagttccagaagattatcaagctttaggaagtatggctaaagacatcgcttatcaaaatgcagttaattattttaagaactaaaaaggaagagtgaaatcatggaaatgtcatttaggtggtatggtgaagacgaccccgttactttagaaaatattggtcaaattccaacaatgaaagggattgttacagcgatatacgatgtaccagtaggagaagtttggtcacgtgagcgcattcaacagctgaaagaaaaggtagaggcagcagggcttaaaatttcggttatcgaatcagtacctgttcatgaagatatcaaattgggacgtccaacacgtgatctcttgattgataattatattcaaaccgtcaaaaatttggctgcggaaggtattgatactatttgttataattttatgccagtatttgactggacacgcactgatttagcatatcaatatccagatggttccacagctttgatatttgatgagacggtttctaaaaaaatggatccagtaaacggtgaattatctttgccaggatgggatgccagctatagtaaagaagaaatgaaggctatcatggatgcctatgctgaaattgatgaggaaaaactttgggaaaatctcacttattttattaaacgtattattcctgaagcggaagccgtaggcgttaaaatggccattcatccggatgacccaccatattctatttttggtttacctcgcattattactgggttagaggctattgagcgttttgtgaaattgtacgatagtaaaagtaatggcatcactttatgtgtgggttcttacgcttctgatccccagaatgatgttttagagatttcgcgacgtgcttttgagttagatcgtgtaaactttgttcatgctcgcaatattaaattaggtgatggaaagtcatttaaagaatcggctcatccatcagaatacgggtcaatagacatgtatgaagttattaagttatgccatgaatttgggtttgagggtgctattcgacctgaccacgggcgtatgatttggggagaaacaggtcgtccaggatatggcctatacgatagagctttaggagccacttacgtttctggtttatacgaagctgtgattaaaggttcaaaataaggcgatgcttccaaatttctcctgttccaatctcctgaaagagaaatttggaaagttattatcataatatgattgtacttagctaagagtagaatacttatagaagttaatgagaggaataagatgtcaaaaacaattacatttaccaataaagttgtcgtcataacaggtgcaggcggtgttctctgtggttatatggctaaagaatttgcgaaagcaggcgctaaagtggcattattagatttgaatcaagaagctgctcaaacatttgctgatgaaattgtagaagaaggtggtatcgctaaggcttataaagctaacgttttgtctaaagaaaaccttgaagaagtgcatcaagccgttttagaggatcttggaccaactgatattttagttaatggtgcaggaggcaacaatcctaaagctacaactgataatgaatttcacgaattagacttaccttcagaaacaaaaaccttctttgagttagatgaagctggtattagctttgtttttaacttaaattatttaggaacattattgccaacgcaagtatttgcccaagatatggttggacgtgaaggagcgaatattattaatatctcttcaatgaatgcttttacccctctgaccaaaataccagcttattctggagctaaagcagctattagtaacttcacacaatggctagctgttcatttctcaaaagttggtatccgttgtaatgctattgcacctggtttcttggtaacaaatcagaaccgaagcttgttatttactgaggacggtcagccaactgcgcgtgctgagaaaattcttaataatacaccaatgggaagatttggagaagcaagtgagctgattggcggattgttctttttagcagatgaaaaatcatcaagttttgttaatggcgttgtccttccgattgatggtggatttgctgcttactctggtgtttaatttacaagataatagccacttaacacataagagattattgagttgagtggttttttaaggaaatttgtttaatgatcttaccactaaatgatgggtaggttgctaattggaaaatcctcataagttagataaatttagaaactggagataatatggtagatacaaatcacaaaatcgctttttgcatagattctgatggttgcgcaatggatacaatgacatataagcatcaactcttttttggtccaattgctgcagatatatttgggatatcagaacaagaaagaacaagttttttaaaagagtgggatagagtcaatctttattcaagaactcgtggagttaatcggtttgtgggattggttatgggccttgagtttgccggagtagaacatattgataaattaaaagaatgggtcgaaacaacagactcattgtccaataattccttagagttagcgcttgccaacgattttagtagagatttagagaaggctttagaatggtccaatgaagtgaatcgccaaatcaaaaattatgagggagattctttagcgttttcaggtgtgttagaaagtttagaacgattaagtcaatttggtaatgtttatgtcgtgagttctgctaacaaggaagctgtttggcaagagtgggaagaacagggattgctaaagtatgttgatgatatctattgtcaagatagaggtaaaaaagaagatgttatcgccactttaattgcaagtggttactgccgtgaaactattttgatggtaggagattccctgggtgatctggctgcagcagaacaaaatggtattgcattttacccagtacttgttggtaaggaagtcaaatcatgggaaattcttagagaagatattggtgaagcttttgcaaaaggtcaattcgaacagcaaaggcaaaaagaatctattaataccttttgggctaatttagataactaatagaaaggataggctatgacacatttagttgacttaacaaagaaacccttcaatctaaatcaagaagcaattgagtggattgaaaaaacaattaatgagatgacattggatgagaaaattgggcaactttttttcaatatgggagctagtcgttcagaagaatatttaacagatgttttggatcggtatcatattgctgctgttcgctataatagaggtagttcaagtgaaatctatgatcagaatttaattttacagacaaagtcgaaattgccgatgttgattgctgcaaatacagaagctggtggagacggtgctgtcacggatggaactaaagttggcgatgaaataaaagtggctgctacaaatgatccgaaatatgcttatgaaatgggaagaatcgcagggatggaggcatctgctgtgggttgtaatgcttcattttctccaattgtagatttgacacgtaattggcgtaatcctatcatagctagtcgaaattggggtgctaacgttgatcaaattatttcactttcaaaagagtatatgaaaggaatcatgcaatataatattgtacctttcgctaaacattttccaggggatggcattgatgagcgtgatcatcatttgtcatttgcttccaatcctatgagtaaagaggagtggatgtcgacatttggccgcatttatggtgaattggctgacgcaggtttaccaggagtcatggcaggtcacatacatttaccaaacgttgaaaaagaaatgcatccagagcgagaccttgatgatatgttaccagcttcattgaataaaacacttttagatgagttattgagaggagagttaggttataatggagctattgtaacggacgcttctcatatggttggaatgactgcttcaatggcaaggagagatttgttgccaacggcgattgaagcaggttgtgatttattcttattctttaatgaccctgatgaagacattcaatggatgaaagaaggttacgaaaaaggtattctaacagaggaacgtctccatgacgctttacgtcgtactctcggtctaaaagcgaaattaggcttgcataactatgagggacgtcgccaagaactctttatgcctaaagataaggctatggctttaatcaacacattagagtcgcaaaaaatagctgatgaagttgctgataaagcagtaactctggtaaaagataaacaaaaagatatctttccagtaaatccagaacgttatcgtcatatcttacttgttaacgttgaaggatataagggaggttttggtgcgatgattgctggaaacaagcaacgtgcatcggattacatgaaagagttacttgaggcacgtggccatgaagtaactgtctgggagtctaccgaagagcgtattatgaaattgccacaagaggagcgggcagcagctatcgctaatgtttacgcacaaaaacagccaatcgcaaatctaacagaacactatgacttgattattaacttggtagatgtcaatgctggaggaacaacacaacgtattatttggccagcagctaaaggcacccctgatcagcctttttacgttcatgaaataccatctattgtgatttcagtacaacatgcatttgctttagcagatatgccacaggtagggacttatattaatgcttatgatgggcttcctagcacgataagtgcagtagttgcgaaattggctggagaatcagaatttacaggagtttcaccagtagatgcttactgtggtttaattgatacacatttatggcgccaatgctaatagaaacaagatgatgtacttttatgtaacataaaaaaagagcttaaagctctttttttatccttcaaaatagagtagttccttgggtgttttggtaaatacttcaaagccggttttagtcacataaccgcagtcttcaattcgcacaccaactttatctggtatataaatacctggttcaacagagaagcacatgccttcttgaatctccatatcgttaccagccataatagatggaaattcatggacatccatacctaatccatgaccaaggcggtggttaaagtattgtccataaccagccttttcaataacatttcttgctgctgcgtcaacttcagaagcaaggactcctggcttaataaaatcaatagccgcttgatgtgcttcaagacataaatggtaaatatcttttttgaattgatcaggtttccccactgctactgtacgggtcatatctgacgtataacctagtgtttctacacctaaatcaaataataacaaagcattattttcgattttattagttcctgggataccatgtggatttgctgcattattgccagtcaaaaccatagtgtcgaaactcattttattgataccttgttttttcatttcaaattcgatttgagcgataatatcggtttcagtgttgtttagcgagatattgtcaaatccaacttgaacagctttatcagcaaattctccagcgactaacattttctcaatttcatctcgtgatttaattaggcgcatgttttgaatataaggtgttaggttttcaaaatgaccatcaaaaacggtttggagaccttggaatttagtaacattaagattatcaaattcggctagaactttagaaacagaaaaggatggtaagttgctagctattttttgccaaggattttctgaatctatgtaaccaaagacgggaaatggtacactttgttttgcacgcgatacttctagtgctggtacaaataaaataggatcgcgatcttcatagacaaataaaaacatttgtctttcatggggatcgcaaaagaaacctgttaaatagttgactgtcacaggatcagaaaagacagcaagttcagcttggactgaatgtaagtgatggcgtatacgattaagttttgacataataacccttcttcctaaaaggaacttagtctagttaggctagtttcttatgcctattatttttccaaaaaaataggaaaaaatcaagtttagttagtattttgaaagtttttcataaaaaagctttataaaagcttgaaagtgtttccaaaaggtgataaaatatcagtgaaagcgtcattttcaaatagaaaggaagttaaatcaatatgaatacagatgatacgattacgatttatgatgttgcccgtgaagcaggtgtttcgatggcaactgttagtcgtgtggtaaatggaaataaaaatgtcaaggaaaatacacgtaagaaagtccttgaagttattgatcgtcttgactatcgtccaaatgctgtggcgcgtggtttagcaagtaaaaaaacgacaactgttggtgttgtcattcctaatatcgcaaatagctacttttcaattttagcgcgtggtattgatgatattgcagcaatgtacaaatataacattgtccttgcttcaagtgatgaagacgatgataaagaggttaatgttgttaatactttgtttgctaagcaagtagacggtattatttttatgggacaccacttaactgaaaagattcgtgcagagttctctcgttcacgcacaccgattgttttagcaggtactgtggaccttgagcatcaattaccaagtgttaatatcgattacaaagcagcagcagttgatgttattgatattttagctggcaatcataaagacattgcttttgtatcaggaccacttattgacgatattaatggcaaggttcgtttggcaggatacaaagaaggtctcaagaaaaatggcttaaactttaaagaggggttggtttttgaagccaactaccgttatgctgaaggctttgcattagctcaacgcgtgattaatgctggagcaacagcagcatatgttgctgaggatgagttagcggcaggtttgttaaatggtctttttgaggcaggtaaacgtgttcctgaagattttgaaattatcacaagcaatgactcgccaatcgcacaatatacacgtcctaacttaacttctatcagtcaaccggtctatgatttgggtgctgttagcatgcgtatgctaacaaaaattatgcacaaagaagagttggaagaaaaagaaatagtgcttaatcacgggattgttaaacgtggcacaacaaataattagtgttagagtatgttatttgaaaaatagtggtagaatggtagtagcttagcgcttaactttctgatacttaacatgatatattgagaggattagggtagcttagcttcctaatctttttttagaggtgtaatatgacaaatgaattgataatgcaagcttttgagtggtatttacctagtgatgggaatcactggaagaaattagaggagtctatatcagaccttaaaaaacttggaattagtaaaatctggttaccaccagcatttaagggaactagcagtgatgatgtaggatatggtgtttatgatctctttgatttaggagaatttgaccagaatggaacaattagaacaaaatatggtaggaaagaagagtatctaaagcttattaagtcgttaaaggcaaatggcattaaaccgtttgcagatatcgttcttaaccataaagccaatggtgatcataaagaaaaatttcaagtcatcaaagtcaatcctgaaaatcgtcaagaagcattaagtgaaccctatgagattgaaggatggacgggatttgatttcccaggtagacagggtgagtacaatgattttaaatggcactggtaccactttactggtttagattacgatgctaaaaataatgaaacagacatctttatgattgtaggcgataataaaggttgggcagacgatgatttgattgatgatgaaaatggtaatttcgattatctcatgtacaatgacattgattttaagcatcctgaagttataaaaaacttacaagattgggctaagtggtttattgaaactacaggcattgaaggttttcgtttggatgctgtgaaacatatcgattcttactttattcaaactttcattaatgatattcgtacaaaaataaaacccgatttagaggtctttggcgaatattggaaatctgaccaaacatcaatgaaggactatttagaggcaacacaatttcaattttctcttgttgatgttaccttacatatgaatttttttgatgccagtcaccaaaaccgtgattttgatatgcgaacaatttttgatgatagtcttgttattgataatcctgagtatgctgttacattcgtagaaaatcatgatacgcaaagtggacaagctctagaaagtagagtggaagattggtttaaacctttagcttatggcttgatacttttacgccaacaagggactccatgtcttttttatggtgattactatggcattcaaggagaatttggtcaaccatcctttaaagaggttattgataaaatggctgagctacgccaaaactatgtatttggcaaacaagtcgattattttacgcattcaaattgtattggttggacttgtcttggggatgaggaacataattcttgtttagctgtggtcctaacaaatggtgatcagggatggaaacatatggaagtaggggaaatttatgcaggcaaaacgtttgttgattatttaggtaattgtgaacaagaggttgttataggagatgatggttggggtgattttttagttgaatctgcgtctatctcggcttgggttcctaaaatagaggaagctaactgataaatcaggtgaaaaaaaaggtaaaatgagatataataagacctatgaaagttttactgtatttagaggctgaagaatacttgaaaaagtcaggtatcggtcgtgctatcaaacatcaagagaaagctcttcaaattgctgggatagattataccactaatcctacagatgactttgaccttgttcatatgaatacctatggtattagaagttggcttttgatgagtaaagctaaaaaaactgggaaaaaagtaattatgcatggccattccactgaagaggactttagaaattcttttattggctcaaatttagtatccccgctttttaaatggtacctttgccgtttttatcaaaaagcagatgccattataaccccaactgattattctaaacaactaataaaagcatatggcatcaagaaaccaatttttgttttatctaacgggattgatctaagtcgctatcagaggtcagaaaagaaagaatctgcatttcgtcactattttcacttaagtaaggatgataaagttgttatgggggccggtctttatttcatgcgtaagggaattgaccaatttgttgaagtagctgcaaaaatgcctgatattcgttttatttggtttggagaaacaaataaatgggttattcctcgaaaggttaggcaaatcgttaccaagcaacatccctcaaatgttacttttgctggttacataaaaggtgatgtttatgaaggtgccatgagtgctagcgatgctttcttctttccgagtcgtgaagagacagaagggatagtagttttagaggctttagctagtcatcagcatgtggttttaagagatatccctgtgtatcacggttgggtgaccgaagacagtgttgaattagcgactgatgttgatggttttgttgaaaagttggataaagtcttatctggtaagagtgataagattaaagaaggttatcatgtggctgagagtcgaagtatcgaacgaattgcccatgaattggcaagtgtttatcaaaaagtaatggagttgtaagatgcgtataggtctatttacagatacatacttcccccaagtttcgggagtttcaacaagtatccgcactttaaaggaagggttggagaaggaaggacacgaagtttatattttcacaactaccgaccgtaatgtcaaacgttttgaagaccctacaattattcgtttaccaagtgtcccttttatttcttttacggatcgtcgagtagtttatagaggtttaatttctgcttataggatagctaaagactacgaacttgatattattcatactcaaacagaattcagcttagggcttttaggaaaattagttgcaaaagctttaagaatacctgttgtgcatacttatcatactcaatatgaggattacgttggttatatcgcaaaaggcaaattgattaagccaagtatggtcaaatatatcatgcgtacctacctaagtgatttggatggtgtcatatgtccttctcgaattgttctcaatcttctagatggttacggtgtcaaaattccaaaacaagttattccgacaggtattcctgttgagaactatcgtcgagaggatatctctgaagaaacaatcaagaatctacgaacggagcttggacttgcggataatgatacaatgctattgagtttatcacgggtatcttttgaaaaaaatattcaagcaatcttgatgcatttatcagctgtcgttgatgaaaatcctcacgtaaaattagtgatagttggagatggtccttatctttcagatctaaaagaacttgttcactctttagaacttgaaaattcagttatttttacaggtatggttgagcatagccaagtggctatctactataaagcatgtgatttctttattagtgcttcaacaagtgaaacgcaaggattaacttacattgagagtctggcgagtggacgtccaatcattgcgcaaagtaatccttatctagatgatgttatttcagataaaatgtttggaactctgtacaagaaggaaagtgatttggcagatgctatcctagatgcaatagcagagacacccaaaatgactcaagaagcttatgaacagaaattatatgagatttctgctgagaatttcagcaagtctgtatatgctttttacctagactttctgatttcacaaaaagctagtgtgaaagaaaaagtctctctgacaataggaaataaggatagccattctactcttcgttttgtcagaaaagcggtatatttacctaagaaagtttttacctttacaggaagagcctctaaaaaagtggtaaaagcacctaaacgtcgtatttcatctattcgagattttttagattgagacgaataaaattagtaaatgtcttgaaattataaaaaatattgttataataaaaaatgaagacatgttaggttctaatagattttaagagcgagcactggttggtggaaagagtgcaattagagaacttagtactacttccttgattttatgcaaacataaaagggtggttcccttatcgccactagaggtctgacacaagtatactcgagtttttgtgttggataaattgaggtggaaccacgtagtctttacgtccttttggatgtaaaggctctttttttataaaagaagtggttgcataaaagaggcagattgctttgctaatgttatacttattatccctagctaggataatgtggaattcaatcaaaggtcaatccctttgtttattagtgaattaatgtgtttaggaattggtatcatcctaacagttattaagaaaaggagaacaagatgattaaaatcactttcccagatggtgcaattcgtgaatttgaatctggcatcacaacatttgaaattgcacaatcaatttctaactctttagctaaaaaagctttagctggtaaatttaatggtcaacttattgatacaacacgtgctatcgaagaagatggtagtattgagattgtaacacctgaccacgaagatgctttaggagttcttcgtcactcagcagcgcatttatttgctcaagctgcaaaacgcctttttccagacttatgtttaggtgtaggtccagctattcaagatggtttttactacgatactgataataaatcaggtcaaatttcaaatgatgatcttcctcgtattgaagaagaaatgaaaaaaattgttaaggaaaatcacccttgtattcgtgaagaaatcagtaaagaagaagcgttagaactttttaaagatgacccttataaagttgaattaattagtgaacatgctgaagatggtttaactgtttatcgtcaaggtgaatttgtagacctttgtcgtggacctcatgtcccatcaacaggacgtattcaagtctttcatcttctaaatgtcgctggtgcttactggcgtggtaacagtgataatgctatgatgcagcgtgtctatggtactgcttggtttgataaaaaagatttgaaagcatatcttaaacgccgtgaagaagctaaggaacgtgaccatcgcaaattaggtaaagaacttgatttatttatggttaatcctgaagtaggtcaaggattgccattctggttgccaaatggagcaactattcgccgcgaattggaacgttacattgttgataaggagattgcttcaggttatcaacacgtttacacacctccgatggcatctgttgaattttacaagacttctgggcactgggaccactatcgtgaagatatgttcccaacaatggatatgggagatggagaggaattcgttcttcgtccaatgaactgcccacaccatattgaagtttataaacatcatgttcattcatatcgtgaattgccaattcgtatcgctgaacttggtatgatgcaccgttatgaaaaatcaggggccctcacaggattgcaacgtgtacgcgaaatgacactcaacgatgcccatattttcgttacacctgagcaaattaaagatgaatttcttaaagctcttaatcttatagcagaaatttatgaagattttaacttaacagattaccgtttccgcttatcttatcgtgacccagaagataaacataagtattatgataacgatgagatgtgggaaaatgcacaagctatgctaaaagaggctatggatgattttggattagattattttgaagcagaaggcgaagcagccttttacggtcctaaattggatatccaggtgaaaactgctcttggtaatgaagaaacactatctactatccaactagatttccttcttccagaacgctttgatctcaaatacatcggtgcagatggtgaagaacatcgtccaattatgattcaccgcggtggtatttcaacaatggagcgctttacagctattttaattgaaacttacaaaggtgcctttccaacttggcttgctccacaacaagtttctgttattccaatttcaaatgaagcccacattgattatgcttgggaagtggctcgtgtccttaaagatcgtggtattcgtgctgaagtagatgaccgtaacgaaaagatgcaatataagattcgtgcggctcaaacccaaaaaattccatatcaattgattgttggtgataaggaaatggaagaaaaagccgtaaatgtgcgccgctatggaagcaaagcgactgaaacaaaatctatagaggaatttgtagaaagtattttagctgatattgcaagaaaatctagacctgacgaagttaaataaattttattagtcattataaaaatcattaataaatgatgtgaactgattactgtatgatgcagaatcagttttttagatgctaattttttctttatgtttaattataagctaattatagataaataatctcatataacattcacaaaattagatttttttggtataattaatatgattgacacataaaggaaaatagtattaataaaaaggggtatggagcattgcgaacagtattagtagtgcaaggtgatgacgaaacaatagagttattaaggtcgtatttagagggagctctttataaggttgtgatggctagtgatggtgaggaggctttttctttatttcagcaacatcagattgatttagcaatcatagatattacgctacctaaaatagatggatatgagttgacgcgactcattcgtcaagatagtcagattcctattattatgctagcagctaagacaacagatatggacagaatattaggattgaatattggagcagatgattttatcacgaaaccgtttaattctttggaggttttagctcgaattaattcgcaactgcgtcgttactatgaattcaatagtcttgccaaacctaaaaatcaatttataaagataggggaattggaattagatgaggaacatgttgaactaactaaaaatggtaaacatatcaagttgactgctacagaatttaagattcttcatatcttaatgtcatcaccaggaaggatttatactaaaacacaactctatgagaagattaatggtaggtatttagaaggtgatgagacaacgattatggtgcatatttctaatatccgtgacaaaatcgaagatgatagtaaatatcctaaatatataaaaacacttagaggagtaggatataaaatcgaaaaaccgcagtatcttgtttaaaaatataatggctagtaagagccattttttagtgaagatatttcttggttttaagctttcctttttgctataataagtaaaattggaggggagagatatggcaaagaccgctcttaatattccttttacagttgaagggatagaaaattattatcaaaatataaaaatgatactgtctttagcagataaatggagcatacctaaagatgatctattactttttttaaagggcctcaaggctattgatgatataaaagttggctctcctatttttaagtatttttggacttctttaagtttacaagcacccctcaaagctttagaattcgtgttagagcaggctaaaatgccaactgaattgtcaggagaattatcagaaacacaatacttggtcgcacagttttcagatgagttagctccacatgatgatttctggatagccttatcacaagttatttatgattcttttcctgggaatagtctagccgaagatactgtattaaataggaaactccatcaattccgctatttgatttctagtcagcaagcacagtatgttcgacgatactttaaagatgttggtatgactgatagagatgctttagtaaactacctatcatgtttaagagaaccagatagtatcgcctactatgaatctgctcgcttgcataataaacgtcggagaaatggtgaaatctttggtttcccagatgatgagccggttattaatagtaagcttttaatttcattccatacggaatttattattgatgacaaaggaaactttttaaacgagattgacgcagaagtaataacacgtaatggtattatcaatggagctagctttaattatgcttttaaaaataatacacgtcataaagaattagatgttgatcctgtaaagttagacccaaaatttcgaaacgatatgactagaggttatagatcgccaaatctatctagaaggaaatggtttttctttaaagaagaggattacgattgtagttatttcaataaaaaaggatattacgcatttggaaggcgtagtgctaagcaatcggttgataaacaagtcaaatacttgaagaaggctgtgcagaaaatgcgcatcaactgatacatatactattaaaagataccatagtactatggtatcttttaatttgaggtattaatgtcaaatggttttttattgaccacatgtttttataaacgagtggtcaaaattgaagaagtatctagcttatgttaaaatataattgaataatagaaagaaggtgctgtatgattaagaaaaataaagtttttttaggagttcttttagtccttgttgttatccttggaggtggtgtattattttaccaatcacaattccaaaagacaactaatcaagcgttagctattgcttataaagatgctaaagtggctaagaaggatgtcatacatcaaaaaattgacaaagaatttgaaaactttagagggagctacgaaattgaattcaataccaaaagcgcagaatacagctatcatgtagatgttaagactggacaaatccttgagcgggacatggataataatggcttttcaaaatcgacttctcagtcaagttcatcgtcaagtcaaaaatctcataaaataagtcaagaagaagccaaaaagattgcatttaaagatgctaatatagaggaatcagaagtcagtaatcttaagatcaaagaagaaattgaaaatggaaaatcagtttatgatattgactttgtggacctgaaaaataaaaatgaagttgattatcaaattgatgcagaaactggaaaaatcattgaacgttctagagatcatatgaatgattaatttaaataagatataaaaaaacgaaggtctaaaaggccttcgttttaattactcagtagcttgctcccaacgttttgaaagtttacgtgaaaaacttgagatgataaagtttgtaatgaaatagacagcagttataatagcgtagagtgtaaaaacttgtccagcttcgaaatatcttcccattagaatttgactttttccgaagatttcttgaatagctataacagaataaagtagtgatgtatcttttataaccgttacaaactgagaaataatggctggcaacattttgcgaaaagcttgtgggaaaataataataatgaaaacttgcaaataagtgaatccttgagaaagtccagcttctgtttgtcctttatcgactccatttaaacctccccgaataatttctgctaaagcagcggaggtaaaaattgtaaacgaagtaataccagcgctgactgatttcatctggaatactaagaaaatgataaaaatccaaagtagatttggaacatttctgacaaattcgatatagatactagctattaatttccagataggatttttgctatttctcataattgctaatagagttccaaaaaacattgatagtaaaatggaaataaaagatatatataaggttaaaccgaacccttgaaggagaaatagtatctttgttagtgttaagactgatgacatatcaaacctccttaagaataagttttcttatttaattcttcttgttttcttgcccagcttgctagtgggaaacaaataacaaaatagaagatagcagctcctgcaaaagctgggatataattagtcgtatcataagcccaggccttagctacaaacatgatatcggctccagaaatgattgctacggtagaggtattcttgattagattaacaacttggttggtcattggtggtaaaattgttctgacagcttgaggcaaaatgataagttgcatggtttgattagctgtgaatccttgagctaaagcagcctctgtttgtcctttagggacagcttcaattcctgagcgaataacttcagaaatataggcaccatggtatagtccaacgcacaaaacggcggtgaaaaaagcactaatcataacatgtccattactaatgattgctagtccatagtagacaaaaaccatttgaactaaaagaggtgtgttttgaaaaacttcaacatagatacgtgatatcaacttaccaactttacttttagaagttgataaaccaccagagagaattcctaatatcagagcaagtaggagtgcaccaaacgaaatacctagagtatataagaagcctttaaagaataggtcgaaatggttaaagaaagcgccccaccttgaaatggcaaaaggactgatgtttaataaagtcataaaaaatcctccctattctttttttactttagcgggtttaagcttaaatttttgataaatgtgttttaaactaccatctttttcccatgataccagtaacttattaacgtagggaatcaagactttgtcctgtttactggttgcaataccgtattcttgcgtattgaacccttcttttaatatggttgtatgagggctaaggtagccgctaaggatagatttatcaactgaaaaagcatcaatacgattagcgtacagcgatatcgctaattctgggaaactccctaattgagcatagctaaattttagcttgtgttctttagcatatttttctaaattgacttttgtagtggcaccttgagccacaccaatgtgtttaccatccaattcttttatagttttgatatgactatttttacgcaccaaaaatccaatttcatcgtgataataagctttagaaatattatagttagcttttctttcgggcgtgatagtgtatgttgcgattagaatatcaatttgcccattgtccatcagaggctctctggtttgtgcggttgtcggtacaaaaactggtttgacacctaaggatttggcaatttttttggcaatatcaatttccattccttcgtattgattcgtctcagcattataataaccaaagttaggcacatcttgtttgactccaactttaaggacgcccgattttttgatttctgataattgattagctgacgttgagttaggataaaataacaggaaaataaaaatacaggataatagatagaacgttaatctttttcgtctcagcatatttcgtcctcctaaaggtcagtactggtatggttgataatgttgcttaaaaattgtttagcacgtggttctctgggattatcaaaaaagtcttgtacatctgtagtatccactaaaatttccccatcagccataaaaataatacgatcagcaacttctcgtgcaaatcccatttcatgagttacaacgaccatattcattccgtcatttgccaatttttgcatcactgaaagaacgtctccgatggtttcgggatcaagggcagaggtaggctcatcaaagaggaggagttttggatgcatggcaagccctctagcaatagcaattctttgtttttgaccacctgatagcatagatgggtaggaatcttttctttcccacatattgacaaattttaaatatttttcagcaatttccatagcttcttttttagattgttttaatactttaataggagctaatgtaatattttctaacacggttttgtgaggataaaggttaaaatgttgaaaaaccataccaacttctttacggaggttgaccaattctttagatgaaatatttgctaattcatgtccattcacgaccaaactaccatcgtcaatagattcgagagcgttcattgttctaataagtgttgatttacctgatccagaaggtcctaatagaacaaccacttgccctggctctatttccaaattaatctgacgaagggcgtgataatctccataatacttgttaacattcttataagatatgagtgacataagaacctcctaaaataacagtttattgttaggttacctaacattatagataagtgtatcacctgtttgtgagcttgtcaataaattcagaatattaaagagtaggattgatttaaatattgctatttttagagcggtatttttagtaaaaatattacgttctcgtatcatttatttttcagtttaataggatgtattgaaagtttccaattaactaggaaatctgttataattagtgataatagtggtgctttaggcccatattatcatattttcggtcacttttatttttcagtttatgaatggaagtgggagaccagaaagtaatagaggtaaaatatgaaaaaaatacttatcgttgatgatgaaaaaccaatttcagatattatcaaatttaatttaaccaaagaaggatatgagacggcgacagctttcgatggccgtgaagctttagtacaatatgcagaatttcaaccagatttaatcattttggatttaatgcttcctgaactagatggtttagaagtggctaaggaagttcgtaaaaccagccatattcctattattatgctttctgcaaaagacagtgagtttgacaaagtcattggtttagaaatcggtgcagatgattatgttactaaacctttttcaaatcgtgaacttttggcacgggtcaaagcacatttacgacgtactgaaaatattgaaacagctgtagcagaagaaagtgctcaaaatgcttcttcagatattactattggtgagttgcaaattttaccagatgcctttattgctaagaaacgtggcgaagaaattgaattaacgcaccgagaatttgaattacttcaccatttagcgacacatatcggacaagtcatgacacgcgaacatttattggaaacagtttggggatatgattattttggagatgtccgtacagttgatgtgacggtgagacgtttacgtgaaaagattgaagatactcctggtcgtccagaatatattttgactcgacgtggtgtaggttattacatgaagtcttatgaataatagtgctgcaaatattaggtcgtttgagctagccttactttttttactagtttttgttgctgtttattttgtttatctagcggttagagattttaaaatgtctaaaaatatccggcttttgaattggaaagtcagagatttgatagcaggaaattattcagatagtattctaattcaaggtgatgcagatttggtagaattaggtgaaagtctaaatgatttatctgatgtcttccgaatggcacatgataacttagaacaagaaaagaatcgcttagcaagtatcttaacttatatgactgacggtgtgctggctacagatcgttcaggaaaaatcgttatgattaatgagacagcccaacagcagttcaatctagcatatgatgaagctttatcaatgaatattgttgatatgttagggtcgggaagtccatattcgttccaagatttagtctctaaaacgccagaggtagttcttaatagacgtgatgaaaacggtgaatttgttaccttacggattcgatttgctttgaaccgtcgtgaaagtggttttatttccggtttagttgcagtgtcacacgatgctactgagcaagagaaagaagagcgtgaaagaagactttttgtatctaatgtttctcatgaacttcgtacacctttgacatctgtaaaatcttatttagaagctttagatgagggagcgcttaatgaagaagttgctccaagcttcattaaggtatctctagatgaaacaaatcgtatgatgcgtatgatatcagatttattaagtttatcgcgcattgataatgaagtaacgcatttagatgttgaaatgacgaattttacagctttcatgacctcaattttgaatcgatttgatcagattagaaatcaaaaaacagtcacaggaaaagtttatgaaattgtcagagattatcctcttaagtcaatttgggtggaaattgatacagataagatgactcaagtgattgataacattttaaataatgcagtcaagtattcaccagatggtggtaagatcacagttaatctacgcacaactaaaacgcagatgattttatcaatatcagaccaaggcttaggtattcccaaaaaagatttacctctcatctttgatcgtttttatcgtgttgataaggcgagaagtcgtaaacagggtgggactggacttggtttgtcaattgcaaaagaaattgttaagcagcataagggatttatttgggctaagagtgagtatggtaaagggtctacttttacaatagtcttgccttatgataaagatgctgtaacttatgaagaatgggaggacgttgaagattaaaacatgtcagaaataggatttaaatatagtatcttagcttcaggttcaactggaaattgtttttatattgagacaccccaaaaacgtcttttaattgacgctggtttaacaggcaagaaagtgactagccttcttgcagaaattaatcgtaaaccagaagatttagatgctatactagttacccatgaacattctgaccacattaaaggtgttggcgtattggctaggaaatatcaccttgatatttatgccaatgagcagacgtggaaagttatggatgagcgtaacatgttaggcaaagttgatgttagtcaaaagcatgtttttggacgcggtaaaaccttaactttcggggatttagatattgagagctttggtgtaagtcatgatgctgtggatccccaattttaccgtatgatgaaagatgataagagctttgtgatgttgacagatacaggatatgttagcgaccgaatggcaggcttgattgagaatgcagatggttatttgatcgagtcaaatcacgacattgagattctacgttcgggttcttatccttggacacttaagcaacgtattttatcagataaaggacatttatctaatgaagatggttcagaaaccatgattcgcactataggtaaccgtactaaacacatctatttaggacacttgagtaaggaaaataatattaaggaacttgctcacatgactatggaaaacaatttaatgagagctgactttggtgtgggcacagatttttctgttcacgatacttcacctgattcagctaccccactgacgaggatttaagattgaaaaagattttttacattagtttaggatttattagtttagggataggcattgcaggtattgtcttgccggtagttccaacgactccattagtattgctttcagctttttgcttttcgagaagctctgaaaaatttgatatttggttgcgtcaaactaaagtttataaatactacgctgcagattttgttgaaagcagaagtattgccccagcgcgtaaaaagtcaatgatttggcaaatttatatcttgatgggaatttcaatctattttgctcctctaatgtggctcaaactgggattattgattggaactattgtaggaacttatgtgcttttttatgtagtacctgataaaattgatgaatagttaacaagagactaggtgtgtatcctagtcttttgttgaatattcaaatatgtaattaaggaaacgttttctttggaagataggtttaacttccaaaatgtttgattatttgtcaactgtggtataatggtatttgtttaatattttatctatgattgaaatcaaggagaaaaaaatgaaagaattaagatcaaagctggaaaaagactatggtattgtttttgctaatcaagaattattagatacagcttttacccatacatcatacgcaaatgagcatcgcctcctaaacatttcacataatgaacgtttggaatttttaggagacgctgttctacaattacttatttcacagtatctttttacaaagtaccctcaaaaggcagaaggtgatttatcaaaattacgttcaatgattgttcgtgaggaaagtcttgcaggtttttcacgtctatgtggctttgatcactatattaaacttggaaaaggagaagaaaaatctggtggacgtaatcgtgacactattttaggagatttatttgaggcttttttaggagctttattattagacaaaggtgttgaagtggttcatgcctttgttaacaaggtaatgatccctcacgttgaaaaagggacctatgagcgtgttaaagattacaagacaagcttgcaagaattacttcaatctcatggggatgtaaaaatagattatcaagttactaatgaaagtggtccagcacatgcaaaggaatttgaggtgactgtatctgtcaaccaagaaaatttgagccaaggaattggacgatcaaagaaagctgctgaacaagacgctgccaaaaatgctttagcaacgttacaatgaggaaatcatgtttttaaaagaaattgaaatgcaaggctttaagtcctttgcggataaaactaaggtagaatttgatcaaggagttactgctgttgtaggtccaaatggatcaggtaaaagtaatatcacagagagtttacgttgggcattgggagaatcaagcgcaaaaagtttacgaggaggtaagatgccagacgttatatttgctggtacagaaaatcgtaagccccttaattatgcgcaagtgagtgttactttagataatagcgaccattttatcgaaaatatagctgacgaagttcgagttgaacgtcgtatttttcgaaacggagatagtgaatatttaatagatggacgcaaagttcgcttacgtgatattcatgatttatttatggatactggattaggaagagattctttttctattatttcccaaggacgcgttgaagctatttttaatagtaaaccagaagagcgccgtgccatatttgaagaagccgctggtgttctgaaatacaaaacacgtaagaaagaaacacaatccaaattagaacaaactcaagggaacttagatcgcttagaggatattatttatgaattggacatgcaagtccaaccattagaaaaacaagcaagtattgccaagcgttttttagtattagatgaggaacgacaaggactccacttatctattttgattgaagatattttacaacatcaatcagatttaactactgttgaggaaaagctattgacagtaagaaaagagttagcaacttattaccaacaacgtcagtcccttgaagatgaaaatcaatcgttaaaacagaaacgtcaccatttatctgaagaaattgaggctaaacagttagctcttttagacgttacaaagttaaagtcagatttggaacgccaaattgatctgattcgtttagagtcaaaccaaaaggctgaaaaaaaagaagaggcaggtcaacgcttagcagagttagaaattaaagctaaagattgtagtgaccagattacccaaaaaaatatagagttaactactctgtcggaaaaaatagcccaaataagatcagaaattgttagtacagaaagttccttggagcgtttttcaactaatccggatcagattattgaaaaacttcgagaagactttgttaccttgatgcaagaagaagccgacacttcaaacgctttaacagctttactagctgatatagagaatcaaaaacaagcttctcaagctaaatctcaagaaatacaagaagttagcaaaaatttagaagtattaaaaagtaacgcaaaggtagcattggaacgatttgaggctgcaaagaagaatgttcgtcagttattatctcactaccaagatttaggtcaaaccttgcaaaatctagaaggtgagtataagaatcagcagtcaattttatttgatcatttagatgaaatcaaatcaaagcaagcacgtatttcgagtttagaatctattttgaaaaatcatagtaatttctatgctggagtgaagtcagttctacaggctaaggaccagcttggaggtatcataggtgctgttagtgagcatcttagctttgacaaacattaccaaacagcattggagatagctttgggaggtagcagccaacacatcattgttgaagacgagagtgctgccaaacgttcaattgcttttttaaagaaaaaccgccaaggtagagcgacatttctgcctttaactacaataaaaccaagagaattagcacaacattatctctcaaaattacaaagttctcaagggtttttaggaatagctagtgaattggtaacctatgatcaacgcttgtcaaacatttttaaaaataacttagggttaactgctatttttgatacggttgataatgctaatgtagctgcgagacaattgaattatcaagtacgtttagtaaccttagatggaacagagttacgccctggagggtcgtactcagggggagcaaatcgtcaaaataatactgtttttatcaagcctgaattggataatctaaaaaaagaattgaaacaggcacaaagtaaacaattaattcaagaaaaagaagttgccacattgttagagcaactcaaagagaaacaagaaaccttagcacaacttaagaatgatggagaacaagctcgtcttgaggaacaaagagctgatatagagtatcaacaactatcagaaaagcttgctgatttaaataaactatataatggcttgcaattaagcagcggggcgttggaacaaactacttctgaaaatgaaaaaaatcgtttagaaaaagaacttgaacaatttgctattaaaaaagaagagttgacaacttcaattgctcaaattaaggaagataaagattcaattcaagaaaaagtcaataatctaacaacattattgtcagaggcacagctagaagaacgtgatttgctaaacgagcagaaatttgaacgtgccaactgtacacgtctagagattaccttgtctgaaataaaacgtgacattagtaatttacaaacattactaagccatcaggacagtcaattagacaaagaagagcttccacgtatagaaaaacagttgctacaagtaaataatagaagagaaaatgacgaagaaaagcttgtgagtctccgttttgaattggaggattgtgaagctgctttagatgatttagctgcttctctggctaaagagggacaaaaaaatgaaagtcttattcgtcagcaagctcaattagagtcacaatgtgaacaattatctcaacaattgatgatattctcacgtcaattatcagaagactatcagatgacattggatgaagcgaaggtaaaagcaaatgtcttggaagatattttgatggcgcgtgaacaattgaaatctctacaagctaaaattaaagctttaggacctgttaatattgatgcaattgctcaatttgaagaagttcatgaacgattgaccttccttaacacacagcgagacgacttagttcatgccaaaaatttattactagagacgattacagatatggatgatgaagttaagactcgttttaaatcgacatttgaagccattcgtcatagtttcaaagaaacctttgtacagatgtttggtggaggttctgcggaccttattctgacagaaggtgatttattatcagctggggttgatatttcggttcaacctcctggtaaaaaaatccagtctttaaacttgatgtcaggtggtgaaaaagcattatcagcgttagcattattatttgccattatccgtgttaagacaattccatttgtcatcttggatgaagttgaggccgctttagatgaagcaaatgttaagcgatttggcgattatcttaatcgatttgataaatcaagtcaatttatcgttgttactcaccgaaaagggactatgtctgctgctgatagtatctatggggtaacgatgcaagaatcaggcgtttccaaaattgtttctgtaaaattaaaagaagctcaagaaatgaccaattagaaaacagaaggggatcccttctgttttttggattttcagccttattttatgttacaatagtaaatgtaaaccctttagttaggagattccatgataaaattagtagcaaccgatatggacggtacattcttagatgaaaacggtacctatgataaaaaacgtttagcaaatgtgctaaaaaaatttaaagaacaaggaattgtctttacggcagcaagtgggcgttccttattatcacttgaacaattatttgctgactttcgtgatcagatggcttttatagcagaaaacggaagtgcagcagtcttatttaatcgcttggcatatgaacagcacttgagtcgagaacaatacttagatattattgaccatttgagtaagagcccttatatggagaataatgaatatgtcttatctggcaaggatggtgcatatattctaagtgatgccaatccagattatattgaattcatcactcattattatgataatttgcaaaaagtttctcactttgaagatgttgatgatattattttcaaagtaacggctaactttactgaagagactgttagacaagctgaggagtgggtaaatcaagctataccgtatgccacagcagtgacaacaggttttaaatccattgatattattctaagctcagttaataaacgaaatggtttagagcacctctgtgaacaatacggtattagagcagaagaagtcttatcttttggtgacaatattaatgatttagaaatgctagagtggtcaggaaaagctatcgcaacagaaaatgctagaccagaagttaaagagatagcagattgtattataggtcatcacaataatcaagctgtaatggcttatttagaaagtatggtggattaatgtcggatattaaaatacttgccttagatttagatggcactttatttacaacagataagaaagtttcagaagaaaataaagtggccttaaaagcagctagagaaaaaggtataaaagttgttattacaacagggcgtcctttaaaagcaattggtaatttgttagaggacctagagttagtatctgatgaagattacagcattacttttaacggtggtttagttcaacaaaatacagggaaaatcttagctaaaactgcaatgacacgacaagaagtggaagatatccatgaggagttgtatcaagtgggtttgccaacagatatcttaagtgagggaacggtatatagtatcgctaacaagggacaccattctcaatatcatttagccaacccgctcttagaatttatagaagttgatgatttagagcaagtgccaaaggatgtagtttataataaaattgttagtgttattgatgctacatatcttgatcaacaaattgctaaacttcctgatagacttaaagttgactatgaaatgtttaaatcacgtgatatcattttagaattgatgcctaaaggtgttcataaagcagtcggcttagaactactgacaaaacaccttgggttagatagtagtcaagttatggcaatgggagatgaagcaaatgatttatcaatgctagagtgggcaggcttaggagttgcaatggctaatggtattccagaagctaaggcaatagcaaaagcgacaactatttgtaataacgatgagtctggagtcgccgaagcaattgggaaatatattttaagtgaggaaaattaatgggattatttgaccgcctatttggacataagaaaaaagataaagaaccagaaattgaagcatcagaatctgttgttttagaagatgaagattcagttattgataaagaggagggcagcaacttttcgaaggagtcaactttgaatcgaacctctgaagtccctgttgcagaagatgattctttcttagaattagaaagagatacagcattgtcagaatcacatcaaccagttacctctgaaattcatcctttagagtcagaagataccgatgaaattcctgtaaaagaagacgatagttttttagaactagaagatagggctaagacaaaggtagcagatacttctgaggtagaaaatgtagttcctgattccacgactctttctgacaatgtttctgctaaatctgaggcatcttttagtgataaggagcaattaagtgatagtcaggcttcagatcagttttcagaaactccccttcaagaagagatgtctagtggaaaaactgaggtacaaacagagtcagaggatacatctgcggctgatgcttttttagcagattactatgctaaacgtaaagcaattgagaaagaaatctcgtctaattcgctgtcaacagatgagtcagaattttctgaggcacaggaagttttatcgcaatcacaggcagacactataaaagctgagagtcaagaggaaaaatataatcgtagcctgaaaaaaacacgcacaggttttagtgcacgccttaatgctttcctttctaacttccgtcgtgttgacgaagagttctttgaagaattagaagaaatgttaatcttatctgacgttggggtaaatgttgcaacacagttaaccgaagatcttcgttatgaagcaaaattagagaatgccaagaaatcagaggatttaaaacgtgttatcgttgaaaaattagttgaaatctacgaaaaagatggtatttataatgaggctatcaatttccaagaaggtttaaccgtaatgctttttgtaggtgttaatggtgttggaaaaacgacatctataggtaagttagctcatcaatacaagtctcaagggaaaaaagttatgttagtagcagctgatactttccgtgcaggtgctgtggctcaactagtagaatggggacgccgtgttgatgtaccagttgtcactggagaagaaaaagcagatccggctagcgttgtctttgatggcatggaaaaagccgttgctcaaggcgttgatgtcttgttaattgatacagcaggacgtctgcaaaataaagaaaaccttatggcagagttggaaaaaattggacgtattattaagcgtgtcgtacctgatgctccccacgaaactttgcttgctttagatgcatctacaggacaaaatgctttaagtcaagctaaagagttctcgaaaattacaccattaactggccttattctgactaaaattgatggtactgctaagggtggtgtggtactggctattcgtcaagaactagatattcctgttaaattcattggtttcggcgaaaaaatcgatgatattggtgaatttaattcagaagatttcatgcgtggccttctggaaggaattttataagaaaaaagaactttcatttagaaagttctttttatattaaaagacacgataaacataaggattattagctttagaaacttgacgagactcttcaatgtgtaagactggtaagttttgttgtaacaattgattatactcggatttaattgtacctctaacagttacccaagtattgtccggataacttttttgatttccagtcgttagtagaccataaactcctgaatcggcaatacaatgaatgattccaaagcggaaaataaattgatatccttcgtgtttgggttcgttataaacaaacccagtatattgtatttggcgatccatgaattgctcgggatagagataaattagttccataacttccatgtaattttcagttgtgatggttaatgtaccagagcctttatattttttaagctctttttgcatttctttttcataggctgaagaagtaaaataagtgctggtatctggtttcaaatattgaacgcgtgtcccatcttgacttacagtaccagtagagccggctgctagagggaaattatatcccttggcagagactgtggttgagtctaaactaactgtaggtactaacaaacctactaaaacgggaaatactaaaatcattgggcttgttgatttagctattttaccatgtaggtgactatgcattttcatatttttaacccaaataattagctgtacaattgctaaaataaaagataggaccattgaaatataggccaaataggtataatgagtattaatatactgatttagtttacctgataactttaaatacatgcttaattcaaaataaccagcaagaataagaaatcgaatcattatattacccccacaaataaacaatagataataataataagagaagatacactaatgaattggacaataaaccttgttttaaaagaatttaccatcatcattaaattcttaatatcaatcatgggtccaattaaaaggaaagccatcactggcgcgattccaaaggttgataataaagaagcacctataaaagcgtcagcttcactacacaatgacaagatgaaagcaagcaacatcataactaagatggctgtgatagggctatgtccgatagtagtaagaactcgagttggtaaataaatttgcatagctgaagcaattaaagtaccaaatactagatagcgtcctgtatcaaaaaattcatcgatggcatgagctaaggctagaaagattttttgataccacttcttatcagaataatcatgaaaatgagtaggtttagcgtcttcttttagaatattatcatctactaaaaaggcaagcatgactcctaaagcaatggctacaatggtagcacctacaaagcgtaatatcaggaagcgtatggaatttccaaatgctgagtaggtcgcaaataaaacaataggattaataataggggcagtagcaagaaacggaactgccgtgtatgaaggcactttcttttcaaggaatcgattaataataggaatgataccacattcgcaagaaggaaagacaaagccaacgaaggttccaaataagactctgagaaatttatttttcggtaagaacttattgactatatcaggtgttataaagacttcaataattcctgataaaatagttccaagcaaaacaaaaggaagtgcctcaataataatggaaatgaaaatggcaaaccattgaaggacactatccggtaattgattaaagatatccatagaacttaatctttctgagaatcatctttctgttcaggttttgaatcagaatcaacttttttaggttttggtactttagcaaaactagcgaacatactttctaagtcatcttgacgtttgtgcgtaatagccattaatggcacctctttctttatataataacctattatactatattagcttatttttaacataaaaaaacaaatcgattggaaatgatactatatagtgataaaatgttattagtagattgatgaggtaagattatgattgaattaggtattacaacattcggagagacaacaatccttgaagaaacaaaccaaagctattcacatcctgagaggattcgccaattagttgctgagattgaactagctgatcaagttggtttagatgtatatggtattggagagcaccatcgtgaagattttgcggtctctgcacccgaaattgtcctagcagcaggagcggttagaactaataatatccgtttatctagtgcagtaacgattctctcttccaatgatcctattcgcgtctaccagcaattttcaacgattgacgcactttcaaatggtagagcagaaattatggcagggcgtggttcctttattgagtcttttccattgtttggatacgatttagcggattatgatgatttatttaatgaaaaaatggatatgttgttagcaattaactcagcgacaaatctcgattggaaaggtcatttgacacaaacagttaatgagcgaccaatttatccaagagcattacagagacagttaccaatatgggtggcaacaggaggaaatgttgattctacaattcgtattgcagaacaaggtttgccaattgtttatgcaactattggtgggaatcccaaagcatttcgtcaattggtccatatttataaagaagttggtagtcgtaatggacacaaaccagaacaactaaaagttgctgctcactcttggggatggattgaagaggataatcaaaccgctattgaccgttattttttccctacgaaacagaccgtcgataatattgctaagggacgccctcattggtctgaaatgaccaaagagcagtatttacgttcagtaggtccagaaggtgctatttttgtaggaagtcctgaagtggttgcacataaaattataggacttgttgaagcacttgagttagaccgttttatgttacatctaccagttggctctatgcctcacaaagacgtcctaaatgctatcaaactttatggtaaggaagtagcaccaattgttcgaaaatattttgaaaagaattaaagcagatctggtctgtttttttattgttagattataaaaacgctatcttgaaatcgctttttaaaactcttcgtaagtcaaaaatatgctataataaaagcgttatggaaaatttaaatattacacaaattgctattgatttaggtattaaagcgtcacaaatcgaaaaggttttagaattaacagatgaaggaaatactattccttttattgcccgttatcgtaaagaaatgacaggtaatttggatgaagttcaaatcaaatcaattattgaccttgataagagtatgacagctctttcagatcgtaaaactacggtcttagccaaaattgaagaacaaggaaagttgactcaagaactcaaaaaggctattgaagaagcaactaaactagcagatgttgaggaactctacctaccttataaagaaaaacgtcgtacgaaagctacgattgcacgtgaagcaggtctttttcctttagcacgtcttattttacaaaataaggataaccttgaggaagaagctcaaaactatcttacagatggttttgagacaactacgaaggcactttctggagcagtagatattcttatcgaagctttttctgaggataataaattacgttcatggacatataatgagatctggaactacagctcaatcactgcagttgttaaagatgagtcacttgatgaaaaacaggtcttcaaaatctactatgacttttctgaaaaaataagtaaactccatggctatcaagttttagcattgaatcgtggtgagaaaatgggtgttcttaaggttaattttgagcataaccttgaaaaaatgtttcgcttttttgctgttcgatttaaagaaactagccaatatatagatgaccttattgtacagactgtcaagaaaaaaatcgttccagctatggaacgccgtatccgtacagaactaagtgaaggagcagaagatggtgcaatttcactgttttcagagaatcttcgtaacttattgttagtctcaccgcttaaggggaaaatggtgttaggttttgaccctgcctttcgtacaggagcaaaattagcagtagtagaccaaactggaaaattaatgacaacacaagtgatttatccagttcctccagctaatcaagcaaaaatcgaacaatcaaaaatagagttagcaaaacttatcaaagaattcaatatagaaattattgctatagggaatggaacagcgagtcgtgaatcagaagcatttgttgcagaagttttacaagattttccagacgtatcctatgtgattgttaacgaaagtggtgcctctgtttattcagcctcagaattggcacgtcatgaatttccagacttaacggttgaaaaacgttcggccatctcaattgcaagacgtctgcaagacccattagcagaactagtcaaaattgatccaaaatctattggtgtgggtcaatatcaacatgatgttagccaaaaaaaattagcagaaaatcttgattttgttgttgaaactgtagttaaccaagtaggtgttaatgttaatacagcaagtccagccttgttagctcatgtttcaggtttaaataaaacaatatctgaaaatattgttaaatatcgtgaagagaatgggcaaattaagtcacgtgctgaaattaagaaagtgcccagattaggagcaaaagcttttgagcaagctgctggattcttacgtattcctaatgctaaaaatttcttggataatacaggtgttcaccctgagtcttatgaagctgttaaaaagttgcttgaccaactgactatcaaagaattagatgatcttgctaaagagaagttacaaaaccttgacttaattgcaacagcagaaagtattggggtaggtcaagaaacattaaaagacattatagaagatcttttgaaaccaggtcgtgatttgcgtgatgattttgaagcgcctgttttgagacatgatgttttagatgtcagtgatttaaaagttggacaggaattgcaaggaactgttcgaaacgtcgttgattttggtgcttttgttgatattggtgttcatgaagatggtctaatccaccagtctcgccttattaagcgaaaacgcgataaaaaaactagaaaaatgcctcctttacaacatccaagcaaatatctctctgttggtgatattgtaactgtttgggttgtagaggtagatgcggagcgtagcagaattggacttagtcttatcaagccagacggacttgactaattatgttaagaaggtgtctatagaagattttggatgtcagtttttacatactgcacattggaataatcgcttaagaacaactggaggacgcttctttccaaacgatagacaccttgactttaatcccaaaatttatcgtgagtttggtattgatatttttcgtaagattgtaagacatgagctttgccattatcatctctatatacaaggtaaaggatatcaacatagggataaagcttttaaagagttactagaaaaagtcgatggcttacgatatacccctagagttacggctgttaaagtgaattatcatcattactcttgccaatcttgcggtcaagtataccgacgtaggagacgtgttaatttacgcaagtttgcttgtggttattgtcatggtcgcttgatagagagtttttaaaatcagtcgtaaggcctatttaattttactgtcaaagtagttataattaaaatatagagtagatagaaagaaggataggtatgaaatcaagcttctacaaacaacgaaaaggtaagttggtctgcggtgttgtcgccggtctagctgataagtataactgggatttagctctttcacgggtgttgattgcactgattttgtattttaccaaatttggtcttttgctatatattttattagctgttttcttaccctataaagaagatattattgaaacaagaagacaaggtcccagaagacgtaaagatgctgaacctgttgatgatgacggttggttctggtaattcatataaaggagatttgctagatgaatctccttttttcttagctttatttagaccactttttcaaaatatcttctttttttcagaaaaacgcgttagcgcttacttttagtaaaaagtatgatataatgtgggtgtaaattaatgaaagtgtttagtacctttgctcaactttaaattgtagggtatagcaatagggatattcacttttataagaaggagtaagtatggcagttactgttcaaatgttagttgaccgcttaaagttaaatgtcatctatggtgatgaacatctattatctaagcggattacaacagctgacatttcacgtcctggtctagaaatgacagggtattttgattattatgcaccagagcgtttgcaacttgttggtatgaaagagtggtcatatttaatggctatgacaggacataatcgttatcaagtgttacgtgaaatgttccaaaaagaaacaccagctattgttgtagcacgtgatttagaaattccagaagagatgtatgaggcggctaaagataccggtattgctattcttcaaagtaaggcccctacaagtcgtttatcaggtgaagtttcttggtatttagattcttgcttagctgagaggacaagtgttcatggtgtcttgatggatatctatggtatgggtgttctgattcaaggtgattccggtattggtaagagtgagacaggactagagctagttaagcgaggacatcgtttggtagcagatgatcgtgttgatgtttatgctaaagacgaagagacgctttggggagagcctgctgagatattacgtcatttacttgaaattagaggtgtgggaatcattgatattatgagcctatatggagctagtgcggttaaagattcatcgcaagtgcaattagctatataccttgaaaactttgaaactggaaaagtttttgatagactcgggaatggcaatgaagagatcgaattatctggagttaaggttcctcggatacgtattcctgttaaaacaggccgaaacgtgtcagtagttattgaagcagcggctatgaatcacagagctaaacaaatggggtttgatgctacccagacttttgaggatcgtttaacacatttgattagtcagaacgaggtcaatgatgattaatccagtagcaatacgattaggccccttttctattcgctggtatgctatttgcatagtgtctggtatgttgttagcagtttacttagcaatgaaagaggcccctcgtaagaacattaagtcggatgatattctagatttcattctcatggcttttccactatccattgttggagctcgtatttattatgttatcttcgaatgggcttattactctaagcacccagtagagattatcgccatctggaatggcggtattgctatttacggagggttaattaccggggccattctccttgtgattttttcatatcgtcgcttgattaatcccattgattttctggatattgctgctccaggagtgatgattgcccaagccataggtaggtgggggaattttattaatcaagaagcatacggtagggcagtaaaaaatctgaattacgtaccaaactttataaaaaatcaaatgtatattgatggagcttaccgagtacctacatttttatatgagtctctttggaacttcctaggttttgtcatcatcatgtctattcgtcatcgaccgcgcactttaaaacaaggtgaagtggcatgtttttatttagtttggtatggatgtggacggttcattattgaagggatgaggacagatagcctttatttggcgggtttgcgcgtgtcacaatggttatcagttattttagttattatcggaattgtcatgattatttatcgtcgtcgtgaacaacatatttcatattattaaacagaggaggtattatgatagaaattgctgtattaattattgccattgcgtttgttgttttagttttaggaatacttttcgttctgaaaaaagtatcagaaacgattgaggaaaccaagcaaactattaaagtattaacaagcgatgttaacgtgactctttaccaaactaatgaaattttagccaaagctaatgttttagttgatgatgttaatggtaaagtatctactattgatcctctttttgtagctattgctgacttatcagaatctgtatctgatttaaacctacaggcaagacatattggacaaaaggcaagtagtgcaacctcaagtgttactaaggcaggttcagctttagctattggaaaagcggcttcaaaaatttttcgtaaaaaaggagacaaaaaatgagtaaattatttaaaactttagttatcagtgctgcatcaggtgcagcagcagcttattttttaacaacaaaaaaaggaaaagagctaaggaaaaatgcagaaaaattctatggagaatataaagaaaatccagaagaatatcatcaaatagctaaagataaagcaagtgaatattcaaatttagctgttgatacttttaaagattataaaggtaaatttgaatcaggtgaattgacaacagaggatatcgtctcagccgttaaggaaaaaagcggagaagtagttgactttgctaatgattttgtcaatcaagctaaatcaaaattctcagacgaggatactgctaaaaaagaagataaggctcctgaaacaaaagtagaagatattgtcattgattataaagaaaacacagaagataaagaaaaataaaaaagaagctactataagtagcttcttttttatgagatttttattgtctgagtgaccaaatgaatgaagagactgcagatgtaactgctagacttgccagcatcgctagtaagaaactccagacaggtgttaaacttagtgctagtaataagaaagagattagcacagtggttatactgaagagagcgatacgagcaaaaaagactagctcacgcaacttagcactgtgatcaaattcttgaaatacttgaaattttggttgagcttgctctgttttgctttcgtgagtttgctcttgcttaagtggtgatgacatagctttctcctttgatactagcatatcatatcacaaataatagagtttgtcactagttttttgatactatgagttaaaataaaggttttttctcaaaaaaacaaaaacattgcccatattagtagtagaatactaaaagtattttttactactttccttacttttttaaattggaaaagaaaaaatagatataattttatataatattacaatactatattttttcttatctgatagtgcttaacctctaaagtgatataattttcgaaaagaatatttttatttattcttgtcaagaaatatgcttaaaaatgctgaaagtttgttataatactaattatggaaaaaataattttgacagcgacagctgaatctattgaacaagtaaagcaattgctagcaataggaattgaccgcatctatgtaggggaagaaaattacggtcttcgtttaccacattcattttcagacgatgaattgcgtgaaatcgctaaattagtacatgatgctggtaaagaattgacagtagcttgtaatgcactcatgcatcaagagatgatggataatatcaaaccatttttggagttgatgaaagaaattaatgtggattatttggtagttggtgatgcaggagtattttatatcaacaagcgtgatggttataacttcaaacttatctacgacacttctgtcttcgttacatcaagtcgtcaagttaatttttggggacaacatggagcagtagaaacggttttagcacgtgaaataccttctgaagaactttttaagatgtctgagaatcttgaatttcctgctgagattttagtttatggggcttctgtaattcatcactctaagcgtccgttattgcaaaactattataattttactcatatcactgatgaaaaaacacgtgagcgtggtctttttttagcagaaccaggtgatccagaaagtcactattctatttacgaagataagcatgggactcatatttttattaacaatgatatcaatatgatgactaaagtgactgaactagttgaacatcactttactcactggaaattagatggtatttattgtccaggagataattttgttgctattgctgaaatttttgtcgaaacagctcgtttgattgaaaatggaacattcactcaggatcaggctttcttgtttgatgaacgaattagaaaactgcaccctaaaggacgtggtttagatactggattttatgattttgacccatcaacagtaaaataagatttatttgctacgtgaaagttttctatttcaaagcgtagccaattacactaagaactgcatatcgattggtatgttaattaagatagaaaataattcttttatcttgaaaatagaaggaaatataagatgtctaatgtaaaaaaacgccctgaggttttatcacctgcaggaacactagaaaaattaaaagttgctattgattatggagcagatgctgtatttgttggaggtcaagcgtatggtcttcgaagtagagctggtaacttttctatggaagagttacaagagggaataaactatgctcatgcaagagatgctaaagtttatgtagcggctaatatggttactcatgaaggtaatgagcttggggcaggtccgtggtttcgtgaattacgtgatatgggactagatgcagtcattgtttcagatcctgctcttattgttatttgtgctacagaagcaccaggcttagaaattcatttgtcaactcaagcctcttccacgaactatgaaacttttgaattttggaaagagatggggcttactcgtgtcgtattagcacgtgaggttactatggcagagttggctgaaatcaggaagaggacagatgttgagatagaagcatttgttcatggcgcgatgtgtatttcatactcaggacgatgtgttctatcaaaccatatgagccatcgtgatgctaatcgtggcggttgctctcagtcatgtcgttggaaatatgacctctacgatatgccatttggacaagaacgtcaatcgttaaaaggcgagattccagaacctttctcaatgtcagctgtggatatgtgtatgattgagcatattccagatatgattgaaaatggtgtagatagtttaaaaatagaaggacgtatgaaatccattcattatgtttctacagtaactaattgctataaagctgctgtagatgcctatatggaaagtccagaagcttttgaagctattaaagaagacttgattgatgaactttggaaggttgcacaacgcgaattagcaacaggtttctactaccatacaccaactgaaaatgaacaactctttggagctcgtcgtaaaattcctcaatacaaatttgttggggaagtggtttcatttgacaatgctaaaatggaggctacaattcgtcagcgtaatgttattatggaaggagatcgcgtagaattctatggtcctggcttccgtcactttgaatgttttattgatggtctgcgtgatgctgaaggaaataaaatagaccgtgctccaaatccgatggaattattaaccataacattaccaaatccagtaaaaaaaggggatatgattcgtgcttgtaaagaaggattagtgaacctttatcaaaatgatggtactagcaagactgtaagagcttagatacttttataactattttgtcattttacatggtcaatattactaaaaattgttaaaatagaagaagttcatttaaatagaacaaaaagctataaaaataacgaatagtataagtggaggtataaaatgtcagaatttacatttgaaattgttgagaagttattggtcctatctgaaaatgaaaaaggttggacaaaagagttgaatcgtgtgagcttcaacggagcgccagctaaatttgatttgcgtacatggagtccagatcatacaaaaatgggtaaaggtatcactttatctaatgaagaatttaaagtcattttagatgcttttcgtaaataaataaaaagtggtttcaaaaaccactttttttgtcgagacaaacgagtattcagtaaacatattgattaaaaaaatagaatttttaaactaaaagaattataatggaggtaaaaggaggcctctatgattagacattcatttaaaagtaaggtgttattgttagtctttatcttaacaataatagtgaattatttatccgcaacaggttttttaacagggaacagtcagaagagtctgtctgatcgttatcaaacgctcttgacaccagcaccattagccttttcaatttggtcagtcatctatttattgacctttttagtaatattaagagctatattcagtaagagtcaatcttaccaagataactttgctagcatttttccatactttttgggtcttctattagttaataatatatggactgtattttttacgagtaatttgattggcctatcaacaataataatttttgcttactgtattcttctggttatcattatcaagatactaagtaaaaataaatcaaaattactgcttagaataacatttggaattcatgcaggatggttgctagttgcgtcattggtcaatttagcggtctacttagttaaaattgattttaattacccattaccaaaggtatatatagctatcattgccttgatttttataactgttttaagtctttacctagctagagtattacaaaatgcttacttaatcttatccgttttttgggcttggttgatggtttttaaagcacatttagaaggaaattttcaacacctatattttagtatccaaattttatctttgattgcagcaattatccttggcgtatcgtttttcatcatcggttattataatgtcaaggagaggtacaagcaaaaaaatactagcccttactcacgggttctttgaaagaaatacaaaaagctccatcattatgtactttcctctatcattagatgtatgtctcatgatagaggttcagttcattagtggggcttttttgtattgtattaaagtaaatccatgattaatttcaaattgagtaatgttaaaatgatggcgacaaggtatgctaaataggtattccatttagcattagcatgctctcccataattgatttttgcgacgtgaaataaatcaatggaaagattgaaaatggtaaagctaaggaaagaaaaacttgtgaatagacgattagttgatctaacgtattttcttcgcctccaactagtagggcgataacaaaaattggaagaagagttaataatctagtacaaagccttattaaccattgaggtaatttgaagtgaaggaaaccttccataacgatttgtcctgttaaagtacctgtaatcgttgaattttgaccacttgctagtagggcaactgcaaaaagggtagaaaggaaagaactggctactgcaccagtaatagttttatcagatagggcaagatacatttgagaaaaggcactgatatcattagcatgcccataaaatagactagctcctaagactaatagtagcgaattcacgacaaatgcaagtgatagctgaatgttagaatctaaggtcatgaaacgtacagctttttttattgaagatttattatgataatccacgcgtctagtctgagataaagaagaatgtaaataaagattatgtggcatgactgttgcgccgataatgccaagagcgagggttaaaggactatttttcccttcatgtgatatgttaaaaagctcatggtgtggtaaaaatcctttgaacatagcatctaaatcaggttgtgataaaacaactaaatatgtaaagattatcaaaattgtcaatatgagaacagaaacaaaggcttcaattttttggacgcctaacttcattaagagtaaaagtaagaatacatccaaaatagtaatcatgatagacagtaacaggggccagccaaataataagtgaagagcaatggcagagccaatgacttctgctaaatcagtagcgataagggctaactcaatgataataaatagcaggtaacgaagcggttttgggagtcgagaagctgttgcttgtgctaagtcctgtcgtgtaacaatgccaagcttgccagccatttgttgtaattgcatcgccatcaaagaagatactaaaacaacaaacaatagtaagtaacgataggtagctccaccaataacgctagtaatccagttacctggatccatataaccaactgcaaccaaagctccaggtccaagaaaagctcttaaagtgttccaaaaagagctattgtgaggaacctcaacgctctgattaacttcggataaggatcttttgacggaatgattttgattcatgtaatactatactttctagtaatctcaagccattataacaaatagaaaatagaaaaacaattaaaaattaacgctacttaataatcaattgaggtgctgtttagtatttagagaattattttcttaacagttacatttgaaataacaaaataacagatttctatcgattatttttagttccgtagatttacctaagttatttaagtggagtaaactatatctgtagtgaattttttaagaaatataatccaataatactagcgattcttgtttgattagttcgaaagattgctttatggtatagatatactgtcttgtagagataagaatagatgagctacttaattattattttataataaaaaacacattatttttattgacaaataaaaatgagtttagtaaaataactgtcaaatagaatttcttcggggtcaggtgaaaatcctaaccggcggtatagtccgcgagctttcgagcatgaactggtgtgattccagtaccgacagtaaagtctggatgagagaagaattcagtgattgtctgctacttgcagtttatttgtgctggattaatgagagactccctatagttttctatagggagtctttagtttttttgtgctacctaaaatataatgctaattagtataatcaacgacttctcatccctccccttagttttctattttagaagctaagggtttttattttagaaggaaaaaggaaatgatgaaaaaagaagactacatggcattagccttgaaagaggctgagaaaggtatggggttcgttgctcccaacccattagtaggtgctgttattgttaaagatgatcgtataatttccaaaggttatcataaacgatttggagatttacatgcggaaagacaggctattaaaaatgctgatgaggatatctctggaagtactctgtacgtgactttagaaccatgctgtcatgttggtaagcaaccaccttgtactgaagctcttattaaatctggtatcaaaaaagtagtagttggaagtttagatccaaatcctttagtttcaggaaaagggattgccttgttgagaaaagaaggtttaaatgttgaagttggtatcttaagagaagaatgcgatgctctgaatgaaagatttatttttcacatgacctataagcagccttttgtttatttgaaatatgctatgactttagatgggaagatagctacaaagacgggcgattctaagtggatatcaaatgagcactcaagacaatctgttcagaaattgaggcaaaaatgtagtgctattatggtcggtatcaatactgtattagctgataatccacgtttaacttgccgtattcctaaaggtgaagcgcttgtgaggatcgtatgtgatagtcagttgaagatacctttagactcttacctagttaagagcgctaaaacaataccaacatggattgcaacatgttcagataatcttgctcagcaacaaacattaaaagaaatgggttgccgtttgattaaggtcccaagaaaagatggaaagctggatttgaaagtattaatgactattttaggacaagaagggattgatagccttcttattgaaggaggaagtagtttacatttttcagctttaaaagctggtattgttaacagactaattgtttttattgcacccaaaataataggaggtctgaaagcaaaaacagctatttctggagaaggtttggattggcttaaccaagctttcagagtaaaagatattgaacttagtcgtatggattctgacgttgttattgaaggaaaggtagaacattatgtttacaggaattattgaggaaatgggtcaagtcagtcgtattcggaatggcataaagtcccaacaattaagtattgatgctcccaaactagtccctttattaagaaaaggggatagcgtagctgttaatggtgtttgtttgacggttcttgacaaaagtgaaacagcttttatagcagacgtcatgccagaaagtatgatgcgaacaagcttagctgctttacgacttcattctaaagttaacttagaattagcactcagaagtgactcaaggttaggggggcattttgttcttggacatgtggatggggttggaaaaatagaaaaaatccaaaaagatgatattgctgtcagattttcaattgatgctccacctagtattatgtcttatattatagagaaaggttcggtggctctagatgggattagcttaacagtggtatcatttacagagcattcttttgaagtttcggtcattccccacacgatggctcaaactaatctatccttaaaaaaggttggggatttattaaatatcgaagtggatgttttaggcaaatatgctgagaaatttttagcacccactaatagaactaatcacacttcatcggtaatggattggtcttttttatcagaaaatggctactaagagagaggagaaagctaatggcctttagtccaataaaaaaacttttacaagacatcaaatcagggaaaatggtagtgttgatggatgacgaaaatagagagaatgaaggagaccttatttgtgcggctgaaatggtgacaaaagagtcgattaattttatggctaaatttgggaaaggattaatttgcttacctctgtctaattactatgctgaaaagttagaattagctcaaatggctagccataatactgataatcatgaaacagcttttaccatatctattgatcatctatcaactagtactgggatttctgcggaagatagagctttgacagctaagatggttgctaacgacagtagcaaagctaaagactttagacgtcctgggcacttatttcccttgttagccaaggaaggaggtgttttagctagaaatggacatactgaagcaaccgttgatctatgtcgtttagctggattaaaggaatgtggactttgttgtgaaataatggctgaagatggtagtatgatgagaaaggatgagttattagcatttgctcaaaagcacgatttagctatcgctaccataaaacaattgcaagactatagacgtcaagaagagggaggggtggttagagaaattgagattcagctaccaacgcaattcggtcattttacggcttatggatatagcgaagttgtggcaaataaggaacatgttgcccttgttaaaggggatattagtagtggtgaagatgttttatgtcgtttacactcagaatgtttgacaggtgatgtctttcattccttgagatgtgattgtggggaacaactggctaatgccctccaacaaatagaggctgaaggtcgtggagtccttctttatatgagacaggaaggtcgaggaattggtttgattaataagttaaaagcttatcatttgcaagaagaaggcttagatactttagaagctaatttggctttaggttttgaaggagatgagagagactatggagttagtgctcaacttttaaaagatttaggtataaattctataaacttactaaccaataatccagataaaatccaacaacttgaagcagaaggaatttgcgtcaaaaacagagtgccattacaggtggcagtaacagcttatgaccttaattatttaaaaactaaaaaagaaaaaatgggacatcttttagattaaaggaggaagaaaaaatgacaattattgaaggacaattagtggcaaacgaaatgaaaataggaatcgtagtctcacgtttcaatgaattgattacatctaaattattatcaggagcagtagatggactgctgagacatggtgtttcagaagaagatatagatattgtatgggtacctggtgcttttgaaatcccctatatggctagaaaaatggcattatataaagattatgatgctattatctgtcttggggtagtcattaaaggcagcactgatcattatgattatgtttgtaatgaggtgacaaaaggtattggtcatttaaatagccagtcagatatccctcatatctttggtgttctaacaacggataacatcgaacaagctattgagagggcaggaacaaaagcaggaaataaaggttatgattgtgctctttcggctattgaaatggtgaaccttgataaaaaattgcgtgagcgataaatcagaaacctaacaaagttcagtagaggtaatattaaaacccaccttaaataaggatgggttttaatatattcttatttcattgtagggaaaagtaggacgtctcggatagttgttgtatcagttaacagcatacagagacggtcgataccaatacctagtccaccagtaggtggcataccatattcaagtgcttcaacataatcgtaatcaactccagttgcttcatcatcgccaagttctttagcagatgcttgtgcttcaaagcgagatagctgatcaattgggtcatttaattctgtaaaagcattagcgtattctttagtcatgataaagagttcgaaacggtctgtaaaacgagggtctgtatcatttttcttagcaagtggagacacttcaactggatgaccaaagacaaaagttggttgaattaaagtgtcttcaacaaattcttcgaagaaggcattaatgatgtgaccaactgttgtgaaatgtttttcaagcggaacatttttttcttgtgccaaagcttgtgcttcttcaagagtcatttctttccagaagtcaataccagtgatttctttaaccgcatcaaccatatgaacacgtttgaatggttcattaattttaatttctgtgccttgataattaattggtccatcaccttttacagtttttgtaacatgctggataataccttctgtcaagtccataatatcctggtagtcagcataggcttggtaggcttcaatagatgtgaactctggattgtgggttgcatccatcccttcattacggaaaatacgtccgatttcataaacacgctccataccacctacaataagacgttttagatgcaattcagttgcgatacgaagaaccatgtcaatgtcttgtgcattgtgatgtgtgataaatgggcgagcagaagcaccaccagcttcattatgaagaacaggtgtttcaacctctaagaaaccattgctatccataaagcgacgaatttctgaaatgatttttgagcgtgttacaaaacggtcaaagctgtcacgatttgagattaaatcaagatgacgtttacgatagattgtttcaatatcagttaggccgtggaatttttcaggaagtggacggagtgcttttgaaaggtgagtaatatgagtagccttgatagaaagttctcccatatctgtacgcattacttgcccttcaacaccaaggaagtcacctaaatcagcttttttaaagatttcgtagttttcttcgccaacagaatctttacggacataaatttgaatttgaccttcgcgatcttggatatgcgcaaagccaactttccccttaccgcgcttagtcattaaacgaccagcgattgtagcagtttcttcaatgtcgtgcaagtcttcttttgatttgtcagcgtatttttcatttaattgaccagatgttgctgtacgttcaaatcgtttaccaaaaggatcaatgccttgttcagtcaaagcagccattttttcacgacgaacaatctgttggtcatttaattcttcaatatgttggttagacataatttcctccaagttagtattcatcctattgtaccacaaaaacactgataattcataatttattttatgagtttctggtgttattctcatttttaatagacttttcaccatttgaaaataagggtagaaaaaggtataattaacaattgaaaattcagaaagaaaaggataatcatgattacttcaattgtttttgatgttgatgatacgatttacgatcaacaagcaccttaccgtattgctgtggagaaatgctttcctgattttgatatgagcgctattaaccaagcttatattcgctttcgtcattattcagatattggctttccacgagtaatggctggtgaatggacaacagaatattttcgtttctggcgatgcaaagaaacgcttttagagtttggttatcgtgaaattgacgaagctactggtatttattttcaagaaatatacgaacatgaacttgaaaatattacaatgcttgatgagatgcgtatgacacttgactttttgaaatcaaaaaatgtaccaatgggaattattacaaatggtcctacggaacatcaattgaaaaaagttaaaaaattgggactttatgactatgttgatccaaaacgtgttatagttagtcaagcaactggttttcaaaagcctgaaaaggagatttttaatttagcagcagagcaatttgatatgaacccttcaactacactttatgtgggtgattcatatgataatgatattatgggtgcatttaatggtggttggcattctatgtggttcaaccatagaggacgttctttaaaaccgggaattaaaccagtttatgatgttgctattgataactttgagcaattattcggtgctgttaaagtgttgtttgacttacctgataataaatttatttttgatatcaacgataaaagtaatccagtccttgaaatgggacttaataatggtttaatgatggcagcagagcgtctgcttgagagtaatatgagcgttgacaaagttgttattttactgcgcctaactgcaaaacaagaaaaagtattacgcatgaagtatgctagataattaaataatccactagatgaatctagtggattattttagtgtgtcattttgacctcttgccttaaataagatttatcgttccaagtcagacagttgaagtctttaaaatcatgagtttctatgattgtgaggctggcattatcaagtttatctttgtagtgtaaactaccatattgataacccagtaaggaacgaatagacgcagttaggtttgctccatgtcctacaataaggaccttgtcgtaattttttgaagctagagaacgtaagaaactctctacacgatgcgttgtctgataaagagattctgcaccgaacatgtcatgtttaaattgtaagggattttgataaaatgcggtcatttgacgaggatagatagcttgcatagttgcaattttacaaccttctaaagttcccaatgcccattcacgaagttgaggagtatagtggatttcttttgggcatgaattagcatcattgaggatattaacagtatctctagcacgacctaagtcgctagaataaacagcatcaaaatgaatagatgataggtattgtccaagttcttctaattcttcaatagcttcttcaaggagaggtgagtctccgttagcaccttggaaacgcccctctaaattccattgtgtttttccgtgtctaacaagataaaatttcatatttttctccaatcctaattattattcctttatatcggcaaatttagcatttacgaaatctgcaagaacctcactattaatacgaatagaacgtccaatttctcctgcagagacaatgagttcttgtttttctaaagcgatagtatcgataaaaatagggtaattatgtttttggcgaattccaattggattatttgctccgtgaatataaccggttattttctggagatctttttgaggtatcatttgtacctttttgtttcctgaaattttagctaactttttttcggataaatgctcggtgagaggtaagatacctattatgggaccggttttatcaccgattagcgctaatgtcttaaagatatcttgtttttgaataccgttgggtaaatctccctgtaaagcatccaattgtagactatcatgttcgatttttgctttatctaaaatttgatcaactaaagtttttttgattttattctttttactcataatgacccttaactaataagtttgtttcatatttattataacatttaaagatgattatagtaaatttctactgactcttagaaataagcttgaataccatttcagggaataatgataataaatatcgcaacagtactatttggaatgttaaattagaagttttataaatagctaaatatgaagtgtcctgatgtaatgacttgaaatcataccgtggtcaggtattaaacgattactttgacaaggcatataaaaatttctatactaaatttacaaaatgaaggagagggaactatggaaatactgattgcaggtggtagtggttttttaggaaagcagataataaaagcagcgcttacaaaagggcataaagtggcttacttatcaagacatgaaggtaaaggtgatatatttaaggatcctagattaacctacattaggggagatattacagaagctgataagattcatttagaagacagaacttttgatatattaattgactgtattggagcgattaagcccaatcaactagatgagcttaacgttaaagcaacccaaaaagcagtagcactctgtcacaaaaatcaaataccaaagttagtttatatttcagccaacagcggctattcagcttacattaaaagtaaaaggaaggcagagcagataatcaaagcaagcggtctggattatctttttgtaagaccaggtttgatgtatggtgaagagcgacctctctcgattttccaagccaagtgtataaagttatttagtcatttgcctttcttaggtattgttgtacaaaaggtctttccaactaaggttgtgatagtggcagaagcaatcgttactacgcttaggaaaaaaccaacccaaaaaatcctttctattgaagaattaaataataaatagtttatcaaaaaagctactgttaacagtagcttttactcttttacttttccaaaaagtttctcataagttttcttcttgtctttattaactgcaatttgatttaaatcaagcggttgattgaatcctggtagataaccttgagaggtgtattggtgtaaatcgtatttaagttcagtttgcggagccgcttcatagtatccagaatcgctaccataagttggaatccaaacagcgtcaaatccttttacagagatgccttgctcagtcataaagtaagtaccaatgtagataccaacatttttagcaccaagtctttttaattcttttcggaatgcttggacacctttattcatgttagacattgtctcctcttctacgtcaatccaataaaaagttggtttgtaaggagctgcattcttataaaatatctgagcctcttctttcatttctttaacacttgaaccaagtgcataactgtagacagctactgggatatttcgcttttgaaattctttgatatgggtcttaaacgatttatcgattccagttgtataagcagcgttattagtcttagatatctttgatccaccaaagacacgaataacaacacctgaaatattttttgaaagcgtatcgtaatcaatctccttaggaagttgccaaccagagacatcgataatcggtttaagaacaaactctttatctttcgatgatgttgatttttgcggtacttttgaagcttttacggatggaattgtctttttagcttcaactaattcttttttcaaagtatttgtcgaatgtaaatgaccaataattaataaaagtccaaataaactgaaaaaaaccgcaacaacaataggtttaattcttcttctcattattgatattgtaacttaaaaggtttaaaaaatcaaagtttacaggcttatttacgttcttttaaaaaagaggtcgtttatgtaacattagaaatgaaattgtaataaaaaagacttttaagcggtagtcatagttttgaggtataattaaagacatgataaagaattcaactttaactaaattgactagagtcgctatattatctgctttgtgtgttgtgttgagatatgcttttgcgcctctgcctaacattcagccaattactgccatttttttgattacagttgtcttattcgatttaaaagaaggtgtagctactgtaactataacaatgctagtttcttcttttttaatgggctttgggccatgggtctttttgcaaatcatttccttcactttaattttatgcttgtggaaatttctgatatatccgctgacaaaagctgtatgttttggtaaaataacggaggtagtacttcaaactttctttgcaggagggttaggggttgtttatggcgtcattattgatacctgttttgcttggttatatcatatgccttggtggacttatgtattagcaggacttagttttaatatggcacacgctttatcaacttgtttattttatcctcttttgttaccgattttaaggagatttaggaatgaaaaaatacattaaattattcttgctaacagtattcgctacaactttagtagcttgcgggcaaccatctacatcgaataagacaacaactagctcaacgttagaagttggtaaggttgaattggtggttaaagaagatacgaacgtgttaagtgaaaaggttgtttaccataaaggtgatactgttttggatgtgcttaaagctaactataaagttaaagaaaaagatggtttcattacttcaattgatggcatcagccaagatgaaaccaaagggctttattggatgttcaaggtcaataataaattagctcctaaggcagcaaaccaaattaaagttaaaaagaatgacaaaattgaattttatcaggaagtttacaaaaaataagataaaaacaagttggagatatctccaacttgtttttatgtttttgaaaggctgtagtttagccttgctcaataagattactgtaattaataatttggtctacagtgttagataagaaattaatagtatcgcgcagaggcttatcagtagaaatatcagcactgattaatagagctgtttctaaaggggtacggctcccaccagatttcaagaatgctaaccactcttttgctccgtttggattatttttgagattgagatagccggctgtcgagattactaatccagcagagtaagtatagctatagagccccatgtagtaatgagcttgtctcatccatgtcaaagcggcatcgtcatctatttcaatagcatctccccagaattgtgttaatacttccttcataatagcatttaattgttctgctccaaaagttcctccctcctcaattagagtgtaaactttacgttggaaagcagcttcaagtaagtgagtaatgaaattgtggaagtaagtatcagttaagcgatgtgcaagagcaaagcgtttttgacgtgctgtatcaaattggttttctaagtagtcactaagtaaaagttcgttaaaagtagatggagcttcaacatagtaagtggacatgtgagtattgaaaaaactttggtgattatctgagaagataaattgaccagaatgtccaatctcatgaataagtgtgtagacatcgctcatacgccccgtccagctcatgagtacatagggatgaactttgtaaggatccgcagcatatcctccagaatctttattagcgttagctgcaaaatcaacccaacgctctttttgatagcgctcaacctcttgagaatattcttttcctaaaggagcaactgatttcattactaagtcataagcatcattgatacttacttcgggattaagttcgttatcaatgtctaatttccaatctgcaaaagtcatcttttcaataccattaacatcggcgatatgtttgaggaatcgttgagctactggaccaaattcatccatgataagatcaatttgtctgtcaaacattgaacggtcaacttcttgttcggaaagaagataatcaaaaacactatcgtaaccacgcatatcagcaattaacttttcagatttgacttttgcaagataagccgcagctgcagcattttggtgcttacgtagacctttcgagaatgaacggaaggatttttcacgtatctctgcattttcgtgattttgaaagtaattttcataagttacaaaactatttttgtaggtttttccgtcaacttcaaaatcttccatatcaaaatcgccagcacgcattttagtataaatatcatatggtgtatttaggacttcatttaagtttgtcaaagctttttcgacttctggacttaataagtgttgcttttgaattttagcttggcgaatagttgctttgaaatgagggttattttctaaagaatctaaaatctttatatctgcatttgctagggcagtattaaagaaagaaagtagtacattagctttagttgcgaagtctgatcctgcttgagaaatttgtgcaaactcttcgttgctaaagtcagtagtttgaggcataaaagcatacgtatcaatgtgactcatctggatataaatatgctcgatttccataagggcactagtaaaatcctcaacacaattaagttttccctcgtaattttttttgaaaaccttgatatcctcaagagctttttcaatagccagtaaaaaatcttgacgatctttgtagagagcagtcagatcccaaagttcattttcagggaattcagagcgttttttaagtttcatgcgatactcctttaataatagttgttaattaacaattaatcagttaatctcaattatcctcagtatatcaaaaaagtcgaacaagaaaaactgattactgtcataaataagtaaaaatctgaaaattctatctaaaaatcctagaatggtttactttttactttaaaatggtatcatagtagtgagatttaagagaggaagtgatggtttgtcccacccgaaattagaaagtagtagcaataaagaaatcattaccgaagaggtcggtttactgaagcagcttttggatgaagcaacgcaaaaattgattggtagtgaatcatttgacaagattgaaaaaatagtttcattatcattaactgacgattatactggtctgaaggaaactatttcggctttaagcaacgaggagatggttattgtttctcgttacttctctattttgccgctcttaattaatatttcagaagacgttgatttagcatatgaaattaattataaaaataatcttaaccaagattacctaggaaagttatcaacgactattgatgttgtagctggccatgaaaatgctaaagatattcttgaacacgtcaatgttgtgcctgtgctaacagctcatcctactcaggtgcagcgtaaaacggtgctcgaattaacgtctaagattcatgatttattacgtaaatacagagatgtcaaggcaggaatcgtgaatcaagaaaaatggtatgctgacttgcgtcgttacatcggcattatcatgcaaacagacactattcgcgagaaaaaattgaaagtcaaaaatgagataaccaatgtaatggaatattacaaccgttctcttattaaagcagttaccaaattaacagcagaatataaggcactggcagctaaaaaaggtattcacttggagaatcctaagcctctgactatggggatgtggattggtggtgatagagatggcaatccctttgtaactgctgagacactaagattatcagctatggtacaaagtgaagtgattattaaccattatattgagcagctaaatgaactttatcgtaatatgtcactttcaataaatctaactgaagtctctcccgaacttgttacattggcaaaccagtcacaagataattcggtatatagggaaaatgaaccttaccgtaaagctttcaattttatccaagataaactggtacaaaccctactaaatttaaaagttggttcttccccaaaagagaaatttgttagtcgccaagaatcttctgatattgtaggaaggtatataaaatcacatatcgctcaagtagcttctgacatacagacagaagaactaccagcatacgctactgctgaggagtttaaacaagatttgttacttgtgaagcaatctttagttcaatatggacaagattctcttgttgatggcgaattagcttgtcttattcaagcagtagatatctttggattttatttagctactattgatatgcgtcaagattctagtattaatgaagcttgtgtagcagaattattgaagtctgccaatattgtagatgattacagttctctttcagaagaagaaaaatgtcaacttctcttaaaagaattaacagaagatcctagaacattatcttctacgcatgctcctaaatccgagttacttcaaaaagaattggctattttccaaacagcacgtgagttaaaagatcaattgggtgaagacattataaaccagcatatcatttctcacacagagagcgtttcggatatgtttgagttagctatcatgttaaaagaagttggactaattgatgccaatcaagctcgtattcagattgtaccgttatttgaaaccatcgaagatttggataattcacgtgatattatgacccagtatctacattatgaattagttaaaaaatggattgctactaacaacaattatcaagaaataatgctaggttattcagatagtaataaagatggtggctatttatcatctggttggactctatataaagctcaaaatgagctaacaaaaataggtgaagaaaacggtattaaaatcacatttttccacggtcgtggtggaactgttggtcgtggtggtggtccatcttatgaagctatcacatcacaaccttttggttcaatcaaagatcgaattcgcctaacagagcaaggtgaaatcattgagaataaatatggtaatcaagatgcagcctattataaccttgaaatgcttatttcagcttccatagaccgcatggtaacacgtatgattactaaccctaatgaaattgataatttccgtgagacaatggatggtattgtgtctgaaagtaatgccgtttatagaaatttagtttttgataatccttatttctatgactatttctttgaagcaagtccaattaaagaggtatcaagtttaaatattggttctcggccagcagcacgtaaaacaattacagaaatttcaggtttacgtgcaattccatgggtattttcatggtcacaaaatcgtattatgtttccaggatggtatggtgttggatcagccttcaagcactttattgaacaagatgaggcaaacttagcaaaattacaaaccatgtatcaaaaatggccattctttaattctcttttatctaatgtagatatggttttatcaaaatcaaatatgaatattgcgcttcagtatgctcagttagctggaagtaaagaagttcgagatgtttttaatatcatccttaatgaatggcagttaactaaagatatgattttagctattgaacagcatgataatttattagaagaaaacccaatgttacatgcaagtttagattatcgtttgccatatttcaatgttttgaattatgttcaaattgaattgattaaacgtcttcgtagtaaccaactagatgaagactatgagaagttgattcatattactattaatggtattgcaacaggtttacgaaattcaggttaatattgatagagggaggatcattgctattctcacgccaaacgcatgaagaaacttttgttttcagaaaactagattcataatgacaaaatcaatcaaagtagtacactatagatgaggtgactacgatgattgattttattatttctattgatgattgcgcagttgaattggatagtcgtcaatcttggaaaattcgctaccccttatcaaccattctatttcttgtctttgtttgtcagttagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaatcatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggctaagcagatcattgatttaaaaaggaatcttttcaaaattgatgtccgggcacaaaaggatgaagagaaagttttcatgcgtacggcgtgttgctattctcccttttactttacttcgaaagatgatataatgcataatggtaattttttgatatattaaaggaaataatacaatatgaaaattgataaaaggcatcttctgaattattccatcctcattccctatttgatattgtctattctaggcttaattgtaatttattcgacaactagtgcaactctaattcagcttggagctaacccttttcgttcagtaatcaaccagggtgtcttttgggcagtcagtttggttgcaattatctttatctataaactgaaactaaattttttgaaaaattctaaagtgttgactatggcagtattggtagaagtatttttactactaatagcgcgcttttttacacaagaagttaatggagcacatggttggattgttattggtcctattagttttcaacctgctgaatatttaaaagttatcattgtatggtatttagcgtttacttttgctcgaaggcaaaaaaagatagaaatatatgattatcaagctttgacaaaagggagatggcttccgagatcactaagcgacctaaaagattggcgattttattctttatttatgattggtttggtaattgcacaacctgatttaggaaatggttcgataattgttctaacggtcattattatgtactgtattagtggtattggttatcgatggttttcagctttacttggtctaatcgtcgtggggtcaactttatttatcggaactattgcagttgttggagttgagacaatggctaaagtccctgtctttggttatgtagctaagcgatttaatgctttttttgacccatttaaagatttaacagattcaggacaccagttggctaattcgtattatgcaatgagcaacggtggctggtttggtcgaggacttgggaattctattgaaaaattagggtacttaccagaagcaacaacagactttgtcttttcaattgttattgaggaattaggagttattggtgcagggtttattttagctttggttttcttcttaattttacgtattatgcacgtaggtataaaggctaaagatcctttcaactcaatgatcgctcttggtattggagcaatgctattgatgcaagtttttgttaacattggtggtatttctgggttaatcccctcaactggagtgacatttcctttcttatcccaaggagggaacagcctcttggtactttctgtagcgatcggattcgtgcttaatattgatgctaacgagaaaaaggaactcataatgaaagaagcagaagagcaatataagccacaagaaaaaaatgaaaaaataatcaaccttgatgcctttaaataatcatccaaacaaaaatcgagatttttatctcgatttttgtattttttgaaatttaaactctaattaatagagagaagatatttgaagaaaagaagtgtctattaatattctaatactataaattaggatgtatttaacaatatgattatatgataactactaaaaaatacatataagagataacaaatgcctcaatcaatcttacccgaattttaaggaaataaagaaataagcaaaaaagcataaaatacttgcttttttagaggattttgttaaaatagataagtaaagttagactgtattgcctaccgtctatctataaaatatattttattggaggcttttcctaaaatggcaaaagaaaaatacgatcgtagtaaaccacacgttaacattggtacaatcggacacgttgaccacggtaaaactactttaacagcagctatcacaactgtattggcacgtcgcttgcctacttcagttaaccaaccaaaagattacgcttctatcgatgctgctccagaagagcgcgaacgcggaatcacaatcaacactgcacacgttgagtacgaaactgaaaaacgtcactatgcccacatcgacgctccaggacacgcggactacgttaaaaacatgatcactggtgctgctcaaatggacggagctatccttgtagttgcttcaactgatggaccaatgccacaaactcgtgagcacatccttctttcacgtcaagttggtgttaaacaccttatcgtattcatgaacaaagttgaccttgttgatgatgaagaattgcttgaattggttgaaatggaaattcgtgaccttctttcagaatacgacttcccaggtgatgaccttccagttatccaaggttcagctcttaaagcacttgaaggcgacgaaaaatacgaagacatcatcatggaattgatgagcactgttgatgagtacattccagaaccagaacgtgatactgacaaacctttacttcttccagttgaagatgtattctcaatcactggacgtggtacagttgcttcaggacgtatcgaccgtggtactgttcgtgtcaacgacgaagttgaaatcgttggtattaaagaagatatccaaaaagcagttgttactggtgttgaaatgttccgtaaacaacttgacgaaggtcttgcaggggacaacgttggtgttcttcttcgtggtgttcaacgtgatgaaatcgaacgtggtcaagttcttgctaaaccaggttcaatcaacccacacactagatttaaaggtgaagtttacatcctttctaaagaagaaggtggacgtcatactccattcttcaacaactaccgtccacaattctacttccgtacaactgacgtaacaggttcaatcgaacttccagcaggaacagaaatggttatgcctggtgataacgttactatcgaagttgaattgattcacccaatcgccgtagaacaaggtactactttctcaatccgtgaaggtggacgtactgttggttcaggtatcgtttcagaaatcgaagcttaatttaacttaattaagttcccaaacggcagttagagtcagacagctcaaattgtgaagagtcctcagggactcttttttagtatctataattaaagcgttttactagactcgtgaaacttttaattaactataatttatggtatgatagattagtaaataaaaaaagaagaggtatgtgtaatgtcacgtaaaccatttatcgctggtaactggaaaatgaataaaaatccagaagaagcaaaagcattcatcgaagcagtagcttctaaattaccatcatcagaacttgttgaagcagggattgctgctccagcgcttactttatcaacagttcttgaagcagctaaaggttcagaattgaaaatcgctgctcaaaatagctattttgagaattcaggtgcattcactggtgaaaacagccctaaagtattggctgaaatgggtacagactacgttgttatcggtcactcagaacgtcgtgattatttccatgaaactgaccaagatatcaacaaaaaagcaaaagctatctttgctaatggtttgactccaatcatttgttgcggtgagtctcttgaaacttacgaagctggtaaagcggttgaattcgtaggtgctcaagtttcagcagctcttgcaggtttgtcagaagagcaagtatcatcacttgttatcgcttacgaaccaatctgggctattggtactggtaaatcagcaactcaagacgacgcacaaaacatgtgtaaagcagttcgtgacgttgttgcagcagacttcggtcaagcagttgctgacaaagttcgcgttcaatacggtggttcagttaaacctgaaaacgttgcagaatatatggcttgcccagacgttgacggtgcccttgtaggtggagcttcacttgaagcagaaagcttccttgccttattagattttgttaaataaatcacatgatatctaaaggcatagcactctaggtgatatgccttttcttatagatagttaataataagctatttttgattattgaactagtaatcagactagatttttatggctattttttgtagaatagttaaagtaaatattggtatagccaaaattaaaggagaaattttctaatggtaaaattagtattcgcacgccacggtgaatctgagtggaataaagctaaccttttcactggatgggctgacgtagatctttcagaaaaaggtacacaacaagctattgatgctgggaaattaattcaagcagcaggtattgagttcgaccttgcttttacatcagttcttaaacgtgccatcaaaacaactaaccttgcccttgaagcagctgatcaactttgggtaccagttgaaaaatcatggcgcttgaacgaacgtcattacggtggattgacaggaaaaaataaagcagaagcagctgaacaatttggtgatgagcaagttcatatttggcgtcgttcatatgatgtattgcctccagatatggctaaagatgatgaacattcagcacatactgatcgtcgctatgcttcactagatgattctgttattccagatgcagaaaacctaaaagttactttagagcgtgctcttcctttctgggaagataaaattgctcctgctcttaaagatggtaaaaatgtgtttgttggtgcacacggtaactcaatccgtgctcttgtaaaacatatcaaacaattgtcagatgatgaaatcatggacgttgaaattcctaacttcccaccacttgttttcgaatttgatgaaaaattaaaccttgtttcagaatattacttaggtaaataatctaatctttatataaaaaattcaggccaagttggcttgaattttttattatttataacattttgagtgtctgtaaaaaaccatttttatgatacaatagtagtcagagtttttatagcaaggagttaatgttgaatcgtaaaaaaaggtatcgtctcactgtaaaaaagcaaaatgctagcatacctagacgattaaatcttctattttttattattgttttattatttactgttctaattcttcgtttagagcaaatgcagattgggcaacaatcattttacatgaaaaaactgacagctcttacgagttatacagtgaaagaatcaaaagcgagaggtcagatttttgatgctaagggagttgtcttagttgaaaatgatgaacgtcctactgtggcgttttctagaggaaacaatatttcatctcagtctatcaaagagttagcgaataaattatcacattacattaccttaaccgaagttgcttcaagcgatagagcaaagagagattattatttagcagataaagccaactacaaaaaagttgttgaaagtttaccagattctaaacgttacgataaatttggtaaccatctagccgaatcaaccgtatatgcaaatgcagttgctgcagttccagtgagcgctattaactattctgaagatgagttaaaagtggttgccttatttaaccaaatgaatgcgacaccaacgtttggttcagtgaaattaagtacaggcgaattaagtgatgatcaaatcaagaaactggatgctgataagaaggaactgttaggaatttctgtaacaagtaattggcatcgtcgtaaaaaaggaacttctttatcggatatattaggtactatttctacagaaaaggcaggtttaccaagagaagaagttaaaaaatatttgaaaaaaggctattcactgaatgaccgagtgggaacttcttaccttgaaaaacaatatgaagatgacttacaaggaatcagacaaattcgcaaagtagttgttaataaaaaaggtaaagttgtttcagataatattacgcaagaaggtaagtcaggaagaaatcttaaattaacgattgatcttaattaccaaaacaaagtagaaagtatcttgaaacaatactatggcagtgaattatctagtggacgcgctagtttttccgaagggatgtatgcagttgctatagaaccttcaactggtaaagtgttagcaatggctggtctgaaaaatgatcatgggaatttagttgatgacagcctaggcactattgctaagaatttcacgccaggatctgttgtgaaaggtgcgacgctatcatcaggatgggaaaataaagttcttagaggaaatgaagtgctttatgaccaagaaattgctaatatacggtcatggtttacacgaggtttgactccaatatctgcggcacaagcgctagagtattcatctaatacttatatggttcaagtagcacttcgtttaatgggacaagactataatacaggagatgctttaactgatcgaggctatcaagaagcaatggctaaactaaggaaaacttacggcgaatatggtttaggggtttctacaggattagatttacctgaatcagaaggttatgtacctggaaaatacagcttaggaacaactctaatggaatcgttcggtcagtatgatgcctatacaccaatgcaacttggtcagtatatctcaactattgcgaataatgggaatcgtttagcacctcacgtggtttcagatatctatgaagggaatgattctaataagttcgctcaattggttcgttcaatcactcctaaaacactaaataagatagctatctcagatcaagagttagccattattcaagaaggtttttataacgttgtcaatagtggaagtggctatgcaactggtacgtcaatgagggggaatgtgacaaccattagtggtaaaactggtaccgctgaaacatttgctaaaaatgtaaatggacaaacagtttctacctacaacttaaacgctattgcctacgatactaatcgtaaaatagcagtagcggtaatgtatccgcatgttacaactgatacaacaaaatcccatcaattagttgcacgagatatgattgatcaatatatttcacagttcacaggacaataagagaggacatttgaatgctttacccaacaccaattgctaaattgattgacagcttttcaaaattaccgggtataggtactaaaacagcaacacgtttagctttttacaccattggtatgagtgatgaagatgttaatgaatttgctaagaatttattagctgctaagcgggaattaacctattgttctgtttgtggtaatttgactgatgatgatccttgcttaatttgtacagataagacgcgtgaccagtctgttatcttggttgttgaagatagtaaagatgtgtcagctatggaaaaaattcaagagtataatggtttgtatcatgtcttacatggcttaatttcacctatgaatggtattagccctgatgacattaatttgaaaagtttaattactcgattgatggatggtcaggtgacagaagttattgttgctaccaatgcgactgctgatggtgaagctacatcaatgtatatttcacgagtcttaaaaccagctggtatcaaagtgacacgattagcgagaggtttagctgttggttcagatatcgaatatgcagatgaagtaaccttgcttcgagcaatcgaaaatcgtacagagttataattgttataaagaaaaggttgggaatctcctaactttttcttttacaatactaactttaagtggattgatttttgaaagttaggttaaaatatggtattattaaaaggtcaatcttagattagatagaaaagagaagaaatatgtcaaaagaaacattgatcttgctttacggtggtcgctctgcggaacgtgaagtatctgtactgtctgcagaaagcgtcatgcgtgctattaattatgataaattttttgttaaaacttattttatcacgcaagtaggtcaatttattaaaacacaagaatttgatgaaatgccatcttcagatgaaaagttaatgacaaaccaaactgttgatttagacaaaatggttcgtccaagtgatatctatgatgataatgcaattgttttccccgttttacatggaccaatgggggaagatggttctatccaaggatttttagaagttttaaggatgccttatgttgggactaatattctatcttcaagcgtggctatggataaaattacaacaaaacaagtccttgcaacagtaggtgtacctcaggttgcatatcaaacttattttgagggtgatgatttggaacatgcgattaaactctctttagaaactttaagtttcccaatttttgtaaaaccggctaatatggggtcatcagtaggtatttcaaaagcgacagatgaatcctcacttcgctctgcaattgacttagctctcaagtatgatagccgtattttgattgaacaaggcgtgacagctcgtgaaattgaagtaggtattttaggcaataatgatgttaagacaacttttcctggcgaagtcgttaaagacgtcgatttctatgactatgacgccaaatatattgataataaaattactatggatattccagctaaagttgatgaagcaactatggaagcaatgcgtcaatatgcaagtaaagcttttaaagcaatcggggcttgtggtttatcacgctgtgatttctttttgacgaaagatggacaaatcttcttaaacgaactgaatacaatgcccggttttactcagtggtcaatgtatcccctgctttgggaaaatatggggctaacttatagtgatttgattgaaaagttagttatgttagctaaagaaatgtttgaaaaacgtgagagtcatttaatttaaaaaagttcaactaagtctttcttagttgagctttttcaaatctatgatatgttatgaaagtgtgttataatttaggagtatattcgtttataagggatagcatactatctacaacattgttgctaaataatagaaaaggaaatgatatgaagcttagtttgcatgaagttgctaaagtagttggcgctaaaaatcaagtatcagagtttgaagacgttcccctgggaaatattgaatttgatagtcgtaatatcagtgaaggtgacttatttcttcccttaaaaggagcaagagatggacatgagtttatagagatggcttttgataatggagcaatagcaaccatttcagagaaggaaatagagggtcatccttatcttttagtgtctgatgcacttaaagcatttcaagtcttggcacagtattatattgaaaagatgaacgttgatgttattgcagtaactggctcaaatggtaagacaacaactaaagatatgatagctgcaatcttatcaaccacatataagacttataaaacacaaggaaactacaataacgagattggcttaccctatactgtgctacacatgccagaagatactgaaaaaattattttggagatgggacaggatcatcttggagatatccatgtgttatctgaaattgcaaaaccacgtattgctgttgttactttgattggtgaagcacacttagaattttttggtagtcgagaaaagattgcagaagggaaaatgcaaatcacagatggtatgagttcagatggcatattaattgcaccgggagatccaattattgatccatatcttccagcaaaccagatgactattcgttttggtcatgaccaagaattgcaagtgacagaactcaaagaagaaaaacattccttaacttttaaaactaatgctttggagcaccaattacgtataccagtacctggtaagtacaatgcaactaatgcgatggtcgctgcctatgttggaaaattattagcagtagcagaagaagatatagtggatgctctagaaaatcttcaactaactcgtaatcgcaccgaatggaagaaatcagccaatggagcagatattttatcagatgtttacaatgctaacccaacggctatgcgattgatactagaaaccttttcagctattcccaataatgatggtggaaagaagattgctcttttagctgatatgaaagaactgggagaacaatctgtggatttacataatcaaatgattatgagtatcagacctgactctattgatactttgatttgttatggccaggatattgaggggttggctcaattagcaagccagatgttcccaattggtaaagtgtatttctttaaaaagaatcaagaagtagatcagtttgatcaattgcttgcaaaagtaaaagatactcttaaggagaaagatcaaatattattaaaaggttctaactcaatgaatctttctaaaatagttgatattcttgaagtaggataatagaggtgttagggtaacaagttaccctaacttttttgttttttaatcacgaataatattcagttttattgaggaaaatagatatgctaagcagaaaactggtgatatattcagttttttgataatctgtttattacgaactatatttttaaaaataaaacttaagttcgtttttaggaggattgtttgaaaaatttaaatcgttatgtagttgcggtttctggagtcgttttacatttaatgctaggatcaacttatgcttggagtgtgtttcgtaacccaatcatctcagagactggttgggatatttcatcagtttcattcgcttttagtttggctattttttgtctaggaatgtctgcagcttttatgggacacttagtagagcgttttggtcctaggataatgggaatgatttctgctattttatatggagcagggaatgtgttaacaggtttagccattgaaactcagcagttatggttactgtatgttgcatacggtattttaggaggaatcggacttggttcaggttatattactccagtatcgactattattaaatggtttcctgataggaggggactagcaacaggattcgctattatgggatttggctttgcttctttagtaacaagtccgcttgcacaatccttaatgattaggattggtgtaggtaaaacattttatattttgggattagtatatttttttgtcatgatgattgcctcacaatttattaaacaaccacctcaggaaaaaataactattttgactcacgacggtaaaaagaatgctatgaattcacaaattattactggattaaaagcaaatgctgctataaaatcaaaaaccttttacatcatttggttgactttgtttattaatatttcgtgtggcttaggtttaatatcagcagcttcaccaatggcacaagatttagcaggctattccgcagaatctgcagccttattagtaggggtactagggatatttaacggttttggacgtctgttatgggcaagtctctctgactacattggacgcccgttgacctttataatattatttattgtgaactttattatgacttctagtttatttttgtcattcaatgctattgtatttgcaatagcaatgtctattttaatgacttgttatggtgcaggcttttccttattacctgcttatctaagtgatatttttggaacaaaggaattagctactttacatggttatagtttaacagcatgggcaatagcaggtctgtttgggcccctattgttatcaaagacatattcatggggaaattcctatcaattgacattaatggtttttggttttttattcttattcggattattgttatctctatatttaagaaaattaacaactaaagttgtgtagtatatatctaatttaaaattctttggttttaccaaagagttttttctttgaaaaatagttttgtcttatagcaaataatttgatatactaagtatctagtaaaaaaatgatagaaagataatactaaaatgatagaattcttttctaatatcagaacagagattccgcagatgcctttacttatccatagtttgattttatctgtcttaccttttctgatgtggctgactttggttaatagagataagcctttgtataaaactatttggagtatccttttaggacttcagttaattacgatttatacttggtttttctgggcaaaattgcctttatctgaaagtcttcccctttaccattgtcgaataggcatgtttgtcgttctcttggcgaggcctggaatattaaaggattatttcgcattgttaggagtagtaggtggagtattggcaatgattcacccagacttttacccttaccagtttctacatgtgactaatattttcttctttattggacattttgctttatttgtccttagtttactacatctgatgacacagtccaatttggacaaattaaatccaaaattgattatacaactaacgcttctcattaatatgtctttgatttttattaacctcttgactggggggaattatggctttatgatgaagacaccaatactaggaataacaaatccctttttaaacctttttatagtgacaactctattaagttttctcgtcctatttgttaaacaaattttccaaaaagtgagaatgagagctagtcttaaaacagaagaatcttaattattttaatattattatattatctagctattaaaaaataaatagctggataatgtttttcatttttagctatttttatgattgaccgctaattattaatctgctaagatatagtacgtaataaaaacttaaccggttaattatttttgaaatatattttttctggaggaaaatagtaatgaataaatcattcaataccaaattaggtttggtaactgtagcggtattatcaggtattgtattaacgtctcaattacctgtgaacgctaaagctgagacaccagtaatggcagcaagtgcacaacaaggtttccgttttgtagcaaccgttgtagatagtcagacgcatgtcttgccgggaaaattggtaactttgtcagaggtgacaagtggtcagcctaaaattattgcaagtgtgaaaacgaatgatgccggacaagctatttttaataatctccctataaaacgtaaccttagtgtgtctgttgatggacaagtaaaaggatatactattcgaactgacgtagcaggttctagtaaagcagctagttttacagcaacaggagtagggacaaatgagccaacgtattcaaaaaaaaccatagacatcacagtgagagaccagaatgctgaacctgtttcaggcaggacagttaccttaaaaacacaagctggtcgtgagattgctagcttggtttctggtgacaatggattaactcgctttactgatcgtttactagatggaacattctaccaatattttgttgatgggaaaaaaattggtgatattgtacctggagaatcaagaagtgcatatgttaatgttgcacctaaaaaagattattttacctttacagtcactgctttagataaagatggacttgttgttaagggaaaagaagtaacgttgactgatattactgatggtaaagcagtagcgcttgcttctttaaaaacgaatgataatggacaagctatctttaccaacctaccattatcaagaaatatcagtgtttcaattgatggaaaatcaaagggctatactcttcgaactgatgtagcaggctctcataaagcggctgcattctatgtagatggtaaaggtaccaaagcacctcaatttagtgcagaagcagcggttgtaactgtttacgatgctaatggaaatactatagcaaaccaagaagtgacattaactaattcaaatgggacaattgttgcaaaaggtttgactgaaaaagatggcaaagcaaggttcgccaataaattaatggcaggaacgttatacaatatttttgtaaatggtattgagatgcctaaaactgcccttgttggtagtgatgtcagtgtttttctaacagataaacaaattaagaaagaaaaacctgttactcctgataaattggataaagaaatgaaccaagagaaggaaaaggagctcttagatactccaaaaccagtaccacctacttcgaaaccaacagcaccaattaaaaataaaaaggacgattcccctaagaagttcacgaaaagtcaatcttctagtttgaagtcaagtgttaaggctataggtgctaagccaaaagctatgacagccttagctaaaaaattgcctaaaactggtgatcaagccattagtattttaactttggttggttttattgtaacagggttagcgattatgttaggcttccttaaaaaatcacgatcaaaataatttattttagaagcttgggtctttagacacaggcttctcttctttcttcggaaatagattgaacttgaagaatgttgttaaattcgctataataataaagttatagacaagattattgtttcagttgagactactgaaaataatactaagaaatggataaaagctaaggattgaatatgacattacaagacgaaatcaaaaaacgccgtacttttgccatcatctctcacccggatgctggtaagacgactattactgagcaattattatattttggtggtgaaattagagaagcagggacagtaaaagggaaaaaatcaggtacttttgcaaagtccgactggatggatattgaaaagcaacggggtatctctgttacttcatctgttatgcaatttgattacgcgggtaaacgtgttaatattttggatacacctggacatgaggatttctcggaagatacataccggaccttaatggctgtggatgcagctgtcatggttgtagattcggctaaaggtattgaggctcaaactaaaaaactttttgaagttgttaagcatcgtaatattccggtttttacgtttattaataaattggaccgtgatggacgtgagccattggatttgcttgaagagttagaagaagtactaggtattgcttcttatccaatgaattggccgattggtatggggaaatcatttgaagggctttatgatttacataataaacgtttagaactctataagggagacgagcgttttgcaagtattgaagacggtgatcagctgtttgccaataatccattttatgaacaagtcaaagaagatattgaacttcttcaagaagcaggtaatgacttttcagaacaagctattcttgatggtgacctaactccagtattctttggctctgcccttacgaactttggagttcagacttttcttgatactttcttggagtttgctccagaacctcatggtcacaagactacagaaggtaatgttattgaccccttggctaaagatttttcaggttttgtctttaaaattcaagctaacatggacccacgtcatcgcgaccgtattgcttttgttcgtattgtttctggtgaatttgagcgcggtatgggagttaatttgacacgtactggtaaaggtgctaagctctccaatgttactcaatttatggcagaatcacgtgaaaatgtgacgaatgctgttgctggggatattatcggggtttatgatacaggaacttatcaagttggggataccttaacagttgggaaaaataaatttgaatttgaaccattaccaacttttaccccagaattatttatgaaagtatcagcaaaaaatgttatgaagcagaaatcattccacaaaggtattgagcaattagtacaagaaggagcaatccagctttataagaattatcagacaggcgaatacatgctgggtgctgtgggtcaacttcagtttgaagtttttaaacatcgtatggaaggtgaatacaatgctgaagttgttatgacaccaatgggtaaaaagactgtacgttggattaactcagacgatttagacgaacgcatgtcttcaagccgaaatattttagcaaaagatcgttttgaccaaccagttttcctatttgaaaatgattttgcacttcgctggtttgctgataagtatcctgatgtgaagcttgaagaaaaaatgtaaaatttaaagtcactcaaatttgagtgactttttaagttttttagactaaaatagttataatacatagaaaagattggagattaacatgggaattttttcgggattaatgggaaatgcttcacaaatggataccgataaagtcgagaatcagttatctgatattctgatttcagatgaacaggttgatttagcttataccttaattcgtgatttgattgtttttactaattatcgtttaattttagtcgataaacagggggtgacaggtaaaaaggtttcttataattctataccttatgcttctatatcacgttttacagtggaaactagtggtcattttgatttagatgctgagttaaagatttggatatcatcagcaatagaaccagcagaagtacttcagtttaagaacgaccgtaacatagtgagtatacagaaagctttggcgacagctgttttaaaataaacaatttagcagtagtgatttttatcactgcttttattttgaagtatagtaggcctcaagcatatattttgaaaacgctgtatttttttgataagatatttttttgaggagtattaaataatgataatagaattaaagagtgttggaaaaatttttccaaaatcacagtttagattagatgatatttcttttaatatagaagaaggcgagatagttggtctgattggttctaatggtactggaaagagtactattttgaagatgattaatggcttaatcccttatgataaaggaaatatttattatcaaggaaaagaagtgaagtctttttctgataataagttacgtcagatgcgtaaagatattgcttatatttttcaaaatcataatttgttagcaggagaaagtgtatattatcatctagctttagtttataaattaaatcatcaaaaagtaaatcatgacgcaattaatgatatcttagattttttaggtttgatggatttaaaacaggtgaaatgccatagtttgagtggtgggcagcaacaaaaagttgcaatcgctatggctgttttgcaaaaaccgaaacttattctatgtgatgagatcagctctgccttagatactaatagtgaaaaagagatatttaacttgttgtctgatcttcgtgaaaaatatggtatctctatcttgatgattgctcatcacctatctcttttaaaacaatattgtgatcgtgtaatgattttggatcaccagactattgtagatactgttgttccagtgaaagcaactctgaatcaattaaagtcaaactacgtagatcaagtaaaggagtttttgttacatgattgacattattgaaaaacatggcgaaggtatcttaaaatcattttgggaaaccaatttaatgttagggttaaccttgattctttgttttctaattgcttttccaacaggtattttattgttttcattgagaaagtcttacttgattaaacattctttagcctatcaactactaaatttatttttaggtacgttacggagtgtccctttccttatttttatttttatcttaatccctctcaatcgattaatttttgggacctcatttggaacgatagcggcaatcttacctcttactttggtttcagtcagtttgtatgcacgttatgtggaacaagctttattaaatatacctcaagttgttgtagatcgagctctcagtctaggggctaacaagagacagataatttattattttttaatcccctccatcaagattgaccttgttttatcatttactgcaacggctataagtattcttggctactcgacaataatgggagttattggtgcaggaggtttgggtgaatatgcctatcgttttggctatcaagagtatgactacccagttatgtacttgattgttgtcttatttataatatatgtgtttatcttacagagtttgggctattttatagcaaaccgctactcaagaaaataaaagaaaagaggaactatgaaaaaattactttccctaacatgtctaatcatgatgtctttatgtttagtggcatgtactaagcaagcaatgtcgtctaagaaaattaaagataagaatagtaaagaaaaggtgattactgttgcaacttacagcaaacctacatctacctttttagatttggttaaagataatgtaaaagaaaaaggatatactttaaaggttgtcatggtctctgactatattcaggctaacattgctttagaaaacaaagaacatgatgctaaccttttacaacatgaatttttcatgagtatctttaataaggaaaatgatggtcatctagtatcaattacaccaatttatcattcattggctggtttttatggtcaacatttgaaaaatattgccgagcttaaagacggtgctaaggtagcgattccgtctgatcctgccaatatgactagagctctgctattattgcaagaaaagaaacttatcaccttaaagaatacgtccaaaaagaccaaggctatcgaagatattattactaaccctaaaaaattacgaattgaacctgtagcattacttaacctcaatcaggcctattttgaatatgaccttgtctttaatttccctggatatgtgacaaaaatcaatctagttcctaaaagggatagattattatatgagaaaaaaccagatatccgttttgcaggtgccttggtagctcgtgaagataataaaaatagtgataaaataaaagtacttaaagaagtactaacaagtaaagagattcgtcactatatcactaaggagattccaagtgaagcagccgttgcgttctagatagataaactatgaaccctccttctttatagatggtgggtttttattgccttttttctattttctgaagcaactaatagaactagcaatttatgaaagcgtgttatttattagattgaccttattttatatctttttacttttaattgtgttacactaagtaggttgtcagaaaagataactaataaaggttcataaggcagcttcgcactgtcttttagaaaagagaaacatttgaaatttacagaacttaacttatcgcaagatattctttcagcggtagaaaaagcaggctttgtagagccatcaccaatccaagaaatgactatcccacttgctcttgaaggcaaagatgtcattggtcaagcgcagacaggtacaggaaaaactgcagcttttgggttaccaactttaaataaaattcatactgaagataatactatccaagcacttattattgctcctacacgtgaacttgcagtacaatcacaagaagaattgttccgttttggacgcgataaaggtgttaaggtccgctctgtttatggtgggtcaagtattgaaaaacaaatcaaggcattacgttcaggagcacacgttgttgttggaactccaggtcgattacttgatttaattaaacgtaaagcacttaaacttaatcacattgaaactcttattcttgatgaagcagacgaaatgcttaacatgggatttttagaggacattgaagcaatcattagtcgtgtaccagaaacacgtcaaactcttttattctcagcgacaatgcctgatccaatcaaacgtatcggcgttaaattcatgaaagatcctgagcatgttaaaattaaagcaactgaattaactaatgtgaatgttgatcagtattatgttcgtgttaaggaaaatgaaaaattcgatactatgacacgtttgatggacgttgatcaaccagaattgtcaattgtctttggacgtacgaaacgtcgtgtagatgaattaactcgtggactaaaattacgtggtttccgagcagaaggaattcatggagacttagatcaaaataaacgtcttcgtgttatcagagactttaaaaatgaccatattgatattcttgttgccacagatgttgctgcgcgtggtttagatatttcaggcgttacacatgtttacaactatgatattccccaagatcccgaaagttatgttcaccgtattggacgtactggtcgtgctggtaaatctggtcaatctatcacttttgtttcaccaaacgaaatgggatatttgacaattattgaaaacttaactaaaaaacgtatgactggaatgaagcctgctactgcaagcgaagcatttcaggctaagaaaaaagttgcattgaaacgtattgcacgtgactttgaggatcaggaattagtttctaaatttgataaatttaaagccgatgctttagaattagcaactcaatacacaccagaagaacttgctctttatgtcttaagcttaacagttcaggatccagaatcgttaccagaagttgaaatcacacgtgaaaaaccattaccatttaaaccatcaggtggtggctttaaaggtaaaggtggacgaggcaatggccgtggtggcgatcgtcgacgcaatgatcgtggtgatcgtcgtggaaatcgtgaccgtgatgatcgtggtagtcgttgtgattttaaacgtcgtgatgataagttcaagaaagataatcgtcgtcaagaaaataaaaaacctcataaaaacacttcaagtgaaaaacaaactggatttgttattcgcaacaaaggcgataaataagaggattatgaaaaaggagttgctgagcgactccttttttattttttgtaagataaagcgtagatagtgatatccataaaattgccttataactttaagaatgaagacaaaagattaaagtgaggttgaaatttaaaagttaaagaagcgaggataggctcattacacttagtatattatcgtattattgttcatttttatgttgtttaatataagtcaattttgcttgccgagtcttttgtttaaataatgcttctgccctcattgcttcttgtttgctattaaaagcttcagaataaagaagttttactggcaatctcgcacgagtatatttagcaccttttccagtattgtgtgtattgagacggcgcttgacatctgtagtataacctgtataaagtgttccatctgaacattctaaaacatacatataagcaggaactttaatcatgagattttccgttttctccgaaatatatatcaaaaatagtctcagtatagtctccattatcttgatgaacaacaagaggaggaagtattttcataccttctgtcgagccatctttaatagcttcaattaaaagcatattagcatcttttcctaattttggataaacaaattggatacgtttaggtgctaaattgaactgacgcatcgtatcaataatttcaaggaaacggtctggacgatgtaccatagcgatacgtccttttgtttttagagcatgttgagcaatttgacaaatctctctaaggtttgttgttatttcgtgtcttgcaaggagataatgcgggcttagattttttttagaggtttcgcttgctttgaaataaggtggattgcaaagcattaaatcaacgtttgaacgttgaacatgatcaagaagattttttaaatcatcattaatcatagtaacctgtttttccaatttattgagcttaatcgaacgcttagccatatccgcaaggctctcttgtagttcgatctctataattgtcgcatttgttttggtgctggcaaacaaaccgacagcaccattaccactacataagtcaacgataagaccacgagaaggaagtttagggaaccgagacaataaaacactatctatggaataggaaaaaacttctttgttttggatgattttgacatcagttgaaaaaagctgatcaatgcgttcattttcttttaaaattgtatctatcataggcttattatagcaaaattacagcttcctagcactagttttgaaagtgtggaggttgattttaagataattctttctaaaaaaaaggaagcatgataaaatagaagttacttgatgaaaggtagaggagaaacatgttctatacttacttacgtactttagttatgttcttgatttgggtggctaatggtaatgcgcactatcataatgaagataaaatgttaaaagatgatgaaaattatattttagtagctccacacagaacattttgggatcctgtgtacatggcttttgctgctagacccaaacagtttatttttatggccaaaaaagaattattcacgaatcgtttgtttggttggtggattaaaatgtgtggtgctttccctattgatcgtgaaaagccagggcaagatgctattcgatatcctgtaaagatgctgaaaaatagcaaccgttctttggtgatgtttccgagtggaagccgccactccaaagatgtcaaaggaggcgtagctgttattgcaaaaatggcaaaagtcagaattatgccagcagcatatagaggtcctatggtttttaaaaatctattaaaggggcatcgtgttgatatgaattttggtaaccctattgatgtttctgatattaagcgtatggatgccgaagggattgcagaagtatctcgtcgtattcaggaagaatttgatcgtttagatagagaaaatgaaacttatgatgatggtaagaaattaaatccattgacttatatttatcgtctacctttagcaattatagctattgtcttgcttgtcctaactctaatttttagttatttagcaagctttgtgtgggatccacaaaaacatctaaaataagggttacatggaaactatttactttttagtaaatagtttttttggtttttaataggaaaatctctttagttacgaataagtaaatggaggaatatttttatgtttgaaatagtattggaaaaaattaaatcgcataaatgggagacaacaggaattattgtaggactcttattatttggaattttgggtttaaatcattttggcactcatcataaagaagacaatttaaatatcaatttagagaaaaaagtatcaactataacagaaaaaaaggtaccaatgattagtcacgtcaaagataaagtatctaatcaagtaacggttgacgtaaaaggggcagtcaatcatccaggtgtttatagtttgccttctcaaagtcgtgtaacagatgcgattaagcgtgcaggtggactaagcaatctcgctgatagtaaatccgttaatctagcacagaaattacaagatgagacggttatctatgttgctcaaaaaggtgaaaaaataactgttgtggaagaggagaaagcaaataatatcgctactcagggaaatagtaaggggaaaattaatcttaataaagcagatttatcaagtcttcagaccatatcaggcgttggggctaaaagagctcaagatattttagattatcgtgatagtcaaggtggttttaaaactattgatgacctcaaaaacgtatcaggtattggtgagaaaacactagaaaaattacgtcaagatgttacaattgactaagtattttcctctaaaacctatttatttagcattgttggtcttccaaatttacttactagtgttttcttggacaatgcttggttgtgcctttcttttattttcttttatttttctgatttatcaatatgatcgtgaaactatttttaaaacaatagcaatagtaatttttttcttattttattttttatggcaaaatcacaatatgaatgtccaatatcaaagagtaccgaatcatattagccagattaaagtgcgtattgatactatttctatcaatggtgatgttttatcattccaggcagatgcttcaggtaacacttatcaagctttttacacattaaaaaataaaagtgagaaagattattttcaaaatcttgataataatataatgataattgcagatatcaaacttgaagaagcagaggagagaaggcattttaatggctttgattatcgtcagtatttaaaaagacatggaatttatcgtatcgccaaagtgacaaagataaaacagatacgcttatttcaacataggtctttctttgctcttatgtctaagtggcgtagaagtgcaattgttattagtcaaacttttccaaatcctatgcgtcactatatgtcagggcttttgtttggatatctagataagacctttgatgacatgtccgatttatatagtagtctaggtattatacatttatttgctttgtcaggtatgcaagtaggtttttttctcggtatttttcgttatatctgtctacgtattggcttacgtctagaccatgtttggttacttcaaataccattctcgctaatttatgctggtttaacaggctttagtatctcagtcgttagggcacttattcaatctttattatcacatagcggtgtcaagaaagatgagaactttgctctctgcttgttaatttgtcttatctccctcccccactcacttttgactacgggaggagttcttagctttgcttatgcttttatacttacgatgacctcctttgatcatttttcgagtataaaaaaagtagctatcgaatctttgacagtctctgtaggaattcttcccatactaacctactatttttcgggttttcaaccaatatcaattatattaacagcacttttatcttttgcatttgatattatatttttgcctttattaactgttatatttgtcttatcgcctatcgttaaattaagttgtattaatagtttgtttgaaatcctagaagtgttattaaaatggactgggcaactgtttccaaggccacttatttttggaaagcccagcctttttcttttaatagtcatgattataattttgggattactttatgattattatcattctaaatgttttcgttattgctcccttcttattatctttaccttgttttttatcactaagaatccaattactaacgaggttgcgattttagatgttggacagggagatagtattttagtgagggattggttaggaaaaacaattttaattgatactgggggaagggtgagatttgaacagcctgaagaatggaaacaaaaagtaaatcagtctaatgctaagagaacgctcattccttacttgaaaagcagaggtattagcaagatagatgatttagtgataactcataccgatacagatcatatgggggatatggaagttatctcaaagcattttaaagttgcacgtttgattacaagttcaggttctttaacgaattcgcagtacgttaagcatttatcaaagataggtgtagcggtaaaatctatagaagccggtgataaacttgctgtcatgggaagttatttacaagtactttacccatggcacaagggtgatggaaaaaataatgattcaattgttttatatggacatttattaggaaaaggcttcttatttaccggtgatttggaggaagagggagaaaagcagttattagaagcttatcctaatttatcagtagatatccttaaagcaggacatcatggttctaagggctcatcaagtctatcctttctgaaaaagttgtctcctagtgtggttctagtttcagctggtaaaaataatcgttaccagcatcctcatcaagagactttacaaaggttccaaaagattaaaagcaagattttccgaacggatcaatcaggtacaattaggctaacaggatggtggaagtggcatattcagacagttcgttgatttataaaaatgattgcgtatctgttaaatacaatctatttttcgcaagaattcagtaattttaagcttgacatggaacgggttccagcatttatactgatttcagaagaagagaggtattttttatgactatcaaacgtattttttgtgacatggatggtacactattaaatagtgaaggacaagtgagtaaaagtaacgctaccttaatacgtgaggcagcgattccagtaactttagtgtctgctagggcacctatggaaatgaaggatgccgtagatgcacttcaattaggaggagtccaagttgcttttaatggaggattgatttatagaataggagataataatcaagttctacctattcatacacaaatcattaaaaaaagcacagtaaaacaattgctaagaggaatacggtttcattttcctcaagttagtttatcttattacgatcttaataactggtattgtgataaaatagatgaaggaatccgatacgaacatagtttaactcaacaatgcccaacgtttattcataatgaggatcagtttttagaaggtcacacaaatacttttaaaattatgatgattactttcgatgaagcaaatatgctagaattagaaaaatatcttcaaagtttggagttaccagaaatcactattcaacgttcaggtaaagcgtatcttgaaattacacatctcttagccaaaaaatctaaaggaattgcttacatccttcaaaaagagcagttagctagagaagaaacggctgcatttggagatggacataatgatttgcctatgcttgaaatggtaggttaccctattgttatggataatgcttttgatgatatcaaagcgatagcatatcaactaactaagtctaatgatgaagacggagtgggatatgggattcaaaaatttttaaagtaggagccttataatgacaagtattagtgatatagctaaaaaggcaggtgttgctaaatcaacagtttcccgtgttatcaatcatcacccacatgtttctgatgagacgcgacaaaaagtaatggctcttatcaccgaattggattatataccaaatcaactagcgcgggatttaagtcgaggcaaaacacaaaaaataggtgtcgtcattccccacacgcgccatccttattttacacaattaataaatggcctattagatgctgctaaaactaccgactatcaacttgttatgatgccttcggattacaaccaagaattagaactttcctacttgaaacagctcaagatggaagctattgatgctttaatattcacttcaagagcaattagcctcgatattattgaaacttatgcaaaatatggacgaatagtagtttgtgaaaaattgcaggaatataatcatctatcctctgcttaccttgatcgctattcttcatttctagaggcgttttctgatatgaagttacgaggtttggagcacttagttttattattttcaaggaataatgaatcctctgctacctatcaatccgcattattagcttatcaagaggtctatgggcaactatcctctccatatatggtagttgggaatgttcatgactttaatgatggactaaatttatcttatcaattggtaaaagaagttagtatagatggtatattagctacaagtgatgaagttgcggcagggctaataaaaggttatgaagaaagtaggaaaaaatgtccttatattattggtcaggaatgtttattagttgggcaacttttgaaactcccaacaattgaccacaaatcctattatttagggaaattagcttttaaacaggctttagctgaaaagattagtcaagaagttttattctcagagtttttatctcaagacaattagtcattcaaaagtaatagaaaaaaggtttccaactaaacttgattggaaacctttttatttaatgattgataattttaagcatttgtttgaaagcagtctctgcttcaggaatcggtaagactggataaacgtggttcattttttgaccaacgatatagtggtgtttaatgttttcttttgctaatttttgatgtaataattgattatcggggtagaaaatatcgtgcgttcctataaaaaatgatattggagccatcttgttaaattggctactgtaaagaggactaacttgaggatttttaaaattcttttttccatttgcccagtaaggagctacttgttgtaattgccaagctttaagaaggggatcttttttttgaactttttcaatctttggattattagtagcaatatctaaccatggtgatattaaaataatttcttttggttgtttgatatgctccgtgacaaggttatcagcaagacctaaagcaagacctccgcctgcactttcacctactaggataatttgtttgggagatgtgacgctagctaatgtattttggtataattttttaattttggggatagcatcactataattatatgtaggagctttagggtaaataggaaagacaacttttgcatctaattttttagctagtttattgacaaaaatatattgtaattcagaagcttgatggatatatgatcctccatgaacatagaagataaccttttgcttaggattatttttatcattccaagtgaatgtttgcatgccatcagtagcggtaatttctaccttttcattatttaatgcctgaggaatgtctacaggaagaacattacgtttagctaccttagttaagtaattttggtattctttgatggtttgaggcttaatctgatttaccacaggtagagttttttcaatagtattgctagttagggatcttttttcaacaatatgagtgtaagcatatgctcccataaaaatgacaaaaaaggttagaagtagtagtacaataagttttcgatagtttttcatgattatccttttgtaattgagctcgtcatgctaaaaatgattagttgttattctataataaagtagatacgaaaacaagaaaataatgctataaaatttcaacctattataattttttgctgatagtacgtattaacctttaatttgctaaaatagaagagaggagagtgttattatgtttcacagagaagatttttcaaaagcattattaaaaaaagctttgcagcccggtatgagagttatggatattggttgtggtagtggggaattgacgcgtttggctgctgatatcgttggtaaagaaggtgatgttgtaggaattgatattaatgagcaacttttatggcaagctagacatgataatggctatgctaatgttagttatcaaaacgcagatttagcagcactttcctcctttgaaacaaaaagttttgatgcaattattggacgtcgtgtattaatgtatcaaaaagatccaaagaaagtaatagaaagtttaacacctttgttaaagccaaatggtttttatgtttttcaagaaagtgatgcaatgtgtttagaactagctaagcctagctttgtaaatatgaataaaatacaatcactaatctggcaaactgttgagaaggaaggaggacacattcatattggaagtcaacttgagcaattaatgttagaagcaggcttaatcgttgaccattttgtatcagaaaatgtcattcaaacgtcacaaactggtacagatttatcttggctactaaatatcatgaaagaaagaatacaaaaatatagtgaccttcagggattagaagatgtcaatttacaaaaagaattagaagagaataatgaccattttatccgagattgtcaatttggaattatttctcatagagttgatgaatgattttaagtattatttgacaccttgaaaagtttccttatggtataataaggaatatgattgcgattgaagaaattgggagaattaccccagataatttagggttagtaactgttttagcaggagaagatttagggcaatatgctcagatgaaagagaagctatttcaggtaattggattcaataaagacgatttagcctattcttattttgatttaagtgaagaagactatcaaaatgcggaattagacttagaaagtttaccttttttatcagactacaaggttgttatttttgatcagtttcaagatattacaactgataaaaaaacttatttagatgaacaagcaatgaagcgctttgaagcctacttgcagaatcctgtagatactacgagacttgttatttgtgctccaggaaaacttgatggaaaacgtcgacttgtaaagttattgaaacgtgatgctcgtgttttagaggctaatactttaaaagaatcagatttaaagacgtattttcaaaaatatgctcaccaagaaggattagtttttgaagcaggtgtttttgatgagttattgattaagtctaactatgattttagtgatactttaacgaatatcgctttcttaaagtcatataaaacagacggtcatatttcgtccaatgatgttagagaggctatccctaaaagcctgcaagataatatatttgatttgactcaagatgtcttacttggcaggatagatttagcgcgtgatttagtaagagatttacgtctacaaggcgaagacgaaatcaaattgattgcaatcatgttaggacagtttcggatgtttttgcaagttaaaatattggctagtaaagggaagtcagagagtcaaattgtttctgaactatcccattacataggacgtaaaatcaacccttatcaagtaaaatttgctgtcagagattctagaaaccttccccttgcttttttaaaagaagcgattaggattttaatcgagactgactatgctattaaaagagggacttatgataaggattatctctttgatttagccttattaaaaattgctcataaaaagccctaattaaagaaacaaaagagttgaaagctgttccaaattcctatagaataagggtaataatagatgaaaagaggatttcgacatggcaattattttaccagatttaccctatgcatatgatgcgcttgagccacatattgatgctgagacaatgacactacatcatgataagcaccatgcaacttatgttgctaatgcaaatgctgctcttgagaaacatcctgaaattggagaagacttagaggcgctcttagctgatgtttctcaaattccagaagatattcgtcaggcagtcatcaataacggtggtggacatcttaaccacgctcttttctgggaattgatgtcaccagaagaaactcaaatttcacaagagttatctgaagacattaatgcaacttttggttcatttgaagactttaaagctgctttcacagcagcagcaacaggacgttttggttcaggttgggcttggcttgttgttaatgctgaaggcaaacttgaagtgctttcaactgccaatcaagatactccaattatggaaggcaagaaacctattttagggcttgatgtatgggagcatgcttattacttaaactatcgtaatgttcgtcctaactacatcaaagctttctttgaaattattaactggaataaagtaaatgaactttaccaagctgctaaagcttaataaaaaacgagtcgataggctcgtttttttattattctaaaagttgataatgttttttaaaagtctagaagtccaaactcagataaaactagaatagtcctattatcttcaactaagcgaataagtttattgaaagcgcttgacaagattagtaagaaatgataaaattaagacgttttcaggtgttattatttaaggtaagcaagctgataacagataaaattgcataataaaggatgttatcacattttgtgagcagggacctattcaacgacgactttttgttgtgtcttggatgggtcattttttattgtgcgagtgaaggactaggactttaatgattataaaacgcgtattaaatcataatgcagtcatatcagtaacacatcaaggattagatgtgctactgatggggaaaggaattgcatttaagaaaagaataggtgataggattaatagcgatgctattgagaagtcatttgttttaaaaaatagtgataacatgaaccgttttacggagttatttattactgttccagaagaagtagttgcatgttcagaacgaattatcaacctaggtaaaatcaaattgggtaagaacttagatgaaattctttatatcaatttgacagatcatattcattcggctattgaaagacatgaacaaggaatggttatccaaaatccactaaggttggaaatccaacgttactatcctgatgaatactccattgggatgaaggctctggaacttataaaggatgaattgggcatttgtttaacaatcgatgagtcggcttttattgctatgcactttgtaaatgctggattggataatccgtttaatgaagcgcataaaatcactgagattgtatcttacattgaacagaaagtaaaaatagattttcgaacagaactagatgaaagttcaattgattattatcgtttcatgacacataccaaattatttgctcaacgcgttttatcaggaatgaaatacgaagatgatgatgctgatttacttttggtagttaagaaaaaatatccgagagaatataaatgtgttaaagagatcggcaacaatatggctatccaataccaatatcaacttaattcaagtgaactcctatatctgacggtgcatgttaaacgattagttaaaaatttaaaggagatatcagatgactaaataccaagagactgctaaagctattttagcagcagtagggggagaaaaaaatattcaacacgtaacccactgtgtgacacgattacgattagttttagacaatgatgaaattgtcaacgatcaggttattaaaactattccgaatgttatcggtgttatgcgtaaaaatgatcaataccaaattattttgggaaatgatgtcaataattattataatgcttttttggccttaggtcattttgaaaatactaccagagaattttcatcacaaaaaaagagttcaatacttgagaaattaattgaaacgattgcaggagtcattacgccgcttatacctgctcttctaggaggagggatgctcaaggttataggtattttgctccctatgctcggtatagcaagctctagttctcaaacagtagcttttatcaatttttttggtgatgccgcttattattttatgccaataatgattgcttattcagctgcgtcacgatttaaagttacacctgtattagctgctacagtaggagggattctcttacaccctgcttttgtgacaatggtagctgaaggaaaaccattatctttatttggagctccggttacactggctagttatggttcttctgttattccaatcttaattatggtttttcttatgcaatatattgagagatggattaataaaattgttcctagtgtaatgaagagttttttacaaccgactttgattattctcatttctggctttttagctttagtggtcgtggggccactgggggtaattattggtaaaggattgtctagtgcaatgctttcgatttaccatgtggcgccatggttagctttatctattcttggtgctattatgccattggttgttatgacaggaatgcactgggcatttgctccaatatttttagctgcttctgttgcgacaccagatgttttgattttaccagcaatgttagcttctaatttagctcaaggtgcggcttctcttgctgttgcagttaaggctaaacaaaaacaaacacgtcaggtggcctttgcagcaggtttatcagcactactagctggtatcacagaacctgcactttatggtgtcacactgaaattcaagaagcctttatacgctgcaatgatatcaggtggtttagtaggagcttatattggattagttaatattgcttcctatacatttgtagtaccatctattattggtttgccacaatatatcaatccacaggggggcaataatttcagtaatgctgttattgcagcaatagctactattattttgactttcattattacatggttcttgggaattgatgaaggagaaaacgaaaaaagtagtattaatgctcaagagcacacacatattagaagtggtttatcaaaaaaagagacattgtattcacctatggtaggcaatgtattacctttatctaaagtacccgatgaaacattttcatctaaattactaggtgaaggtttagcaatcactcctagtgtgggtgaagtttatgcaccatttgatggtgaaattataagtttatttcctacaaaacatgccattgccttaaaggatgataagggagtcgaagtgttaatccatattggaatagatactgtagaactaaatggagaaggttttgaacaattggtcaaagttggcgattttgttaaacgaggacagttacttttgcgaatggatattgattttattagttcaaaggggtattctcttattagtccggttgtagttacaaattcaattgaccaacttgaaattatcgttaaagacgcagagacaatggttacaaatgaagatgatttacttgtaattctttaaaaggaaggatgataatatgacggtttttcctaaacattttctatggggaggtgcagttgctgccaatcaggtagagggtgcatttagaacagatggcaaaggtttatctgtacaagatgtacttccaaatggtggtttaggcgatttcaccgccaaacctactccagacaatttgaagctagaagcaattgatttttatcataactataaaaatgatataaaactgtttgcagagatgggctttaaagtttttagaacctctattgcctggtctcgaatttttccaaatggtgatgatagtgctccaaacgaagctggcttacaattttatgataatttatttgatgagttgcttaaatataatatcgagcccttggttaccttatctcattatgaaacaccgcttcatcttgcaaaaacttataatggttgggctgatagacgtttgatagcattttttgagaaatttgctcaaacagtcatggagcgttataaagataaggtgaaatattggttgacttttaatgaagtgaattctattttacatatgcctttcaccagtggtgctattatgaccgacaaatcacaactaagtcctcaggagctttatcaagctattcatcatgaattagtagcatcggctagagtgacaaaattagggcgttctatcaatcctaattttaaaattggctgtatgattctggctatgccagcttatcctatgacatctgatccaagagatgtcctggctgcaagacaatttgaacaacataatctgctattttcagatatacatgtcagaggtaaatatcccacttatattcagtcctatttcaaaaataatggtattaaaattaaatttgaagaaggagatgaggaagtattggcacaaaatacagtagattttctatcgtttagttactatatgagcgtgacacaagcttatgactttgaaaattatcaaagtggtcagggaaatatccttggaggcctaactaatcctcatttaacaacttcagaatggggatggcaaatcgatcccatcgggctacgcctagtcttaaatcagtattatgaacgttatcagattccgttgtttattgtagaaaatggattgggagcaaaagatcaattgatagaaacactagacggtgattatactgtcgaagatgattatcgtattgattatatgaatcaacatttagttcaagttgctaaagctattgaagatggtgttgaaataatgggatatacatcttgggggtgtattgattgtgtatccatgtctacagctcaactaagtaaacgttatggtctaatatatgttgatcgaaatgatgatggaacagggagtctacaacgttacaagaagaagtcatttggttggtaccaaaaagtgattaagacaaatggccaatcattgtttgaacatcataacagataacatgttaaacaactagtctctgtttcaatttaatataaaaaggagtatccataggttactcctttttattataatttatgaaggttaatatcttctgatttaagtgctagatacaataaagttgcatccttaaagtttcttggattgagttgcgttgattcataaatcttatttaacctatattgaacagtatttttatggataaaaagttcctgactacattcttttaatgatagattatgcttaaaatatgagttaagcaagatcttatcattttcagataagtttacaagcgctttatttagcacatattgtttaatattagaatcaatacttgttaataacagttcaagatcaaggtcgtcgacgaggttgaccttttgttgaccttttaaagctttcagggctaagatagacgtttcatatgatctttttaaaagtgataaagatgatttttgtccgataccaactttatagaggcccttttcgcattcaaactttgataggatatttggataataatagtcaaacatatggtcagaaagtaaaagccagtattgattgggataattaaaggtataaatagcagtgtcaagtttatcaaaaaagttcaagagtgacatttcagattgacttaagagtaatttttgtttttgactattgatttcaaaagtgagtagacgatagtcagttttttctgataggtggtattggtttaaaaattgattgaggtaatagtagtctaactctctgccttcaacaagatgatgtaagacaatagaagcttcgttttttcgcccgaaatccagataatctaattcatgctcttttaagatgagtcgagtcattttttgagcaagtaaagcatattttcctacttggttggggtttccactaatcccaatagtagctaataattcacaattataatagaaaggaatattgatccctgcttgtgtcccaaaataagattcttgatctgttacttcaatcatttgtcctgtctgtgctacttttaaaccaatttcatggaattctccaacacgttttggattggtactagcgaaaatgattcctttggtattaataaaattaatatcttgttgacaaacatctttgatagaggtaacgatttgttgtgcgagttgttttcttaatttcattcagcttaccttttgttatatataacaaatatcatatcataaaaacgctaacatttgttctgtagtctatattttttgttatttgattttgttactataattgagtgatataaaatagtgaaaaaaataacaaagattcacaaaatattttcaaggaggttttcaaatgaaggtagtagtagctattgattctttgaaagggagtctttcttctttagaagctggcaatgctataaaggagtcaattaatgaagtaatctcaggggcggatgtggaagtacatccattagcagacgggggagaaggaactgttgaagctttgacgctaggtatggggggtacgatcgaaacaatccctgttaaggggcctcttggagaaaaagtacatgcgagttatggtattattccacagcgtcagttagctattattgaaatggctgcagctgctggtattaccctaattgctactgaagagagaaatcctctccacacaaccacttatggagttggagaaatgataaaggatgctataagtaaaggctgtaggcactttattattggtattggaggtagtgctactaatgatggtggggcaggtatgctacaagctttgggatatgcattattagataaagataatcaagaaatcagtttgggagcacaaggattggcagatttaaaatctatctctactgataaggttattgaggaattaaaagaatgtgattttaaaattgcatgtgatgtaacaaatcctttatgtggtgctcaaggttgtagttcgatttttggaccgcaaaaaggtgctgatgaagatatgattacaaaaatggatacttggttaagtaattatgctaccttagctacttcagttagtgaaaaagcagatgcaactattgaaggaacaggtgcagcgggtgggcttggatttgcctttttagcctttacaaatgctaccttagaacctggtattgatattattctatcagaaattaatatagaaaaagcgatttctgaagctgatttagtagttactggtgaaggtcgtttggatgggcaaacggtgatgggaaaagctccaattggcgtagcaaaattagctaaaaaatatggtaagaaagtagtggcattttctggatctgtcaccgaagatgctatactttgtaatcaacatggtattgatgctttttttccaatcgtacgacgccttatcagcttagatgaggctatgtctaaagaggtagcttataaaaatatgaaagaaactgctactcaagtctttagattaatcaatttgtataatcattaatattgaaaggaattttgataagttatggaagctacatttacaacaacaggggctttaataggattagcgcttgctattttactgattatcaaaaaagttcatcctgcctatagtctcattcttggagcattagttggtggtttgattggtggcggtgatttagttacaattgtcaatacaatggtattaggtgcgcaagggatgatgtcatccatattacgcattttaacatcagggattttagcgggtgctttaattaaaaccggatcagctgaaaaaattgcagaaagtatcattaaaaaattaggacaacagcgagccatcacagctttagccatcgcaacaatgattatttgtgcagtaggtgtctttattgatattgcagttattacagttgctccgattgcattagcaataggtaaaaaagctaatctttctaaatctagcatactgttagcaatgattggtggtggtaaggctgggaatattatctcacccaatcctaatacaattgctgcttcagaagcatttaaggttgatttaacaagcttaatggtacaaaatattattcctgcaattgcagctttagtagttacgattatattagcaaagattgtttccaagaaaaataacgatatttcttatgatagtgaggagcaagtgggctctgatctgccagcattcttaccggctatttctggtccacttgtggttatctgcttattagctcttcgtcctttatttggaatcactattgatcccttgattgcactgccgttgggtggtctaattagtattttagcaacaggttacctaaaagaaacggtaccgtttgttgaatacggtttatcaaaagttgttggcgtttcaattcttttgattggaacaggtacgctctcaggtattattaaagcatctaatctacaatttgatatgattcatctccttgaatttttaaatatgccgacctttatccttgccccactctcaggtatttttatgggagcagcaacagcatcaacgacttctggaacaactattgcttcacaaacgtttgctgaaaccttgattaaatcaggggtaccggcggtttcgggtgcagctatgattcacgcaggtgcgactgttttggattcgctacctcatggatccttcttccatgcgacaggcggagctgtcaatatggctataaaagatcgtatgaaactaattagctatgaagctttgattggattaactagcacaatagttgctgtcgtttactattgtttctttgggtaaaatttggatgaatacgtgatgtttattatcactgtttgaatagaattctcattgattttttctaattttcttactataataaattagtaggagaggtgttgtgaaacaaacaaagaaagaatttattttaggattaaccattattattacccttactttattaatcatgctgatttttttagtaatgtttaataagtccagtaactctaagttgaagcagacaaaagatagaagaatatcatctacttcaaccacaaggacatccagtagctcacatgatcaaaaaattgtagaaaagtctcttgaaaaaaagaaaatggtcatggaacaagatatggaattgatgaatgcctataggctctattatgattatgcccatttgtccttgaaagaggttgttctggcctatatgtctgaatatggcattgaaaaaaatagtgttgctttttcttataaaaatttaaaaacaggacaaagggacgctatgaatgatactcaggctatgacagcagggagcacctataagttacctcttaacatgttggtagtagatgcagtggtcaagggcaagttgtccatggaagaacgctttgatattaccgagactgactatgaatatattggtgaacataataattatgttgctgctttctcgggggcaatgtctattgatgatatgcaaaaatactctttagtttattcagaaaatacacccgcctatgctttagctgagcgtattggtggcatggatagtgcttattcaaagtttggtcgttatggccaatctaaaggagacatcaaaaatatacaaaaaaacggtaataaagtgacaacagattactatattcaagtgctagactatctctggaaacatcgtaaaaagtatgatagtttaattacttatttagaagaagcttttccaacagattattatcgtgctttgataccatctgatgttgttgttgctcaaaagccagggtatgtccgtgaggcgttgaatgttggagcaattgtcaaagaagaagtgccttatattgttgctatttatactgcaggtttaggtggctctactcaggaagattcagaaattaatggagtgggactatatcagctagaacaattatgttttgttattaatcaatggcatcgtgttaatatgaattagaaataaatctatcaaaataataaaaacctcttagattaactatctaagaggtttttataaatgtgattttataacttggttaagtgaagaaagggcagaaacagttttttgataagattcaggactaatttctgagaaaaaatacccgcacgattgcaccgcattgacaacggcatcttgtgactcaatacctttgttacttagatgaataatgagttgccttttatcatctcttggtttttctcgtacaatccacccacgattttccatacgctttaaaactggagttagggtattcgaattaagagatagtgcataactaagttccttcatatgccgatgatcctcttcccaaaggactaacaagataacgtattggagataagtcaattgaaattcatccaaagctttttggtaaaatttattgaaaagtcgatgtgtttcactaaccgtaaaacataatcgctcgtctaaaatacttcgattactcattatcatattgtagcattttggaggcgttatagtatgtcaatcgtgttaaaaaatgataaaactttttcctaattgaaagcctattcttacttaacaaacatagcatcaccaaagctgaagaaacgatatcgttcttcaactgcatggttgtaagcttctagtacaaaatcacgtccagcaaatgctgatactaacatgacaagagtagactttggtaagtgaaagttggttgaaaaagcgtctacaaccttgaactgataaccaggcttgataaaaatatttgtccaccctgagtcggcttttaattcaccattgaatttagaaccgattgtctctaatgtgcgaatagaagttgtaccaacagctacaatacgtccaccagattctttaactgcattgagagtatcagcagcttctttagataattggtaaaactcagaatgcatttcgtgttcatcaagattatcaactgaaacaggacggaaagttccaagtccaacgtgaagcgtcaaatagacaagcttcacaccttttgtttcaattttttccaatagttcttttgtaaaatggagaccggctgttggtgcagcagcagaaccattttcttttgcatacacagtctgatagcggtcacgatcttctagtttttcatgaatatatggcggaagtggcatttcgcccaaactttcaaggacttctagaaaaataccatcatatgagaattctacaatacgcccaccatgttctaattcctttgtgactgttgctattaaccgaccatcaccaaatgaaactttggtccctactcgtaagcgtttagcgggtttagcaagcacttcccattgatcgccttctgtatttttgagaagtaataactctacatggccgtgtgtatcttgcttttcaccataaaggcgagcgggcagaacacgtgtgttattcattactaaagcatcaccaggcttgagttcatctaagatatgatcgaaatggctatctgtcatcgtcttattcttatgatcaatgactaataatttagaagcgtctcttttttcaagtggtgtttgggcaatgagttcttctggtaaataaaaatcaaaatcgtttgtattcatgatttctcctatctataagtaagcttttctattatatcacgttcagtaaaaatgacccaactaatctttttatttagaatgattataaaaaataattgtaatcattctaaataagtgatataataattgtcagaaagtgagaagtagagaagatgaaagaagcaaaaaatttttcccaacaattgaatattttaagagctggtgttcttggtgctaatgatggtatcatctctgtagctggtgttgttattggtgttgcgagtgcaactcataacctttggattatttttttatcagcagcttccgcgattttagctggtgcattttctatggctggcggggagtatgttagtgtttctactcaaaaagatactgaacaagcagcagttgcgcgtgaagagaaactactagaaaataatccagaacttgccaaaaaatccttagttgatatctacttagcaaaaggagaaagtcacgaacatgctcaatggctagttgacaaggctttttcaaagaatgctattgagcatttagttgaagaaaaatatggtattgagttcggtgaatatacaagcccctggcatgctgctatatctagttttatagcttttgccatcggatcaatttttccaactataactattctgttattgccattttcggtacgaattgtaggaacggtaataattgttattgtttcactattatcaactggttatgtaagtgctaagttaggtcaagctcctacagtacctgccatgcgtcgaaatgtgatgattggttgtttgacaatgttggcaacctacgtcattggacaattattttcaatataaaatattaatcgtggagttattgtctaaactagaatggacagtaattctttttagttttataacgaaattaagaagtttttattgacaaaaattggtatataccatataatataatcataaaggtctataccaaataaaaggagagtaaacatgagagttattacagttaagaacgacattgaggggggaaaaattgcatttactcttttagaagagaaaatgaaagctggtgctcaaactttaggattggcaacaggaagtagcccaatcaccttttacgaagagattgtaaaaagtaatcttgatttttcaaatatggtttctattaaccttgatgaatatgttggaattgccgcaagtaatgatcaaagttactcttattttatgcataaacatctttttgatgctaaacctttcaaggaaaataaccttccaaacggcttggctaaagatttgaaagaagaaataaaacgatacgatgctgtcataaatgctaatccaattgattttcaaatccttggaattggtcgtaacggtcatattggttttaatgaaccaggtacaccttttgatattacaacacatgtggttgatttagctccaagtacaattgaagctaatagtcgtttctttaatagtattgatgatgtaccaaagcaagccttatcaatgggtataggctctattatgaaatcaaaaacaatcgtattagtggcgtatggtattgaaaaagcagaagcgattgcaagtatgattaaaggacctatcacagaagatatgccagcaagtatcctccaaaaacatgatgatgttgtgattattgtggatgaagcagcggcatcaaagttgtaaagtaaataataaaaaagtaaggatgaatctcaatgagaaaaaattcattcttacttttttattatgctttattaaattgtccagtctaagttaggtccagctggaataataccagtagggttaatggttttatggctaccgtaatagtgttttttgatatgatcaaaattaactgtctcagcaattccaggtaggttgtaaatacgttttgtataatgccataaatgtgggtaatcatgtagcgcttttaaattacatttaaaatgaccataataaacggtgtcaaagcgaactaaagttgtgaaaaggcgaatatcagcttcggtaaattgttctccaacaagataatggttatcagataagtgtttttctaactgatctaaagctgtgaataaggtttcaacttccttttgataaacgttctgagaagtggcaaaaccagctttatagacaccattatttatttttggataaataaaattattcatttcgtcaatttgtccttgtaaggaatcgggatagtaatcgtcagtatttccagtaatatgattaaatgcagtatttaacatacgcataatttcagatgattcattgttaacgattgtatggaattttttatcccaaagaacagggactgtcacgcgtcctgtataatcactttgacttgcttgatagatttggtaaaggtattggctttggttaatcatatcaggaataacgcctttatattcttgaaaagtccaaccattctccaacattaaagggttaacaatggagatagagatatgagattctagatttttaagctttctcatgattaatacacgtgatgcccaagggcaagctagtgaaacgtagagatgatatcgtccagattctgctttaaaacctgcatccccactaggccctgctgaaccatctttagtaacccaatgacggaattgtgtaacggttcggacgaatttaccaccagttgatgcagtatcataccattgatcaacccatttgccatctactaaaagtcccatgataatctcctttgtttttctattactaattagtagtataaagattttaaaaagaattagcaaatgtttaacttacagtatggtaaactaagggtatgcgtttagataaattattaggtcaggcaggatttgggtctagaaatcaggttaagaaattaatttgttctaggcaagtttctgtagatggtcaaattgttacaaaggataatgttattgtagatagtggtctacaatcgatttttgtaggaaaagagagggtctgcctaaaagaaagttcttattaccttctttataagccatcaggagttgtttcagcagttagagattcagaacataaaacagtcatagacttaattagcgaaaaagataaggtggagggattgtatccgattggtcgtctagatcgtgatacggaagggcttttaatagtcacgaataatggtccactgggttaccgaatgttacatccaaaacaccacgttgcaaaaacatattatgttgaagtaaatggtttcttggaaagagatgctattaccttttttgaagaaggagttgtatttgacgatggaacaaagtgtaaaccagctgaattaacgattgatacggctaataatgacaaaagtaccgcaagaataactatcacagaagggaaatttcaccaagtaaaaaagatgtttcttgcatatggcgttaaagttatatacttgaggcgtatttcttttggtgacttgaggcttgatatgaatttgaaaccaggtcagtatcgtagattgagagattcagaggcagctatcttaaaaaggtatttagattagtgaaacgactcacttgaccttgcttagtattcttcatatacttataagtgattattttaaaggagaaaaccattgaattcaaaactttcattgaaattgactattttatcgatttctatctttttgatgtctcatttagcaattgctcctgcaattcctaaattgtatgccttttaccatactcaaaaccctcatattggactagcttcagtagagagtttagttactattccagctatgatgattactatttttgttattttgagtaattttgtagtcacaaaacttggcaaaaaaaacacggtcttacttggtttatgtttaatcttaatgtctgggtttatctcattttttacaagtaatttttcacttgcgatggctagtcgactacttttgggtattggtattggtctctataattcgctatcaattagtatcataacggatttatatgaggctgatgagagagccagtatgattggtcttagaacagcatcactcaatatcggtaaagccttaactacatttattgttggattggttttagctattggtgtgaattatatttatttggtttaccttctggttattcctgttttctttttcttttggaaaaatgttccagaggttgaaaatcaaacacatacccttaaagctagtacaacatttgatactaaagcggctttgttgatgctcatcacgttcttagtaggtattgcttatataggagcaactgtcaaaattccaaccttactagtgacaaaatatcactacgcgacgagcttctctagtaatatgttaactctccttgcttttagtggtattttagttggatctgtatttggaaaattagttaaagtattccaagagaagacgctattaatcatgattctagctatgggaataggtaatgtgctatttgctttagctaataatcagatcatttttatcgtagctagtattttaataggagctagttttgttggcaccatgtcttctgtattcttttatatttcaaaaaactatgcaaaagaacataataactttatcacaagccttgccttaacagctggtaatataggagttattttgacaccgcttattttaacgaaacttccaagccagctacatctggaaccttttatgacaccatttttaataacaagtgggctgatggtgattaatgtctttgtttacctagttttaatgtcaaaaaataaataaaaagttatccgaaaggataacttttttcgaatagtaaaagtaggagaaaaaatgttaattgctaaagacaaacaaggaaatttaattaatctactcgagtctcatccgggaaagggacagtatttttgtccaacttgttgttcagctgtaaggttaaaggcaggtcgaatcatgagaagacactttgcacatattagtctaaaaaattgtcagttttatcatgaaaatgagtctaatgagcacttgcaattaaaagcaaagttatatatgagtttaagtagagagaatgaaactatgctcgagcatcatttgccagaaattaatcagattgcagatttatttgtgaatgagacattggctttagaagttcagtgtagccgactatcagagcagcgactcagggagcgaacaaaagcatatctacaggcagactttcaagtgagatggttactaggggaaaaactctggttaaagcatcgtttaacaaatctacataaacaatttttacaattttctcaaagtatcggatttcatatttgggagttagatttgaggttagaagtactgagactaaaatatttgatttacgaagatttacgcggacatgtctattacttaagtaaaacttgccctcttagtggagacgttctagcatttttgaagtggccataccaatcaaaaaatctaaatttttataaggttaaacaagacagaaatatcagagattatgtgcgtcagcagttacgctatggcaatcaattttggttacgaaaacaagaaaaggcctacctttctggtcagaatctattgacccaagagctaatgatgttttttcctcaaatacagccaccacgtgtagatactgatttttgtcaaataacaaattctctaacatcgttttatcagaattttacaaattattatcaaaaaaataagaataacttagaccaaacactttatccccctgtattttatgataaaatagtcactaagaattaaactggaggatacaaaatgtcagacaatcgctcacatattgaagaaaaataccaatgggatttaactactgtctttgcgactgatgagttatgggaaactgaagtggtagagcttactcaagccatcgataatgcaaagggtttttcaggtcatctgttggactcaagccaatctttattggagatcacggaggttgaattagatttatctcgccgtttagaaaaagtttatgtctatgcttcaatgaaaaatgaccaagacaccactgttgcgaaatatcaagaatttcaagcgaaagcgacagcgctctatgcaaaatttagtgaaacattttcgttttacgagccagaactattgcaactttcagagtctgattaccagtcattccttttagaaatgcctgacttgcaaaaatatgatcatttctttgagaaaatatttgcaaataaacctcatgtcttatctcaaaacgaagaagaattgttagctggtgctagtgagatttttggagcagctggtgagacatttgaaatccttgataatgcagatatggtcttcccagttgtaaaaaatgcaaaaggtgaggaagttgagcttacacatggtaatttcatttcccttatggaatctagcgataggacggttcgaaaagaagcatatcaagctatgtatagcacatatgaacaattccagcatacttacgctaaaacattacaaacaaatgtgaaatctcaaaattttaaggctcgtgtgcatcattatcaatcagcacgccaatcagctctatctgccaattttattccagaagaggtctacgaaactctaattaagacagttaatcatcatttaccgctcttacatcgttatatgaagttgcgtcaaaaagttcttgggctagatgatttgaagatgtatgacgtatatacacccctttctcaaatggatatgagttttacttatgatgaagctctaaaaaaatcagaggaggttctagctatttttggcgaagcatattctgaacgtgttcatcgtgcttttactgaacgttggattgatgtccatgttaacaaaggaaagaggtcaggcgcttattcaggtggatcttatgacactaatgctttcatgcttcttaactggcaagatactttagataatctttatacgctggtgcatgaaactggacatagtctacactcgacgtttactcgtgaaaatcaaccctatgtttatggtgattattctattttcctagctgaaattgcatcaacaacaaatgaaaatatattaacagaaacccttttgaaagaagttaaagatgataaaaatcgctttgcaattctcaatcattatttggacggtttcaaaggaacaatttttaggcaaacacagttcgctgaattcgaacatgccattcatgtagctgatcaggaggggcaagtactaactagcgaatacttaaacaatctttacgctgagcttaatgaaaaatattatggtttgactaaagaagataatcattttattcaatatgaatgggcaagaattccacacttttactacaattattatgttttccaatatgcaaccggcttcgcagcagcaaattatttagcagagcgtattgtaaacggtaatccggaggataaagaggcctacctaaattaccttaaagctgggaattcagattaccctctaaacgtcattgctaaagctggtgttgatatgactagtgcagactatctggatgcagcttttagagtatttgaagagcgtttagtggaactggaaaatcttgtagcaaaaggcgtccataatgattaagttgaaaatatagctattgaagtaaaaccagtcaactagactggtttttgatagtgatcagttattttatagtttgttttgagagtggttttggtaaagttagttagtggaaaactcaataggtggaaatacctacccaagttatgatttttatgagaccaaaactgctattgtcaaaaaagaagggaaataggatgaagaagcttacttttatttgggatttagatgggacattaatagattcgtatgtaccaattatggaagctcttgaagaaacctatcgtcattttggtttaatatttgataaagaattaatccatgaatatattttacaggaatcagtggggaaattattggtaaacctttcagaggaagagcaaatacctcatgaaaaactgaaagcatattttacaaaagaacaagaaagtcgagattctaaaatacatttaatgccatatgcaaaagagattttagaatggaccaaagaacaagatatccccaattttatgtatacacataaaggagcaagtacgcattcagtgttggaaaccttgcagatctctcattattttgatgaaattttaactggtgtttcgggattcgagcgaaaaccacatccacaagggattaattatttagttaaacgatattctttagataaatcaatgacttattacataggagatcgtccactagatttggaggttgctcaaaatgctggtataaaatccataaacttaaggttagagaattccaaagaaaactataatatttcaagtctcaaagatataatatcacttgatttcactcgtttggattaaatcattctcagagttagacattttttgctataataaaaaagttattatttaaaatagaaaagaggagccaaaagtggttcaatcttacagtaaaaatgctaatcataatatgcgtcgtccagtagttaaagaagaaattgttcaatatatgcgtcagcaccaaaaacaaaataatggctgtttagcagagttagaagcatttgctaaacaggaaaatatccctattatacctcatgaaacagcgacttattttcgttttttgatgcaaacattacaacctaagcacattttagaaattggaacagctattggtttttcggcccttttgatggcagaaaacgctcctgaagcaaagataacaacgatcgatcgtaatgaagagatgattgccttggctaaggaaaactttgcaaaatatgataatcacaatcagataacccttttggaaggcgatgctgtggatgtgttacaaacattggataaatcttacgattttgtattcatggattctgctaagtctaaatatatcgtttttttacctcaagtattaaaacatttagatgttggaggagtagttgttttagatgatattttccaaggtggagatattgcaaaacctatcgatgaagtgagaagaggtcagcgaactatctaccgaggtctgcaacgtttatttgactcgactttgcaacatcctgatttaactgctactttggtacctttgggagatggtttattgatgattcgtaaaaatgcagatcatattgtactagaagattaaggcatttttaagaaattatgatataataatggagttaatgacaaaaaggagttataaatcatgaaaacaagatcaaaacttgcagcaggctttttgacacttatgtcagttgccacattagctgcctgctcaggtaaaacatcaaatggaacaaatgttgttacaatgaagggcgacactattacagtctctgatttttatgatcaagtaaaaacatcaaaagctgcacaacaatcaatgcttacattgatcctctcacgtgtttttgatacacagtatggtgataaagtttcagataaaaaagtatcagaagcttataataagacagctaaaggctatggtaattcattttcaagcgcactttcacaagcaggtttgactccggaaggttacaaacaacaaattcgcacaactatgcttgtggaatatgctgtaaaagaagcagctaagaaagaattaacagaagcaaactataaagaagcatataaaaactatactcctgaaacttctgtacaagtaatcaaattggatgcagaagataaagctaaatctgtccttaaagatgtaaaggctgatggagctgattttgcaaagattgcaaaagaaaaaacaacagctactgataagaaagttgagtataaatttgattctgcagggacaaccctccctaaagaagttatgtcagcagcctttaagctagataaaaatggtgtttcagatgtggtttcaacggttgattcaacaacttataaaacaagttactacatcattaaagtaactgataagacagagaaaaaatctgattggaaatcttacaaaaatcgcttaaaagaagttattcttaaggataaaacaagcgatagagccttccaaaataaagtgatttcaaaagccttagaaaaagctaatgttaagattaaagataaagcatttgcaggcatcttatcacaatatgctacaacaagtggttcatcatcacttaaaaaatagttgaccaagtcttaaaaagactgtataattaatactattgagaatgaaatttcaacgattagatacagaaaagtgacggttgctgcgagtcatggataatcagaaaaagatgctactcaatggggtaaaactaaaaataaatgagaatgacaagttcattgaatgaaggtggtaccgcggttttcgcccttcgtaatggacttgtcttttgctatttgtcaactttcgaggaggaagagatatggctacttttcaaattaaagaaaaaatgttttctctaggcggtaaatttactattacagacctgactgggcttccctgttatcacgttgaaggaagtttgttccctctacctaagacttttaaagtctttgacgaagaggaacatctcattagtcagattgagaagaaggttttaagttttttaccaaagtttaatgtgacattagccaatgggaatcatttcacgattaagaaagatttctcatttttgaaacctcattacaccattgaagaccttgatatggaagttaagggaaatttttgggatatggatttccaactcttaaaagacaatcaagttatagcaaacatatctcaacagtggtttcgtatgacttcaacttatcaggtagaagtttacagtgaaacttacaacgatttgacaatttcgcttgtcatagcgatcgactatgtcaaagagttagaaaaaaatgcatcaaactaattttaggagagaataatgaaagaattatcgtctgcacaaatccgccaaatgtggttggatttctggaaatccaaaggacattccgttgagccttcagctaacttggttcctgttaatgacccaacgcttctttggatcaactcaggtgttgcaaccttgaaaaaatattttgatggttcagtgattccagaaaatccacgtattaccaatgcacaaaaatcaattcgtactaatgatattgaaaatgttggtaaaacagcacgtcaccatactatgtttgaaatgcttggtaacttctcaattggagactatttccgtgatgaagctattgagtggggatttgaactcttgacaagtcctgaatggtttgacttccctaaagacaagctctacatgacttattacccagatgacaaggattcatataaccgttggattgcttgtggcgttgaaccaagtcacttggtgccaatcgaggataacttctgggaaatcggtgctggtccttcaggtccagatactgagattttcttcgaccgtggtgaagattttgatccagaaaatattggacttcgtcttttggctgaagatatcgaaaacgatcgttacatcgaaatctggaacattgttctctcacaattcaatgctgacccagccgtaccacgttcagaatacaaagaattgccaaacaaaaacattgatacgggtgcgggtcttgaacgtcttgcagctgttatgcaaggggcaaaaacaaactttgaaactgaccttttcatgcctatcatccgtgaagtagagaaattgtcaggtaaaacttacgatccagatggcgacaacatgagcttcaaggttatcgctgatcacatccgtgcgctttcatttgccatcggtgatggtgcgcttcctggaaatgaaggtcgtggttatgttcttcgtcgtcttctccgtcgtgcggttatgcacggtcgccgtcttggcatcaacgaaactttcctttacaaattggttccgactgttggacaaatcatggaaagctactatccagaagtgcttgaaaaacgtgattttattgagaaaatcgttaaacgtgaggaagaaacatttgctcgtactatcgatgctggtagcggtcacttagattcattgcttgcgcagcttaaggctgaaggtaaagacacacttgaaggtaaagatatcttcaaactttatgatacttatggattcccagttgaattgacagaggaattggcagaagatgcaggctataagattgaccacgaaggctttaagtcagccatgaaagaacaacaagaccgtgcgcgtgcagctgttgttaagggtggttcgatggggatgcaaaatgaaaccctagctggtattgttgaagaatcacgattcgaatacgacacatatagtcttgaatcaagtctttcagtcatcatcgctgacaatgaacgtactgaagcagtttcagaaggtcaagctcttcttgtctttgctcaaacaccattctatgctgaaatgggtggacaggttgctgaccacggtgtcatcaaaaatgataagggtgacacagttgctgaggttgttgatgttcaaaaagcaccaaatggtcaacctctacacactgtaaacgttttggcatcactttcagttggaacaaactacacacttgaaatcaacaaagagcgtcgtttggctgttgagaaaaaccacacagcaactcacttgctccatgcagctcttcacaatgttatcggtgaacacgcaactcaggctggttcattgaacgaagaagaattcttgcgctttgattttactcactttgaagcagtaagcaatgaggaacttcgtcacattgaacaagaagttaatgagcaaatttggaacgatcttacgatcacaacgactgaaactgacgttgaaaccgcaaaagagatgggagcaatggcactttttggtgagaaatatggtaaagtggttcgtgtggttcaaattggtaattattctgttgaactttgcggtggaactcacttaaataattcttcagaaatcggtctcttcaagattgtcaaagaagaaggtattggttcaggtactcgtcgtattattgcagttactggtagacaagcttttgaagcttatcgtaaccaagaggatgcactaaaagagatcgctgctactgtaaaagctccgcaattgaaagatgcagcagctaaagtacaagctcttagcgactcacttcgtgatcttcaaaaagaaaatgtagagcttaaagaaaaagcagcagctgcagcagctggtgatgtctttaaagatattcaagaagctaagggcgtgcgcttcattgctagtcaagttgatgttgcagacgcaggtgcacttcgtacatttgctgataactggaaacaaaaagactactctgatgtgcttgttctcgtagcagctattggtgagaaggttaatgtccttgttgcaagcaaaactaaagatgtccacgctggtaacatgatcaaaggattggcaccaattgtagcaggtcgtggtggtggtaaaccagacatggctatggcaggtggtagcgatgcaagtaaaattgcagagttgctagcagcagttgcagaaaatttataagaaacacctctcatttagttagtaaataaaacagacaaagggcagaacatcgttctgttcctttgtgtatataggagaaatatggttggtttaggaacagttatcaatgttattcttattatagttggaggctttgtaggtttatttttgaaaaattttttgaaagaatcacttcaaaagagccttatgcaagccatgggagttgcagttttatttatttcgatatcaggtgttttggagaaaatgatgttagtcgaaaagtcacatctcatctctaatcatacaaatatgatgattattactcttgctctaggtacggtacttggagagttgctatcactagattcgtatattgataaatttgggaactatcttaagcaaaaaacaggaagtggtaacgatattaaatttgtggaggcattcgtcacctcaacttgtaccgtttgtattggagcaatggccgttgttggtagcattcaagatggtatagcagcagatcattcgattttatttgctaagggaatgttagacatgattattattgcaattatgacagtgtctttagggaaaggagctctattttctgcacttcctgtcgctttactacaaggtagccttacgattgttgcttttttcatggggagtctacttaatccatcatctttagattaccttaacttagtaggaaatatgcttatattctgtgtcggtgttaatttactctttaacctaaatattaaagttatcaatatgttgccagcaattattttagctatattatggggaagttttatataaaagataaccaagttttaactcaaacttggtttttctttagacatatgttaggatgaaagaagatatactacggagaggatccaactcatgaatctattattttctattgatgatatgtacgtagatcattttaaagtgatgctttattcgcttgtccgacaaaccaagaatcgtaagttagagatatatgtcttacaaaaaacattactcaaacgtcatacagaacttattcaatatactcaaaatttagaagttggctatcatccaataattgtaggtaccgaagtatttgctcaggcacctacaactgatcgctatccagatacaatatattatcgacttttggctcataaatttttacctgagaccttagataggatactttatttagatgcagatatgctttgcttaaatgatttctcaagtttatatgatatggagttaggtgatcaactatatgcagcggcaagtcataatactgatggtaagtttctagattatgtcaataaattacggttaaaaaatgtagagctagaatcctcttatttcaatacaggggtactcttgatgaacttgcctgctatacgaaaagttgttcatcaacaaactatcttagattacataatgcaaaaccgtggtcgtctaatcttaccagatcaggatatcttaaatggcttatacgctaatttggttaaaccaatacctgatgaaatttataattatgatgctaggtatagtcttatttatcaattaaaaagtcgcaatgaatgggatttagagtgggttattaaccatactgtttttttacattttgcaggacgagataaaccatggaaaaaagattatagaggacgttactcgggcctttataagtttatggctaaagaggctttaactaaaaattgaagatttaaaaggttactaaattatttctatttagtaactttttttggggtgatattttaatgatatcaataatctttgctaataattatttataaaaaagaaaaataatatcaaaggaggagcgtgttaaaatcacttaatcattgaacaatcaaattaatcattgtttcaaaagcataatggttttaggagttactcaaatgaaaaaggaatttattattacaggtcggatggttgcaagagttatggaaaccctagtttgcttatgtatggtaagtaatcttgttcttgatatgcttgatataatagaaataaatgaaattgtattttgtgtgttggtagcatcaattgcagggcttgagttttgtttgcaaaaagaaagggagtagatagatggaattgtttggcttaatggctttttatggtcatgacgtatattggtgtacctaaagagcaaaaggcactcagtcgtaggggtaaacaattagaaaaaataaatcagggaggaaaaacacttatgtcacaaatgattcaagatttagtaggaagcacatgtatgatttatttagaggatggttctcaaactcatccttatgagattttaaaggtagatgaggattgggtacagattcgtcgcaacttgaaacgaagtaaagaggaggtgcgtattgtccgtattcatgatatcaaggaattgcgtccagtcaataaatagagcgaggaataaatctatatatcattttataaaggagaaaaatgatgggattaattttaaaaaatagactcaaagaattgcgtgcacgagatggtatcaatcaaacagaactcgctaaattaacaggagtctcaagacaaacaattagcctaattgaacgcggagaatatacgccatctgttattattgctatgaagatttctcaagtatttaaagaatccctagagaatgtttttagtttagtgtcaatggaggaataatgatgaaaaattttataaaacaaagtgatactacatttgttcgaattatcaaaagtcttttaattggtggttttataggggccatacttggttccgtaggagctctttttatcatatttggtcaagataagtacttatctgaaattaatattgttcaatatttcctatgggttagtcgtattgttgtaattataacagctctctttagtctcatctacctctatcagattcaaaaatatcagaaagtttttttcaatgttgatgaaagtcaatctgaagaaatttatcgccagattaatttaagacattcttatgggatgacttttgtgtcaatttcaatagtactcagtatagttaatactttatttaactataaactaaatatttttgatgattcagttactttagttattccaatatatgatttatcactgctatttgttttattgggtttacatatatattttttaaaggtatatcggaatatccgaggtataaaaatgacagtcgctccaactttaaaagagttgaaaaacaatgtcttacaattggacgaagcagagttggaatcaaattataagatgtgttttgatattgtcatgaatttaagtggttttattttccctacgatctattttgtattattctttatctcatttgtttttcaaaaagtggagattgtagcaattattataacaacatctattcatatctacattctcattaagtctttaaaagcagcacgtcatttttatagatagtagtagctagattttttatcaaaaaacttatattagtgtaaaataaaaggattgattctctgaaaatcagtccttttattttttctatttcttaggtaaaaagaagctagggtagctgataactaaaataataatactaatgactacaaaaaatagagttaacaaaccagcagtaccattgacgcttaatgagtataatgtagcagacataccttttggtgcataactagcccaaaaaataacaccagcgatataatgccaaacataacgaacaagtgttgctaatattgctccagataatgctaatgataaagctttagttttagagctgctgctaagtgcatctttaaatttagcagaaaatacgcctgcaagtcccatacttataaatgctaagatgtattctataaaaacttgggataaactaaggtaatatactttggaaagaacaaagtgcaataagccccaaattaagccagcaaatagaccgtattttgtaccacgacgtaatgcaaaaagtatcagaggaattgctccaaaagagggagtgaaccatgacgcaaaatcaggaatcattgataaagccatagcaagcgctgcaaaaatagcagtttcaataagacaggtagtgttgttattttttgacataaaaaatctcctttttttatacagcaaaggagattcttttgtcatttgtcatgtttaaccaattcaaaccacaattcctacgctcgtcctaacgagatcaggttagaggattttgcatatctgcaatctcagctcaaggcactcccttgtgtatttactctaacattctatcttgaaagggtttgcttgtcaagaaatttgtatttaactagaaaaagacactaaatcagtgtctttttcttataatccatagttatagtcatcatcatgcatagcttcaacgctaccaagtaggtaaccattacctacttgagagaagaagtcatggtttgatgttcctgttgaaataccattcataacaattgggttgacatcatttgctgtatctgggaataaaggatcttgtcctaaattcataagagctttattagcattgtagcgtaaaaaggtcataacttcttcagtccatcctacgccatcataaagtgtcttggtgtatttttcttcgttttcatacagctgataaaggaggtcatacatccaatcacgaaaattctcttgctcatcttctggtaattcgttaaaaccaagctggaatttgtaaccgatataagtaccatgtacagattcatcacgaataattaatttaatgatttcagcaacatttgctaacttattatttcccaaatagtaaagaggtgtgaaaaagccagaataaaaaaggaaagtttcgaggtaggtggaagccacctttttttgaagggcatttccattagcataaatgtcattgataatacgtgctttttcttgaaggaactcattattattagtccactcgaaaatttcttcaatttctgatttagtatttaaagttgagaaaattgaagaataagatttagcgtgaacagattccatgaattgaatattgtttaagacagcttcttcgtgaggcgtgcgaacatcggcacgaatagcttcaacaccagtttctgattgcatggtatcaagtagggttaagcctccaaaaaccttgccaacaagatctttttcttgagcagaaagtttgcgccaatcgtctaagtcatttgataaagggatacgtgtatcgagccaaaattgttcggttagtttttcccaagttgatttatcaataacatcttcaatttcgttccagtttatagcttcgtagtaagttgtcatggttttctccaatggtaaataggtttttatataatgatgatggaagaagagtagaatatagaattctgatctagcaatatttcaagtattatcgatttttagaaaaataaagatgaaaataccttagaaaataagataacatcatgaaactgagatagtttatctcagtctagtttctgatgttttaagtagagtttcttcgttagatgacacaactttcgcattgattagctccgacttcgctaccatcatctgtaaaagtacggatatagtagattgatttcacacctttgttgaaagcatagttgcgtaggattgaaaggtcgcgagtagtctgcttactttctgttttccactcgtacaactcctttggtaattcgcttcgtaaaaagagtgtcattgagagaccttggtctacgtgctcagttgctgcggcatagacgtctattactttacgcatatccatatcataggcagaagtgtaataagggatagtatctgtagctaagccattagctggataataaattttcccgatttttttctcttgacgctcttcaatacgttgtgtaatagggtggatagatgctgaacaatcgttgatatacgaaatagaaccattcggagcaactgcaagccgattttgatgatatagtccgtctttcataactgcgtatctaaggttttcccaatctttagcttcggggataaaatgattagcaaatagggattttactttgtcagattgtggaacaaattttccagatacatatttatcaaagtatgtaccgtcagcgtattttgatttttcaaaacctacaaatgttgtttgacgttcgcgggcaatattgtttgattctactaaggtccagtagttcattagcatgaaataaatatcagtaaattcaattgattctggactaccatattcgatatgattttttgccaaataggagtggagtcccattgctccaagtccaaatgtatgtgcttgagcatttccgtttttaatagttggaacagcttcaatatttgatgagtcagtaacgaaagttaaagcacgagtcattgttttaattgattttccaaaatcaggagatgtcatcatatttaaaacattagttgagccaaggttacaagaaatatcagttcccatttcaaggtattcttgagcatcattgataagacttggtttttgtacttgcaaaatctcagagcaaagatttgacatgataatttttccatcaacagggttagtacgattagcagtgtcaatattgatgatgtaaggataacctgattcttgttgaagtttagaaatctctgtttctaaatcacgagcattgatttttgttttagtgatattagggttagcgactaattcatcgtatttttcggtaatatcaatatagctgaaaggaacaccatattcacgttcgatactataaggactaaacaagtacatttcttgattgttacgtgctagttcatagaatttatcgggtacagtaatccctaatgacaatgttttaacacgtactttttcatcagcattttcttttttagttgataagaatgaaataatatctggatggaaaacgtcaaggtaaacaactccagcaccttggcgttgtccaagttggttggagtaagaaaaactgtcttcaaataatttcatgactggaacgactccagaagcagcaccagcaaaacctttgataggagctccagcctcacgaaggttactaagtgatattccaaccccaccaccaatacgagataattgaagagctgaattaatcgaacgaccaatagcattcatatcatcagttacttggattaagaaacatgagactaattctccgcgacgacttcgaccagcatttaaaaaacttggtgttgcaggttgatagcgttgtgaaatcatttctagagctaagtcagttgctagttcttcatcaccgtctgcaaaataaagagcgttaaagagaacgcgatcttcaatactttctaaatagtattctccatcatttgtttttaatgcatactgctgataaaacttataggctgccatgaaggatttaaaacgaaactttttatcgaagagtttggtagataattcttcaataaattcaggacgatatttattgaggaaagcttcttcaagataatcatacttaaggaggtaagcaattttatcagtgattgagtcaaaagcttttgaattaggctgtacgttttctttgaaaaaagcagttaaggcttctttatctttatggagtgggatttgtccattaacaggacggttaatttcattatttaggcgaaagtaagatacatcgccaatattttttaaactcattgaatttatcctcttaacttaacaatacaaaatgggaataaagcaattaattgctttattcccagactctaatttgcttaaacaagttcttttagtttgcttggttggaaacctgaaaaaacaacattaccagcttcaatcactggagccgcagaaaagccgagatttttcacatattcaattttttctggtttttcatcaatattaatttcttcaaaatcagcgccgtgctggtcaagaaatttcttagtcattttacattgcatacagttgtttttcgaaaaaacagtaatagctgccatgttgtcctcctaatttttttcatggtaatagcatataaaaaaagaatggaaaaagcaagtgttttatttctaacaaaacacaatatatagtgtcttaaaataaaatgagacactatatttcgttttttagggttagtttaaaagctttcagcctgttttccaattcctttcagaagaacataaaaaaatcatttttagaattctatttttaaattctaagactctcatttttaatatgaaaagctgtggaaaacattcaagtttttttctgtttgagacatttaatcttgaaaaataaaaagcaatatgttatacttttaacttgtaagggttaccaataggtgactcaaatatttacaaatgacaaaaggagaaccataatatggcttcaaaagatttccacattgttgcagaaacaggtattcacgcacgtccagctactttgcttgtccaaacagctagcaaatttgcttcagacatcacgcttgattacaaaggtaaagcagtaaaccttaaatcaatcatgggtgttatgagtcttggtgttggtcaaggtgctgatgttactatttcagcagaaggtgcagatgcagatgatgcaattgcagctatcgaagaaacaatgacaaaagaaggattggcataagaaaatgacagaaatgcttaaaggaatcgcagcctctgatggtgttgcagttgctaaagcatatctacttgtccaaccggatttgtcatttgagactgtaacagtcgaagatacaaacgcagaagaagctcgccttgatgttgcactccaagcttcacaagacgagctttctgttatccgtgagaaggcagtagaaagcttaggcgaagaagccgcagctgtatttgatgctcatttaatggttctttctgacccagaaatgattaatcaaattaaagagactattcgtgcaaaacaagtaaatgcagaaacaggtcttaaagaagtgactgatatgttcatcactatctttgaaggtatggaagataacccatacatgcaagaacgtgcagcagatatccgtgatgttgccaaacgtgtcttagcacatcttttgggtgttaaattaccaaacccagcaactatcaatgaagaatcaatcgttattgcacacgatttgacaccttctgatacagctcaattaaataaacaatttgttaaagcttttgtaacaaatattggagggcgtacaagtcactcagctattatggcacgtacactcgaaatcgcagctgttcttggtacaaatgatattactgaacgtgttcaagatggtcagttgattgctgttaatggtattactggtgaagttatcattgaaccaactgaagctcaaatttcagccttcaaggcagcaggtgaagcttatgccaaacaaaaagctgaatgggcacttcttaaggatgcacaaacagttactgctgatggtaaacattttgaattagctgctaatatcggtacacctaaagatgttgagggtgttaacgaaaatggagcagaagcagttggtctttaccgtacagagttcttatatatggattcacaagatttcccaacagaagatgagcaatatgaagcatataaagcagttcttgagggtatgaatggtaaaccagttgttgttcgtacaatggatatcggtggagataaagagcttccttactttgatcttccaaaagagatgaacccattcttaggattccgtgcattgcgtatttcaatttctgaaactggtgatgcaatgttccgcacacaaatccgagcacttcttcgtgcttcagttcatggacagctacgcatcatgttcccaatggttgctttgcttaaagaattccgtgctgctaaagctatatttgaagaagagaaagcgaacttgttagctgacggtgtagcagtagctgaaggcattgaagttggtattatgattgaaatcccagcggcagctatgcttgcagaccaatttgcaaaagaagttgatttcttctcaattggtactaatgatcttatccaatacacaatggctgcggaccgtatgaatgagcaagtttcatacctctatcaaccatacaatccatcaatccttcgtttgattaacaacgttatcaaagctgctcatgctgaaggtaaatgggcaggtatgtgtggtgagatggccggtgatcaaactgcggttccacttcttgttggtatgggattggatgaattctcaatgtcagcaacctcagtacttcgtacacgtagcttaatgaaaaaattggacacagctaaaatggaagaatacgctaatcgtgctctttcagagtgttcaactatggaagaagttatcgaacttcaaaaagaatacgttgactttgactgagaataataaaaaagtagggattaaaaaatctctacttttttattgaaagtttggatattgttaagtttctaagaaaaatatgtcagataattgaaataaatagataaagtgatagaataaacctattacaatgtaaaaggagatttactttgacaaaagaatatcaaaattatgtcaatggcgaatggaaatcatctgttaatcagattgagattttgtcaccaattgatgattcttcattgggattcgtgccagcgatgactcgagaagaagttgatcatgctatgaaagcgggtcgtgaggctttaccagcctgggctgctttgacagtatatgaacgtgcacaataccttcataaagccgcagacattattgaacgtgataaagaagaaattgctactgttttagcaaaagaaatttctaaagcttacaatgcttcagtaactgaggttgtaaggacagctgatcttattcgttatgcagcagaagaaggaattcgtttatcaacttcagctgacgaaggtggaaaaatggatgcttcaacaggtcataagttggctgttattcgtcgtcaaccagtaggtatcgttttagcaatcgcaccttataattaccctgttaacctctcaggatcaaaaattgcgccagctctaattggtggaaacgttgtgatgtttaaaccaccaacacaaggttcagtctcaggacttgttttagcaaaagcttttgcagaagcaggtcttccagcaggtgtctttaatactattacaggacgcggttctgagattggagattacattgttgagcatgaagaagttaattttattaactttacaggatcaacgccagttggaaaacgtattggtaagttagcaggaatgcgtccaattatgcttgagttgggtggtaaggatgcaggtgtcgtcttagctgatgctgaccttgacaacgctgctaaacaaatcgttgcaggtgcttatgattactccggacaacgctgtacggcaattaagcgtgtacttgtcgttgaagaagttgcagatgaattggcagaaaaaatatctgaaaatgtagcaaaattatcagtaggtgatccatttgataatgcaacggtgacaccggttattgatgataattcagccgactttattgaaagcttagtagtagatgcacgtcaaaaaggtgcgaaagaattgaatgaatttaaacgtgatggtcgtctattaactccaggattgtttgatcatgttactttagatatgaaactagcttgggaagagccttttggaccaattctcccaattattcgtgtcaaggatgcagaagaagctgttgctattgccaacaaatctgattttggattacaatcatcagtctttacacgtgatttccaaaaagcatttgatatagcaaataaacttgaagttggtacagttcacattaacaataagactggacgtggtcctgataatttcccattcttaggactcaaaggatctggtgcaggtgttcaaggtatcagatattcaattgaagcaatgacaaatgtaaaatcgatagtttttgatatgaaatagacgtaaaacgactcaactattgtcagttgagtcgttttataaacctcttttacattaaaaataaagaattatataatcttctaaagtggttttatttttgtgatataattgtcataaaaaataacaaaagagtcattatatgaagaaattaattataggtatttttagtctaattattatagcgattcttgcttggcaaggtttttcgtttttgaaacataaagaaataaaacttcaacaagctgttgttgaaaaagaaattcgcatagccgagaaaacggtagaagtggtgaaaagacagaaaactgaacgtgttctttttcttgaacctaaaggatatgacaaaagtctaagcgctgatattttaaagtggaatcaaaaaagctttgagcataaaaaattttatgacaatcaatacattattctacgtcctcaattagcagattctaactttgcaaatgttaaaaaattatccatttatcaaatcttatatcaaaaagaaaaaggaagtatgtttcaaaaatcaagtcgccttttgagaacctacttacttgatcaaaataagaaaccttttgaattagatgagcttttagctcataatatatctggatttaaggctattttagaaaatatagctccaggaactcaactaaaggaacatgatagcaataaagaatttttaaaaactggaagagtaacagatgggctagatgttaaagatggtaagttaattattaatgatttaaaattaccacttgataaattatataatgtgatcgatgagtcatatttaaaatcaagtgatctagatttagtttctaatttaaaagctaaagcaccacgtgttgcacttacctttgatgatggaccaaatgaaaaaacgactcctaaagccttagaaatccttaaaagatataatgctaaagcgactttctttgtaatgggacaaagtgctgtagggcacacagatattttacaaaggatgcatgctgaaggtcatgagattggtaatcatacatgggatcatcctaatttaaccaaactaccagcggagaaaatcaaggaagagattcataagactaatgatctgattatgaaagcaacaggacaaaaaccggtgtacttacgtcccccttacggagcaacaaatgctactgtaaaaacagtgacaggattgaaagaaatgttgtggtcagttgatacagaagactggaaaaatcataatacacaagcaatgatgaccaatatcaaaaaacaattacgtcctggaggagtgattttgatgcatgatattcaccagacaaccatagatgctctgcctacaattatggattatctgacaacccagggctattattttgttactgtaggtgaattatattcaacgccttaataaaaaaagaaacaagttacttgtttctttttttattttaaatgtaatttttgattgtgaagtacaagttctgtaacggtggcgtattttttaagttgtttgagctcttctttatgtgttacaaatgtaataacacatccctctttccccatacgaccagttcgtccagaacgatgtgtatatgtttctttgtcgcgtgcgatatcaaaattaatcacatattctaggttgtcgatatcaatgccacgagctaccaaatcagttcctaggagtaatgaaatatcatggtttttaaatttctctaagataactttacggaatttaatattaatatcgcttgctaaagaaactgccgaggccctattaaattgtaaacgttcttcacatgcacctaagtctgataagctgttaaaaaagacaagacctctaaaatcaggaatatttgaaaatttacgaagtaggtcagtacgctctcttttatcaactgtaatataataatgttttatagtatcaagtttttgattagatagatcgattgttatagtgttatcggcaagtttactattgtccagtttgttggtggcactaatgtaaatcatttgctgatcacgaggaacgcgattaataatattgtccacaaaatgatattgtgagtcgccgagtaattcatcgaattcatcaaggacgatagtattaatgttcatcatttttattttttttagtttcacaagttcaaatacgcgtccagcagttcctataagaatttctggtcctttttttagtcgctcaatttggcgtttttgactagaacctgaaaggaatagttgtgcggtcagtcctaatggttcagcccattcttttgtaacgtcgaagatttgtccagctaattctgaatttggagctaaaattaagagttgttggctctttttaggttgcaacttaagaagcgttgggaaaaggtatgctagagttttaccagtacctgtagggctaattccaaggatattatcaccatcagtaataggttgaaaaagtttattttgaatatctgttagatcatcaaattgacgctgggttaatttatcctgccattggtctggaaattttgttatcataagaatcctcttgttattttatatattatcattgttattataacatgctttttatttttagagcgttttcaataaaatttagactttaaaaaaaataagtttatagtacaatagatagaggataaatttaatttggagtgacaaatgcgtaaaaaacctattattattggtgttacaggtggatctggtggtggtaaaaccagtgtttctcgggcgattttatcaaatttcccagatcaaaaaattaccatgattgaacatgattcttactataaagatcaaagtcatttaacttttgaagaacgtgtaaaaaccaattatgatcatccccttgcttttgataccaatttgatgattgagcaattgaacgaattgattgagggacgtccggtcgatattccggtttatgattacacaaaacatacccgtagtgatagaactatccgccaagaaccccaggatgtcattattgttgagggaattttggtattagaagatcagcgtttgcgtgatttaatggatatcaaattatttgttgatacagatgatgatattcgtattattcgtcgtattaagcgtgatatggaagagcgcgatagaagtttagatagtattattgaacagtatacagaagttgtaaaacctatgtatcatcaatttatcgaaccaacaaagcgttatgcggatattgtaattccagaaggagtaagtaatattgtcgctattgatttaatcaataccaaagtggctagcatcttaaatgaagcaaaataaacacaatggtttgtgtttatttttttgttttatataggatggttatttagttttagtaactttcaaattatgctataataagtgctatgaacaagtctaagaaaatcgaaaattatcaattattattactacaagcgcaagctctattctcagatgaaacaaatgctcttgccaacttatcaaatgcttcagctatgctaaatgctatgcttccaaattctgtatttacaggcttttatttatttgatggagaagagttaattcttggccctttccagggtggtgtatcatgtgtgcatattactttaggaaaaggtgtttgtggtgaatctgcacaaactgctaagacgctgatcgttgatgatgttacaaagcatgctaactatatctcctgtgattcaaaagctatgagtgaaatcgtagtacctatgtttaaaaatggcaaacttctaggagttctagatttagattcttctttagtagcagattatgatgagattgatcaagaatacttagaaaaatttgtaggtattctagtagaacatacgatttggaatttggatatgtttggagttgaaaagtaatgtatcaggccctttatcggaaatatcgtagccaaacatttgatgaaatggttggacaaagtgttatttcaactactttaaagcaagctgtgtccagcaaaaaaattagccatgcttaccttttttcaggacctaggggaactggaaaaacaagtgctgctaaaatatttgcaaaagcgatgaattgcccaaatcaaattaatggcgaaccttgtaatcattgtgatatttgtcgagatattacaaatggtagtttagaggatgtcattgaaattgatgctgcgtcaaataatggtgtcgatgaaattcgtgatatcagggacaaatcaacttatgctccaagtagggcaacctataaagtttatattattgatgaggttcatatgttgtctacaggtgccttcaatgcactattgaaaacacttgaagagccaacagaaaatgttgtttttatattagcaacaacagaactccataaaatccctgcaacaatcttatctcgtgtccagcgctttgaatttaaagcgattaaattattagctattcgagatcatttagcacagattttagataaagaagctatttcatatgatttggatgctctgacactagtcgctagacgagccgaaggtggtatgcgtgatgctttatcaattctcgatcaagccttgagtttagcgaaagataaccacatttctttagatgtagcagaagaaattacagggagcatttccttatctgctatagatgattatgtatcgaatatattggctcacgatacaactgaagcactcgctaaacttgaagtaatctttgatagtggcaaaagtatgagtcgttttgcaacagatttattgatgtacttaagagatttacttgttgttcaagcaggtggtgaagatagtcattcaagtgatacttttatagccaatcttaatgttaaacaagatattttatttgaaatgattgataaagtgacatctgttcttcctgagataaaaaatggtagccatcctaaagtttatgcagagatgatgaccatccaattgtctgaaatggtagaaaaaaattcgtcaaacatacccgcagatgtgacagcagaattagatagtcttcgtcgagagttaaaatcgttaaaaaacgaaatgagccaactctctcgagcagatcaaagttcatcaactcaaaaagtaaaggttaataataagacattcacatttaaagttgaccgtacaaagattttgaccattatggaagaaacggttgtagatagtcaacgttcacgtgaatacttagaagctttaaagagcgcttggaacgagatattagataatattacggctcaagatagagccttattaatgggatctgaacctgtcttagctaatagcgagaatgctattttggcatttgatgcggcctttaatgctgaacaagctatgaaacgtaccgatctcaatgatatatttggtaatattatgagtaaagcagcaggtttttcacctaatattttagctgtacctagaaatgattttaatcaaattcggagcgattttgcaaagaaaatgaaagctcaaaagacggaaacagaacctgaagttaatcatcaaattccagaagacttttcttatctagcagaacgaatagcaatcgttgaagattaaaacgtaactaaaaatagttgcctgttacaggcaactatttttttgataagttttttaattatttagtagattctgttataatggtgatatgacaaaacgacaatttatttttatggcgcttttatgctcttttgaaacttatttttttaatcaatccgttatggatggctcctggatttttgctattttttggggagttttattacttcgagatcttcaaaaggtgtatgcgatttcaaaattcacaaaagagcttatcaaatctaccaagaagaaagactgatttcgccactgcgaagtgttttcaactgaccatcatctaactcaaccactaaatatcctttatctgtaatatcaatagctttcccagaatacattgtttgaccatccataaagctaacggttctatctaagactagggatttttctctatatacctttaagtgatcctctagtggaatattgaaaaagagattccagatttctgtaatcaattgatttctagttatggtcggttgctctgtaaagagactacctgcgcgcttagttaacgccctagggaactctttgatatagaaattgatacctaatcctataataacattcgttaccaacccactctcaacagaagcgatagcctcggttaaaataccagctatttttttattatctaaataaatatcattgacccacttaatttcaggagtaattcctgttaaccgtgagatagcttttacagcactagaggctaccatgacagtataaggttttatatcttcaatcggtacattaggttgtaataaaagagacatatagatgccgccttgatttgatgtaaagaaaggtctatcaaaacgtcctttagcttttttttgattaggagctaaaaaaaggtgtggagtctttaatttactttctatccccattttagcatctagttgggttgaagcactattattattaagactaaccttaataccaatttcttgttcgagttgttctggtaataatatgtcacctgataccaatcggtagcccttgttagtgacagactcaatctctaggcctaattcttctaacgtttttatacctttccaaatagctgtgcgggaaatattaagttgatttgccatagtttctccgctaataaagttgttattttttgatagtatttgataaattttttcgtaggttttcataaatctagtatagtataaatcgagaaaaaagactaaagaaaatagagatatttttttatttattggtaacttatttcacaaaagatgaaatagtggtacaatagctatatgagtcccgaaaaggtagcctagaggctagttctttgtaactcgacacattttacattttaggggggacatttttatgtcagaacgtaaacttttcacgtctgagtcagtatctgagggacatcctgataagattgctgaccaaatttccgatgcgattttagatgcaattttagagcaagatccagatgcccacgtagcagccgaaacagctgtttatacagggtcggttcatgtatttggcgaaatatcaacgacagcctatgttgatattaaccgagttgtccgtaacacaatcgctgaaattggctatgataaagctgaatatggcttctcagctgaatctgttggagtgcatccgtcactcgttgaacagtcgccagacattgcacagggagtcaatgaagctcttgaggtacgtggttctcttgaacaagatcctttagatttaattggtgcaggtgaccaaggtttgatgtttgggtttgctgttgatgaaacacctgagttaatgccattgccaatttctttagctcatcagttagttaagaaattgacagatctacgtaagtctggggaactcacttatcttcgaccagatgcaaaatctcaagtaacggttgaatatgatgaaaatgatcaaccaattcgtgtggatgcagtagttatttcgacacagcatgatcctaatgtaactaatgaccaactccataaggacgtgattgagaaagttatcaatgaagttattccaagccattatttagatgaccaaacaaaattctttatcaatcctacagggcgctttgttattggaggccctcaaggagattcaggactaacaggtcgtaagattattgtagatacttatggtggttattctcgtcatggtggtggtgcattttcaggtaaagatgctactaaagtagatcgttcagcatcttatgcagctcgttatattgcaaaaaatattgttgcagctgatttagctaaaaaagtagaagtacaacttgcttatgcaattggtgttgcccagcctgtctctgtgcgtgtagatacatttggaacaggtgttatagcagaagcagacctagaggcagctgtacgtcaaatatttgatttgcgaccagcaggcattattaatatgttggacctcaaacgacctatttatcgacaaacagcagcctatgggcatatgggacgtactgatatcgatttgccatgggagcgagttgataaagtccaggccttaaaggattttattgctagcaaataataaaaagcgtaaacgaaagtttacgctttttttgctcatgataatttatagaacatttataaaatcttataataaactggttaagtataggaaatactgcatatttcttgaaaatatggtgtatattgtgaataaaatgatggccaagttaattgaattttcctatcgaaaaatttttcaaaaaaataatttcacactcaaatcatttgattatcaaataaatatagcctttataaaaatattatataagtataaaatgtaaaaaaaataaaaaaatgatatttttatttgatttaaatgtatttaataaaaatacaaagtttctaaaaaaagtaaaaattccatctcgacaaacagcgttagttattataaccgaacattattgtccttaaagcatgaaaacaaaaacaaaagttcgtaatttaattgatttgccatgttactaatcttatgctaatatattatctcgtgataagtttttgatgtaaaaattatcatgaaaaagaaaagagagatggaaatgaaaaaacaatttttaaaatcagcagcgattctatcgctagcagtaacagcagtatctacaagtcagccggtaggggcgatagtgggaaaagatgaaacgaaattaagacagcaacttgggtatattgattcaaaaaaatctggaaagaaaattgatgagagatggggtgaaaaaatttataactatctaagttatgagctcattgaagcaaacgaatggattaaccgaagtgagtttcaggaacctgagtatagaactattttatcagaatttaaagataaaatagatagtattgaatactacttaattaacttaagtaatattgctaaagaagatgcgcatcaaagaaatattcttcaatcattagataaatatgaaaaaagtggaatatataatttagaccaaggtgtttataattatatatatcaagaaattagttcagcgaagcacaagttttcggatggggtagataaaatttatcgtttagatagtactttatttcctttctctgtatggtatgataaacatttagataataatgataactacaaggataataaagattttaaagagtacattgctttattaaatgaaattacacgaaaagcaaggttaggatatcaaattgtaaataaccataaagatggggagcataaagatgaagcagaaatactggatattttaatcagagatataacttttgtttcaaaagatgctcctggatataaatatattccaaataaaagaattgcagcgaaaataattgaagatttagatggaattatcaatgacttttttaagaatacaggaaaagataagccttctcttgaaaagttaaaggacacagaattccataaaaaatatcttaattcaactgaaccgtatagtattgaaactaacttaccttcaaattataaagaattgaaggaaaagcaaataaaaaaattggaatatggatacaaaaagtcttctaaaatttatacgtctgctcattatgcactatatagtgaagaaattgatgctgcaaaagaattgcttcaaaaagtgaagattgcaaaagataattataatgaaattaagtccatgaatctaagcccttcaatttttaatcagtatttacaacttcttcaaatagttataagttcagagataaatctaaaaaaggcactcgataacactgtggatttacccatagaaaataattttaatacattggacattcaatataataaattagacactgctattaagtcacttcgaaaatttgtaactaagtataaacaagaagtaagaaaagctactaagagttattctaaaaaagaattagtaaatgcagagttaacaaaagtaatttctaatgacaatattttattagacatgcaagcaattagttccaattatgggtctactaaaaagtttgtttattcagtcaaaagattaccttacgtcccgcaagtaattatgacaacaacgtctaatgtacttatgcctcaaaagcaagttgaaaaagtgaagctactcaccccatttacaatttctaataaagaagtattgaatcatgactcactagtagaaaatgatgctcaaaaacaaaaagtagaacaggaaaaaactaaatcgctagctcctcaaaaaggggctgtaaaagaacaaactgagcaaaaagtatctggaaatactcaagagatagaaaagaaatctgaaactgtggcaactccacaacaaagttcagttgcgcaaacttctgtccaacagccggctccggttcaatcagttgttcaagaatccaaagcttctcaagaggagattaatgcagcacacgatgctatttcggcgtataaatcaacagtcaatattgctaatacagccggtgtaacaactgcggaaatgaccacgctcattaatactcaaacttctaatctttctgatgttgagaaagctttaggaaataataaggttaataatggtgcagtcaatgtattgagagaagatacagctcgtcttgagaatatgatttggaatcgtgcttaccaagctattgaagaattcaacgtcgctcgtaatacttataataaccaaatcaagacagaaacagttccagttgataatgatattgaagctattttagcaggttctcaagctaaaattagccatttggacaatcgtatcggagcgcgccacatggatcaagcttttgtagctagtttattagaagttactgagatgagtaaatcaatctcatcgcgtataaaagagtagacactgctatcaaggcgatcttaaacttttgtattaaactaacctaaaagatagaaagagactaatatgaaaaaaataacaactttaatcttagctagtagcttattactagttgcaacgacatcggttaaagctgatgataactttgaaatgccaacgcgttatgttaaaatgagtgaaaaatcaaaagcattttatcaaagactacaagaaaaacaacgtaaggcacatactactgtgaagacttttaataattcagaaataaggcatcaactacctcttaaacaagaaaaggctagaaatgatatctacaatttaggcattcttatttctcaggagtctaaagggttcatccaacgtattgataatgcctattctttggaaaatgtctcagatattgttaatgaagctcaggctttgtataaacgtaactatgatttatttgaaaaaatcaaatctacacgtgataaggttcaagtcttacttgcatcgcatcaagataatacagacttaaaaaacttttatgctgagttggacgatatgtatgaacatgtttatctcaatgaaagtagagtggaggcgataaacagaaatatccaaaaatataattagtttctaaactaacaaacattcctaaatataagacataaaaccctactcattgattagtgagtagggttttactgttttaaatagctttctgatcagaatgtaagccttgtcatttcaaaggaactatgttattattcttaagtaaattaaataggacatttggggtgcgtaacagctgagattatacccattgaacttgatgcagttagtactgtcgaagggaaatgtgtgccattacaagttttttgtggtggaaaagggcgtagtgtcttcttagtagacagctagctctagttaatcagataataaactccgtttgcttgcagatggagttttttgttgtcaaaattttttgtaggttgttgccccttatctgtcatagagaaggagttatgatgactaatcataaaacaaaaaaattaacggttttagcaattatgattgctttagatgtttttttaacgcccatttttagaatagaaggcatggcctttatgtctagtgtggttaatattatcgctggagttataatgggaccaatctatgcattagttatggcacttgtaacggcttttattcgtattttaactcaagcaggagtagcatctgttgcacctttagctattctaggagctggtccaggagctttcttagcgggttggttttatcggttttatgcgaaagactggatgtcttgggtgggtgagtttataggaacagggataattggagcacttttatcagctccaattatggtctggttttggacttggacagcggatggaaatcacgaagtgttagctaaagcatctgcagctcaatccatttttctttttatgccaaggtttataggggcgactataattggcggtgttattgctttgttgctacttcagggattaaagcgggttcctgtatttatgacaatacaagcattatttaaaggagaaaaagtaaaatgaaattgagtttaaaagatgtattattgattgctctattagcggttgttctgggcgttgtttactttggagcaggctatatttcaaatgcttttgtaccttttgtaggccctatagcgcatgaagttatttatggtatttggtttgtggcaggtccaatggctctttatatattgaggaaaccaggaaccgctattgtagcagaattgttagctgctttgatagaggttttaattggatcaatttatggaccaagtgtactcgttattggtacccttcaaggtttagggtcagaattaggctttacactatttaggtatcataattacaagttgccagcttttatattgtctgctattttgacatcaatttttagttttgcatggagtttttatgccaatggacttagtgcgttttcattttcatataacattctgatgcttatagtaagaactgtttcatctattattttcttcttattaacaaagaatatatgcgaccaattgcatagaagtggtgtactgaatgcttatgggattcatgaaaggaagtagcctatgctatctgttgaaaaattagcttgcacccatggcgatagtcattatttatttgatgaagtgacttttagtcttaacccaggagaacgaattttaatcagtggctattcagggtgtggtaagagtacattggctcttttactatcagggttaaaagaaagtgggaaaggtcaagttttattaaacggctcattaatagaaccaagcgatgtggggtttctttttcaaaatcctgatttgcaattttgtatggatactgtggcgcatgagttgtattttattttagaaaatttacaaatagaaccggagcaaatgcaagatagaagtgagtttgtattggcacaagttggtttaaaaggatttcagaatcggttgatttatactttatctcaaggtgaaaaacagcgattagcattggcgaccatttttttaaaatctcctaaacttattattttagatgaagcttttgcgaatttggatcaagagagtgccagtcaactattacaattagttcttaattatcaagcaaacaatcaatcaatgctgattgtaatcgatcatttgattacttattatcaagatataatggatcactatttttggttggaaaaacggttgacaagggtcaattttgattatatgctcaatcgtttgaatgtcttcgaattagaaaagaaaagtcataatacaggtgacaaactgttatcaattaaagatttccaagttaaactttcaaaaaacaaattcatctcttaccttgattttgatttagcaagtggggagaggttgtgcttagatggaccaagtggcgtggggaagtctagtttgtttatgggattgttagggctttataggactaaagggaaaaaacaatttactcatagaaagcaaattcctataagctttttatttcaaaatcccttagaccaatttattttttcaacagtttatgacgaaatttttcaggtttgcaaggatagtaacaaagcgagggatattttggaaaccataaatctttgggataagaaacagttttcaccatttcaactaagtcaaggccaacagaggcgattagccattggcagtattttagctagtgatagtaaacttctattattagatgaaccaacttatggacaagatgcctatcacgctaatatgattacaactcttcttttgagttattgtcacaaaaatcattgtggggttatttttactagccatgatcctcacttaaaagagtgttttgcaacacgtttcttggaggtgtcatcttgttcaatttgaaaaactatcatccagctattaccttcctatgtttattaataccaaccttttcgtttagtttcacattgaggttaagaacgtctttgttatttctaattatagtagtaacactgcaatgcttcgtaaaggtttctttaaaaacttgggcgaaggtcaatctgatatcatttgtgatgggactctctttatttctagggacgtatttttggggaaaattaccccatcaattcgtcttagctagtctagtggcctgtcgtccgcttatttttatgaacgtgggtttgttatttcatgcatcacattctaattatgattttatagaatctctttatcaaactttcaaagtgcctagtcattttgcatatggtatttttgcggtctttaatcttctaccattaattaaattacaataccaacgtaatcgactcgcattccgactgaagaatcaggtaacttgggcattatcgcctagactaatattgtcagttttattaaagacgatatattgggtagaacagttagagttagcaatgctttctaaaggttttgaagtgggtaaagagcgaacacatgcttcaacttatcccgttcgttttcgagattatagtttacttggtatgagtattttattgtctataggaatgatttttaaataagtacaattagtttagtaatacaattgtgcatttatatagaatgagcgtgttctgctcatgagatcataacaaaggagattactatgttaaaagataagatgattgctaaaggagcaaaatatatccaatccatctatcaagatccatttattcaaggaattataaaagggcgtttagaccatgacgtaatctgccattatttacaggcagataatatctaccttgggaaatttgctgatatttatgccctgtgcttggcaaaatctgataatttacgagataaacaatttttccttgaacaaattgactttacattaaatcgggagttagcagatggtgaaggcccacatcaagccttggccgcttatactaatcgatcttatcaggatattatcgaaaagggtgtatggtacccgtcagcagatcattacattaaacatatgtattttcatttttacgaaaatggtattgctggtgctttagctgcaatgagcccatgtccatggatttaccatcaattggctaaaaaaataattgaggagaaccagtttttgaatggtaacccttttaataattggataactttttatgctaacgatacagttgaagagttaatggaaaactattttcgtatgatggattattatgcgcagaatttgtcaaaagagaagcaagctgatttggtagatgcttttgtgaaatcttgtcagcatgagagacgtttttttcaaatggcaataaatcaagaaaaatgggaggattaatatgacttatttagcaccagttttaactattgcaggaactgatcctagcggtggagcagggattatggcggatttaaagacatttcaagctcgtcggacttacgggatggctgttgtgactagtgttgttgctcagaacacttgtggggttagaggcgttcagcatatagaaacagctatcattgatcaacaactagcttgtgtctatgatgatattaagccaaaggcggttaaaacaggaatgttagcggagagggaaacaattagtttagtcgcttcatatttaaaaaaatatccgcaaccttatgtattagatcctgttatggtggcaactagcggacatcgtttaattgattcagatgccgtagaagcattaaaagaagacttattgccattagcaactattatcacaccaaatttaccagaagctgaggttttagtgggatatgacttatcagatgaagtaagtattattaaagcaggttacgatattcaaaaacaatattctgttagaaatgttcttataaagggaggacatctagatggcttggctaaagattatttatttttggaaaaagaagggttgataactcttagtaatcaacgtatcaatactattcatactcatgggactgggtgtacatttgcagcagtcgttgcagcggagttagctaaagggcaatcaattctaaacgcggtaagtaccgctaaatcatttattacttcagctatcgaaacagcgcctgagttgggccttggaaacggtcctgtcaatcatactagctatcaaggagactaaaatgtatttagaacaattaaaagaggtaaatcctttaaccatttgtatcactaataatgtggtcaaaaactttacagccaatggtttattagctttaggagcttctccggctatgagcgagtgcatagaggacttagaagacttgttaaaagttgcagatgcattattaattaatataggaacactaacaaaagaaagttggcaactttaccaagaagcaatcaaaatagcaaataaaaaccaagttccagttgtattagatcctgtagcggcaggagcaagtcgttttcgattagaagtgtcacttgatttattgaagaattattctattagtttacttacaggaaatggtagtgaaatcgctgctttgattggtgaaaaacaagcgtctaaaggggcagatggcggaaaagtggctgatttagaatcaattgctgtaaaagccaatcaagtttttgatgtgccagtggttgtcacaggagaaactgatgctatcgctgttagaggagaagttcgcttattacaaaatggtagtcctttaatgccacttgttacaggaactggatgtctattaggggcagtattggctgcttttattggtagttctgacagaagcgatgatcttgcttgtctgacagaggccatgactgtttataatgttgctggagaaattgcagagaaggtggcaaaaggtaagggggtgggaagtttccaagttgcatttttagatgccctttcccagatgaaatcagaaatgattatggacaaataggtggtgtcagtagatgaaagatacattgaaattatattttgtttgtggaactgtggattgctctaggaagaatatattgactgttgttgaagaagccttacaagcaggtataactctatttcaatttagagaaaaaggttttacagcattacaaggtaaggaaaaaattgctatggctaagcaactccaaatactttgtaagcaatatcaagttccttttattattgatgatgacattgacttagttgagttaattgatgctgatggtcttcatattggacaaaatgatttacctgttgatgaggcacggagacgtttaccagataaaatcatcggtttatctgtgagtacaatggatgaatatcagaaatcacaattatctgttgttgattacatcggaattggtccttttaatccgacacaatcaaaagcagatgctaagcctgctgttggcaataggacaacaaaggcagttagagaaattaatcaagatattccaatcgttgcaataggcggaatcactagtgattttgttcatgatattatagaatcaggtgcagatgggattgctgttatatcggctatttcaaaagcaaatcatattgtagatgcaaccagacaattgcgttatgaagttgaaaaagctctggttaataggcaaaaacacagtgatgtaatcaaataaggctacatcgttaattataagaatttttaagatattatatcatcacacaatactggtatttgaaaaagaatttaaactatgataatatagtagagttgaattctagttaaagaaagatttgaaagtatgcgtaaaattattattaacggtggcaagcaactgacgggagaagttgctgtatcgggtgccaaaaatagtgtagttgccttgattcctgccactattcttgctgatgatgttgtggtcttagatggagttccggctatttctgatgttgacagtttagttgacattatggaaactatgggagctaagattaagcgttatggtgagacgcttgaaattgatccatgtggcgttaaagatattccaatgccttatggcaaaatcaatagtcttcgtgcatcctattatttctatggaagcttattggggcgttatggtcaagcaacattaggtttacctggtggttgtgatttaggcccccgtccgattgatttacatttaaaagcttttgaagcgatgggagctagtgtttcttatgaaggtgattcaatgcgtctagcaacaaacggaaagcctttgcaaggagcaaatatttatatggatactgtcagtgttggtgcgacaattaacactataatcgcagcagctaaggcaaatggccgtacggttattgaaaatgctgcacgtgaaccagaaattattgacgtggctactcttttaaataatatgggagctcatattcgtggtgctgggactgatgttattacaattgaaggtgtgaaatcgctccatggcacgcgtcatcaagtaattccagatcgtattgaagcaggaacttatattgctatggcagcagctatcggacgaggaataaaagtgaccaatgtgttatatgaacaccttgagagtttcattgctaagttagatgagatgggagttcgaatgacagttgaagaggattcaatttttgtcgaagaacaagaaaggttaaaagctgtatccataaaaacctcaccttacccaggatttgctacagatttacaacaacctctaactcctttattactaacagcagaaggaaacgggagtttattagatactatctatgagaaacgtgttaatcatgttcccgaattagcacgtatgggagctaatatttctaccctagggggcaaaatagtttatagtggtcctaatcaattatctggtgcacctgtaaaagcgacagatttgcgtgcaggcgctgctttagttatcgctggcttaatggcagagggacgaactgaaattacgaatatcgagtttattttacgtggatattctaatatcatcgagaaactaacatcattgggtgcggatatccaattggttgaggaatagtatatataacaaagagttgagaatatttcttagctcttttcttcttgttttagattaagtcacttataggtatttgaaatctcttgtggtataatattatcatggatatatggacaaatttaggacggtttgcattcattgaaacagaacatgttaacctacgtcctgttgcctacactgatagggaagctttttggcgaatagcttcaaaaaggacaaatttacaatttatttttcctgttcaaaccagtaagaaggaaagtgattttcttttagttcattcttttatgaaagagccattgggagtttgggcgattgaagataaagttagtcataaaatgtttggagttatccgttttgaaaacattgatttatctaaaaagacagctgaaattggctattttttgaaagaaagttcttggggtcaaggcattatgactgaatgtctaaagacactttctttttttgcttttcgagagtttgggatggacaaattgatcatagtaacacataaagagaatattgctagtcagaaggttgctttgaaggcgcatttcaaacaatctaggagttttaaaggaagcgaccgttacacacgccgtataagagactatattgagtttcaattaactaggggtgattatcgttatgagtaaacatcaagaaattttggagtacctagaaaatttagctgttggtaagagggttagtgtacgcagtatttcaaatcatttaaaggtgagtgatggcactgcataccgcgctataaaagaggcagaaaataggggtattgttgagactagaccgcgtagtgggacagtacgtgttgctcaaaaagcaaaggttaatattgaaaaactgacttatgctgaaattgcaaggattagtgactcacaagttgttgcaggaatagagggactcagcaaggagtttagtaaattttctataggtgcaatgactcacagaaatattgaaaaatatttggtgcaaggagggttattgattgttggcgaccgtgatgagatacaacatttagccttacaacatcaaaacgctatcttagttacaggtggctttaatgtttccccatctgtttgtcgtttagcagataaacttcaaattcccgtaatggtaacacactatgatacattcacagtatcaacgatgattaatcacactttgtcaaatgccaaaattcgtactgatttaaagaccgttgaacaagtctatcagtcgcaaatggattacggtttcttagcgcaggatgataccgtaaaagaatttaatcttcttgttaaacaaactaaaaatgttcgttttccaatagtcaaccaagctaatgttgtcgttggtgttgttagtgttcaagatattcttggaaaagataaagaagtaaaattggcaacagtcatgtcaaaaaatatcattgttgctaaacctcgaatgagtctagctaatatcagtcaaaaaatgatttttgaagatttgaatatgatgccagtagtatcggatgactttgaattattaggcgttattacaagacgacaagctgtagaaaatttatcgatgtcgcaagggacggatttatacacctatagtgatcaaatcttgtctaatttacaaattgaagatggtcacttttcgtttttagtagaacccgctatgattgaccatacaggtagcttaacacaaggagttttgacggagttcttaaaagaaatttgtattcgtgtcttaactcgtaagcatcaacgcagtattgttgttaaacaaatgacactttatttcttgcaacctgttcaaattgatgaaataataatggtaacgccaacaattatttcagaaaaacggcgcgaagctacactcgatttagaattaaaattagaaaataaaattattgctaaagctatgatagcggtaaaaattaattagatataaggagaataaatagaaaatgattacattaaagtcagcacgcgaaattgaagcaatggatagagcaggtgattttttagccagcatccacattggacttcgtgatattatcaaaccaggagttgatatgtgggaagttgaagaatacgttcgtagacgttgtaaagaagaaaacgtattgccattgcaaatcggggttgatggtgcagttatggattacccatatgctacttgttgtgggcttaatgatgaagtggctcatgcctttcctcgtcattataccctaaaacaaggtgaccttttaaaagtagatatggttttaagcgaacctttagataaatcaattgttgacgtttcatcgttaaactttgacaacgtggctcaaatgaaaaagtacacggaaacatatagtggtggtttggcagactcgtgttgggcttatgctgtaggtgaagtttcacaagaggtgaaagacttaatgtctgtgacaagagaagcaatgtatattgggattgaaaaagcagttatcggaaaccgcattggtgatattggagctgctattcaggattatgcagagagtcgtggttatggagttgttcgtgatttggttggtcacggtgttggtccaacaatgcatgaagagcctatggtgcctaactatggtacagcaggtcgaggtctccgtcttcgtgaggggatggttttaaccatcgaaccaatgattaatactggtacttgggaaattgatacagacatgaaaactggttgggcacataaaaccttagatggtggtctttcttgtcaatatgaacatcaatttgttatcactaaagatggtcctgttattttaacgagtcaaggagaagaaagaacttactaaaatgaaattaaaaaaattctttgaggatttgctggctaaactagaatatagacccattcaagtttttatgcgtcattttcaaagtgcagagatggacttatcagccatagcagttgcttattatctattagtgacagcttttccattactagttattgctgctaatatttttccttattttcatattaatgtgtcggatttattgtcacttatgcaaaaaaatcttccgaaaaatatttatgaacctgcctcacgcttagcagtagatgctttttcgaaaccgtctaccggcattttgggattcgcgtcattaacagctttttggacaatgtctaaaagtttgacctctcttcaaaaagccattaataaagcatacggtgttgaccaacacagagactttgtgattagtcgtttagtgggtgtggggactgggctgatcatcctatttttactgacttttgttttaattttttcaaccttttcaaaaccagttttacagataattgtaaacatgtatgatttgggagatactctaacggcgtggcttttaaatcttgcacaaccagttacatttttgactatatttttaggtattggaattttatactttattttacctaacgcacgaattagaaaagtacgttatgtcattccagggacattattttcaacgtttgttattggtttttttagtaatttaattagccaatacgtcttaaatagggttgagaaaatggtagatattaaaacgtttggttcggtcgttatctttatcttaatgctatggtttattttcttagcccacattatgattttaggtgcaatactgaatgccagcgttcaagaaattgcgacaggaaaaattgaatcaaggcgtggagatattatgtctcttatccaaaaatccaaagaagaaaaataagaaaagacagctcttgttagagttgtctttttttgtctttaaaaataacaaatttgctcaagatgtagttgagtaaaataattaatatttgagatacaaggctttcaatggtgttgattttatttaaattgtgctgaacgaattgtccgataatagaaggaaattgatcaacaaaaataacagctaatatcaaatctaatcctaatgtgcctaatctagcgatgacaaatgtttgtaagcgttgaagctgttcaattttagtttgtttaaaaacaaatcgatcatttgtaaaaaaagcaaaaagtatagctattatgttagcaactattgcagagaatggagcgtcctgcgagaaattaaaaatcccttgtcgaataactaaataaagaagggatgttaatagtccgaacagtaaatataagctgacttcattttgaatactttttttcagtaacgattttaatttaaccatatttttattatatcacggatgcttcaaagtgatgaggaaatctcccataagcttggctttactttttgtttgtgatatacttagtaagttgttttacacaacccttgatgcttagttccctttcatcaagcatattacaaacgttagaagtgttaactatctaaacgttaaaggagaaattatgaacacatttacaactcgcgattacgctcacatggctattgtaacagctatctatatcgttttaaccataacgccaccttttaatgctattgcttatggtgcttatcaattccgtgtttcagaaatgctaaatttcttggccttttaccaccgaaaatacctttttgcggtaacgttaggatgtatgatttctaatctttatagttttggaatgattgatgtctttgtaggtggtggttcaaccttactttttgtttatcttggaaccattttattcaagcaatatcaaaaagattatctatttaatggccttattaacaaagcattctttttcttttctttcttctttgctgcttcaatgattacggtagcagttgaattgaaaattgtagcaggattacctttattattaacatggttaacgacagctgttggtgaattggcttcacttttggttggagcagtccttgtggataagttgagtagacacgtcgattttacaaaataaatatattataaagcgcgagacattgatctcggcttttttgtttgggtttatagttagcatagctagaaaatgctgcaacttttatgagaaatgctccaatttttactaatatccttagtctttgtgataaaatagaaatatggaaaatcgtatgaatgaattagtatctttgttgaatcagtacgcaaaagagtattatacacaagataatcccacagtttctgacagtcaatatgaccagttatatcgagagttagtagaattagaaaagcaacatccagaaaacattttgccaaatagtcccacacatcgagtgggtggtttagttttagaaggctttgaaaaataccaacatgaatatcctttgtattcattgcaggatgctttctcaaaagaagaattgatagcctttgataaacgtgttaaagcagagtttccaactgctgcttatatggcagagctgaaaattgatggtctatctgtctcgttgacttatgtaaatggtgttttacaggttggggcaacacgtggtgatggcaatattggagaaaatattactgaaaatttaaagcgtgttcatgatattcctctacatttagaccaaagtttagatattactgttcgcggagagtgctaccttcccaaagaatcttttgaagctattaacatagaaaaacgagcaaatggtgagcaggaatttgctaatcctaggaatgcagcagcaggaaccttgcgccaattaaacacaggaattgttgcgaaacgtaaattagcaacttttctttatcaagaagctagccctacgcaaaaagaaacacaagatgatgttttaaaagagctagaaagctatggcttttcagtcaatcatcatcgtttaattagctcgtctatggagaaaatttgggattttatccaaactatagaaaaagatagagtttccctcccttatgatatcgatggtattgttattaaggttaatagcatagcaatgcaagaagagctgggcttcactgtaaaggcacctcgttgggcgattgcatataaatttcctgctgaagaaaaggaagcagaaatattatctgttgattggacagttgggcgaacaggagtcgtaacaccaacagctaacctaactccagttcaactagcagggacaaccgttagtagggccactctgcataatgtagattatattgccgaaaaagatatccgtattggagatactgttgttgtatacaaagcaggggatatcatccctgcagtcttaaatgtcgttatgagtaagcgaaaccagcaagaagtcatgcttattcctaaactatgtccttcttgtggtagtgaattagttcattttgaaggtgaggtggctttacgttgtattaatccgctgtgccccaaccaaatcaaagaacgtttagctcattttgctagccgagatgctatgaatattacaggttttggtccatccttagtcgaaaaattatttgatgctcatttaatagcagatgttgcagatatttatcgtttaagtatagagaatttattaactttagatggtattaaagagaaatctgcaactaagatttatcatgcaatccaatcttcaaaagaaaattctgctgaaaaacttctttttggcctaggtattcgtcatgtgggaagcaaggcgagccgccttttattggaggaatttggtaatttgaggcaactaagtcaagcaagtcaagaaagtattgcctcaattgatggactaggaggggttattgccaaatcacttcataccttctttgaaaaagaagaggtagataaactactagaggaattaacttcctataacgttaattttaattatctaggaaaacgagttagtacagatgcacaactttcaggtttaacagtcgttttaaccggtaagcttgaaaaaatgactcgtaatgaagcaaaagagaaattacaaaaccttggtgctaaggtgacaggtagcgtttctaaaaagactgatttaattgttgcaggaagcgatgcaggaagtaaactaaccaaggctcaagatttagggattacaatacaagatgaagactggttactcaacctttaagtgaggaagaaatgaagaaacaaaaaaaagcgcgtttaatttataacccaacttctggtcaagaaattatgaaaaaaaatgtagcggaagttcttgatatacttgaaggatttgggtatgaaacatcagcctttcaaacaacaccaactaaaaattctgccagagatgaagctactagagctgctcaagctggttttgatttgattgttgcagcaggtggagatggtactattaatgaagttgttaatggtattgcacctttgaaacgtcgtcctaagatggcaattattccaactggaacaactaatgattttgctcgtgccttaaaaataccgcgaggtaatcctattgaagcaactaaattaattggtaaaaatcaaatcgttaagatggacattggtcaagctcaagaggacaattattttattaatattgcagctgcaggtagtttgacagagttaacttatagtgtaccaagtcaattgaaaacaacgtttggctatcttgcttatctagcaaagggtgttgaattattacctcgagttcgaaaagtaccagtcaaaattactcacgataagggtgaatttatcggtgatgcttcaatgatttttgttgccatcacaaattctgtaggagggtttgaacaaattgcacctgatgccaaattggatgatgggaaatttacccttattttagtaaaaactgcaaatcttattgagattatgcatctcattcgtttggtgctagcaggtggaaaacatattaatgataaacgagtagagtatattaaaacgtcttatctaactatcgaacccctatcagacgagcgtatgatgattaacttagatggagaatatggaggagatgctcccattactctagcaaaccttaaaaatcatattaggttctttgctaatactgatgaaatttcagatgatgctttagttttagataaagatgaactagcgatagaagctattgcacagaagtttgctaatgaggtagatgatttagaaggattaggagattgatgaatggataatactgtcattgtacattaccatagccgaaagaaaaattactttaatttaagtttatggcagtggcgcgatggctcagagggtcaagatgctcatttttcacggtttgacagtttcggtgctgttgcgatactaaaatatcccttgccatattttttaagccattattatgtgattgttaaggataaaaattggcatcataaaacaatagattatcgcattgattgtactcaaggtggtgcacgtaaagaagtttggattgtagatggggatgacaatctgtattattctcgtcaagcagcagttagtagccatcattatagtagacgccaacctcatgcctacgacatggcaatcaatagtagagcgtttgacaaaaaatggggatttgatggttggttaggttttgaatattcagaaactaaaacggcttttagattatgggcccctactgcggaacgtgtagaactgattttatatcattcgacagatgaaacagcaagtgtatcaaaagttctttctatgaaaagagggacagccgtcaattataaaaatcataaagaaaatacccatggagtctggtttactgaacttgaaggaaactataattaccaagcatatacttatcgagtctactatagacgacgtacctttaaaattacgagagacccttattccattgcaacgactgcaaatggtaaaaggtctattgttattgctccagaagcattaactccggaagggtttaaaataagtcatggaaaagaagctaagtggcggctcgaaaaccccaatcaagcagtcatttacgaaatgcatgtgcgtgatttttcgatatctgagacttcaggagttaagacagattatcacggaaaatttaagggattgcatcaaaaaggtacggttaatcagcatggtgataaaacgacctttgattatgtacaagacctaggagttaactatatccaacttcaaccaattttcgatcatcatcagacatttgatgatgatggtcactatgcttataattggggatatgatcctgaaaactacaatgttccagaagcaagcttctctagtaatccacatgaacctgcaacgcgtattttagaattaaaatctgctatccaagcgtaccatgatgcaggcattggtgttattatggatgttgtctataatcatactttttcatcaactgattctgcatttcaactaacggttccagattattattatcgaatgaatcacaatggaacatttcaaaatgggtcaggctgtggtaatgaaacagctagtgaaaaagaaatgtgtcgtaagtatattcttgattcagttttgtattgggtgaaagaatataatattgatggttttcgatttgatttgatgggactacatgatgtagaaacgatgaacattataagaaatgagctaaataaaatcgaccctcgtattttggtttatggagaaggatgggacatgggagctggtctcacgcctcaaaataaagctaaaaaagataatgcttatcagatgcctggaattggctttttcaatgatgatgtaagagacgctgtcaaaggtgcggaaatttacggagaatttaaaaaaggcttagtttctggaaacagtacagaagatattgttgcaaaaggcattttaggaagtgatgagttagtatcatacattgatcctagtcaagttttaaattatgttgaagcacatgacaactacaacttaaatgatttgctatgggaattacatcctaatgacaacgagaaacaacatatttaccgagttgaagtagctagtgctatgaatctattgatgcaagggatggctttcatgcaattaggtcaggagtttcttcgaacaaagtgttatcctacaggtgataaaggtcaacttactcaagcagataaagaaagggctatgaattcttacaatgccccagaccaagttaatcaggtcaactgggataatgttacctttcataagagtactattaattttattaggaaaataattactttgaagacaaactctccttacttttcttattctagctttgaagagattcgcaaacatgtttttgtagagtctgctcaataccattcaggtttcataagttttacagtcgaagaacataagaaaataaaaataattttcaatattaaaggaaaacgcttgcagaattctttcataggtgatataataatatcaaatcatgaagaaggaaaagcgatagattcattagatgatgagctttctgtaatgatccttgatatcacaaaataacctgaaaacattcaggttatttttgtgtatattaaggaatttgatttgaatttgagtttcttatattttagttaatttttcggaaatatagagggtgaaatattttcagatgcgtctgtatgaggaaaatgtattcctctttttttgtaccattgaggaaatatttttgtcttatattgactagtaggacctgtgaggtgagtagatgtccaataaagatgagttatatacttttggaataggtgaaaattttcatctccagaattatttaggcgtacatagcgaaaatggaagcttttgtttcagagtttgggctcctaatgctgaaaatgttcaagttattggagattttacagattggcgaaatcgacctctccaaatgaacaaaaatcaagcaggagtttgggaagctaacagtttggatgcgcgcgaaggtgatttatataaatatttggttactcgtaaaggtggtcaagtagttgagaaaatcgatcctatggcagtttatatggaaagacgtcctggaactgcaagtgttattaaagttcttagaaataaaaagtgggaagatggtctttggatgggaaggcgcaaacgtctgggttttcagaagcgtccaattaatatttacgaagttcatgctggttcatggaaaaaagatgattttggacatcctatgactttttctcagttaaaagattacttaatcccctaccttgttgagatgaattatactcatgttgaatttatgcccttaatggcacatccgcttgatatgagttggggatatcaattaatggggtattttgcttttgaacatacctatggtactccagaagaatttcaagactttgtagaagcatgtcataaaaataatataggagttcttgtagattgggttccaggacactttattcagaatgacgatgctttagcctatttcgatggaactgctacttatgagtatcaaaatcatgatcgtgcgcataactatcgatggggagctctgaactttgatttaggaaaaaatcaagtacaatcctttttgatttcgagtgccttgttctggattgaacattatcatattgatggtattcgtgttgatgcggttagtaatatgttatatctcgattatgatgaaggaccatgggaagctaaccaatttggggataatcgtaatttggaaggatatcactttttaaggaaacttaacaaagtaattaaagagcgtcatcctaatgttatgatgattgctgaagagtcaacagcttctaccccaataactaaagacttagagtctggaggattgggttttgactttaaatggaatatgggctggatgaatgatatcctgcgtttttatgaagaagatcctctctataggcaatatgattttaatttagtgacttttagttttatgtatatattcaatgagaactttgtactagctttttcacatgatgaagtagtacatggtaaaaagagtatgatgcataaaatgtggggtgaccgttataatcaatttgctggtttacgtaatttatatgcatatcaaatgtgtcatcctgggaaaaaacttctctttatgggaagtgagtttggtcaatttttagaatggaaatataatgatcaactagaatgggaaaacttaaatgatgatatgaaccaaaagatgcaacgctatactaaacaattgaatcaattttataaagatcataagtgcctatggcgtattgatgattcctttgacgggctagaaattattgatgcggataataaatctgaaactgttttatcttttatacgaaaagatgataaaggcgatttgttactttgtgtctttaatatgactcctgtagaacgccctaactttactattggtgttccgcaagcgggtatttatgaagaagttttaaatactgaaatggaagagtttggaggtgtttggaaaaaccacaatcctgtaacgaaaacacaagtggctacatggaaagattatgatcatactttaagttttacattaccagcccttggggcaagtgtttggagaataaaacgtcggcttcgtaaataagtctgcaatttagtaacctcattttgaaaggaaagaataatatgaaaaatgaaatgttagcactcattctcgccggaggacaaggcactcgactcggaaaattgactcagagcattgcgaaacctgctgttcaatttggaggtcgttaccgtattattgactttgcgctttcaaattgtgcgaattcaggtattaataatgttggagttattactcagtatcaaccgctggaactcaatactcatattggaaacggatctagctggggactagatggtatcgattcgggagtaactgtattacagccatattctgcaacagaaggtaatcgctggtttcaaggtaccagccacgctatctatcaaaatattgactacattgatcgtattaatccagaatatgtactcattctctctggggaccacatctataaaatgaactatgatgacatgctacagacgcataaagataatttagcaagcctaacagtcgctgttttagatgttcctttaaaagaagcaagccgttttggaattatgaatactgattcaaacgaccgtattgtcgaatttgaagaaaaacctgaacatcctaagtcaacaaaggcttcaatgggaatatacatttttgactggaagagattacggacagttttaattgatggtgaaaagaacggcatagacatgtcagactttggtaaaaatgttataccagcataccttgaatcgggtgaacgtgtttatacctataattttgatgggtattggaaagatgttggtactattgaatccctttgggaagctaatatggaatatattggagaagataacaaattacatagtcgtgatcgttcatggaaaatctattctaaaaatttgattgcaccacctaatttcatgacagaagatgcaaatgttaaagattctttagttgtagatggatgctttgttgcaggaaatgttgagcactccattttatcaactaatgtccaggtaaaaccaaatgctattattaaagactcctttgttatgagtggcgcgactatcggtgaaggtgcaaagataaatcgagctattatcggtgaggatgctgttattggtgatggtgttgtgattgatggaagtaaagaagtagaagttattggttataaagaagtagcgggggttccaaatgaagattgataaatatactgcgattttaggaaatactgttagttacccagatatgcacagtttgacggataatcgtccgcttgcttctctaccttttgatggtaagtatcgtttaattgattttcaattatcctctttagctaatgcaggcgttagaagtatttatggtatttttcgtgggaataatgttcgctctgtttttgaccatattagaagtggtcgtgagtggggcttaggtacactgttgagtcactattctttaggattctatgatacagacgatgatactcgtacagtcaatggggattattacgatcaaattttaacttacttgaggcgttcgggtagcgaccagacgatatatatgagttgtgatatgctttgtaatattgacttaagtcaagtaatccacttgcataatgcaaatggtgcgcaagccaccgtggtttaaaaaaaatgccgagatcagctattgcagaggctaatcaagtcttgaccattgatgaatctgatcatgtagtgagtctaggtaaagctgtagataatgacgataaccaaaaaatgtctgctgagatttatgttatcgatacaccttggttaatcgaaaaaatggaagaggaagctcaaaataatgaaccacgtaaactccgcttcttacttcgtgatttaattgttgaaagtaatgctttggcttttgaatacactggttatttgtcaaacatttcttctattaaatcctattatgatgctaacatggacatgttaacaccaaataaattttattcgctcttcttttcaaaccaaaaagtttatactaaggtgaaaaatgaggaagctacttattttgataaacaatcaaatgtctctaattcgcaactagcctctggaagtattattaaaggttatttagaccattctatcgtttctagaaattgtctccttgaaaaagggactcgagtagtcaatagtattatctttccaaaagtaaaaatcggagaaggggcaaccattgaaaatactattattgacaaatgcgttaaggttgcatccggagttacattgaaaggtagtttagataaaccgttagtgattcctaaattttcagagattaatgaggatattatacaatgaaaataatgtttgttgcggcagagggtgctccctttgctaaaacaggtggtttgggagatgtgattggcgcactcccaaaatcacttagtaaaaaaggtcatgatgtcgctgttgtcatgccatattatgatatggtagaccaaaaatttggagaccaaatagaaaacctcatgtatttctatacagatgttggctggcgtcatcaatatgtaggagttaagagactttctcaagataatgttacgttctactttattgataatcaatattatttttatagaggtcatgtctatggtgattgggatgatggggagcgttttgcttatttccaattagctgctttagagttgatggagaaaatcgattttattcccgatgtcttacacgtccatgattatcatacagcaatgattcctttcttattgaaagagaagtaccactggattcaggcctataataatataagagcagtttttactattcacaatattgaatttcaagggcagtttggtccagaaatgttaggagatttatttggagttggcgctgagagatatgaagatggaactcttagatggaataattgtcttaattggatgaaagcagcaattctttactcagatagagtgacaacggtatcaccaagctacgcaaatgaaataaaaactccagaatttggtaaaggtttagatcaaattatgcgtatggaagcaggcaaattatctggaattgtaaatggtattgatagcgatttgttaaatccagaaacagatgcttttttgccatatcatttttcaaaaagcaacttagagggcaaaattaaaaataagttggctttacaggaaaatttgggcttacctcaagataaaaatgtaccattaattggtattgtttcacgacttaccgatcaaaaaggatttgatattattgcttctgaattggacaatatgcttcaacaagatattcaaatggttattttaggaacaggctatcaccattttgaagaaacgttctcttattttgctagtcgttaccctgaaaaactatctgctaatattacttttgacttaagattagcgcaacagatttatgcggcttcagatatcttcatgatgccaagtgcttttgaaccttgtggtctctcgcagatgatggctatgagatatggtagcttgcccttggtacatgaagttggaggattaaaagatactgtggtagccttcaatcaatttgatggtagtggtacaggtttttcatttaatcatttttcaggctattggttaatgcaaactctaaaactagcattagaagtttataatgattatcctgaagcgtggaaaaagttacaatggcaagctatgtcaaaagatttttcatgggatacagcatgtgttgcttacgaacaactgtatcagcaactacaataatcaccctattttagtgattagttgataagcttatcgaatctctatgctaaacgtttcttatgtaaaaccactttagtatagagattttattatcctataaggtaaaatattattaatgtaaagagacactatatcaaaaataaagtgttgtcatatcttaataagggattaaattaaagctaaaaaaactaaaaattgttatttgaaaaggattgtgtaaaccatctcaaactatttcatgaaaacgtaatcaaatgaggaaattcattgacatgcacaagaaataggaataaaataacggagtaaatattttttaaaggagaattctattatgaatttagctattttagcacttggtttcgccgtgatgggtgtttcaatcggtgaaggaattttggttgcaaatattgccaaatcagcggctcgtcagcctgaaatgtttagcaaactgcaaacattgatgtttacaggtgtggccttcattgaaggtaccttcttcgttctatttgcgtttacattcttagtaagatagacgacaatttagaaaaaaaggagggatgaggattggaatctacaagtaatccaaccgtatcttttttaggcattgattttgatttaaccatcctagctatgtctctcttgacaattactattatctttatcttagtcttctgggctagtcgtaagatgacaataaaaccaaaaggtaagcagaatgtcttagaatatgtctatgagcttgttaataatacaatctcacaaaatttaggacactatactaaaaattatagtttattgatgtttattttattcagttttgtcttcattgctaacaacttaggattgatgacatcattgaaaacacatgagcataatttttggacatctccgaccgctaattttggtgtagatattacattatcattattagtagcatttatttgtcatattgaaggtattcgcaaaaaaggaattggtggttatctcaaaggtttcttatcaccaacaccagcaatgcttccgatgaatttattggaagaagttactaatgttgcttcattagcattgcgtctttttggtaatatcttttctggtgaagttgtcactggattacttttacaacttgcagttttatcaccatttacaggtccactagcttttgcattgaatatcgtttggacagcattctcaatgtttattggtttcatccaagcgtatgtgttcattatcttgagctcaagttatattggacacaaagttcatggtgacgaagaagaataagaaaagagaggagaaatatgtcaatacttattaatagtacaacgattggtgatatcattatcgtatctggctctgtgcttctcttatttatcttaattaagacttttgcatggaaacaaatcacaggtatttttgaagcccgtgaacaaaagatagctaatgatattgatactgctgaacaggcacgtcaacaagctgaagcttttgcaactaagcgcgaggaagaactatctaacgctaaaactgaagctaatcaaatcattgataacgctaaagagacaggtcttgcaaaaggtgatcaaattatttcagaagcaaaaactgaagctgatcgattaaaagaaaaagcacatcaagatattgcccaaaataaggcagaagcactagcagatgttaagggtgaagtagcagatttaacagttttattagctgaaaaaattatggtatcaaatcttgataaagaagctcagagtaatctcattgatagctatattaaaaagctaggagatgcctaatgaataaaaagacgcaggctctaattgagcaatattcaaaaagccttgttgaagttgccattgaacataaaattgttgaaaaaatccaacaagaagtagcagctttaattgatatttttgaaacaagcgagcttgagggtgtcctgtcaagtcttgccgtttcacatgatgaaaaacaacattttgtgaagacattgcaaacatcatgttcaacttatcttgttaatttccttgaggttattgtacaaaatgaacgtgaagcacttctatatcctattttgaaatcagttgatcaggaacttatcaaagtgaatggtcaatatccaattcaaattacaactgcagttgctttgtctccagaacaaaaagaacgtctttttgatattgctaaaactaaattagctttaccaaatggacagttagttgagcacattgacccatctattgttggtggatttgttgtcaatgcaaacaataaagtaattgatgcaagtgttcgtaatcaattacatcaatttaaaatgaaattaaaatagaaagtggtgtgacttttggcaattaatgcacaagaaattagcgctttaattaaaaagcaaattgaagacttccagccaaattttgacgtcacagaaactggtattgttacatatatcggtgatggtattgctcgtgctcgtgggctagataatgctatgagtggagaacttcttgaattttcaaatggtgcgtacggtatggctcaaaaccttgagtctaatgacgtgggtatcattattttgggtgatttctcagaaattcgtgaaggtgatgtggtaaaacgtactggtaaaattatggaagtaccagtaggggaagctatgattggacgtgtcgtcaatccgcttggtcaaccagttgatggactaggtgaaattgagacgacagcaacacgcccagttgaaacaccagcacctggtgttatgcaacgtaaatcagtttttgagcctcttcaaacaggtctcaaagcgattgatgctttggttcctatcggacgtggtcaacgcgaattgattatcggtgaccgccaaactggtaagacgtctgtagcgattgatgcaatcttgaatcaaaaaggtcaagatatgatctgtatctatgtggctatcggtcaaaaagagtctacagtacgtacacaagttgaaactttgcgtaaatacggtgcccttgattatacaatcgttgtgacagcttcagcatcacaaccatctccattacttttcattgctccatatgcaggagtagcaatggctgaggaattcatgtataacgggaaacacgttttgattgtttatgatgatttatcaaaacaagccgtagcttatcgtgaactttcgcttcttcttcgccgtcctccaggtcgcgaagcttacccaggggatgttttctaccttcatagtcgtcttttggaacgttcagctaaagtatcagatgctttaggtggaggttcgattacagcgcttccgttcattgaaacacaagcaggtgatatctcagcatatattgctacaaacgttatttcaattactgacggccaaattttcttgcaagaaaatctctttaactcaggtattcgtccagcgattgatgcaggttcatcagtatctcgtgttggtggtgcagcgcaaattaaagcgatgaagagagttgcaggtacgcttcgtctagatcttgcttcttatcgcgaacttgaggcattcactcaatttggttcagaccttgatgcagcaacacaagcaaaactaaatcgtggtcgtcgcacagtggaagtgttaaaacaaccattacacaaaccattaccagttgagaaacaagttgtgattttatatgctctaacacatggattccttgatgatgtacctgtaaatgatattttagcttttgaagaagctttgtatgattactttgatgctcattatgataatctcttcgaaacaatccgcacaacaaaagatttaccagaagaagcagaattagatgctgctattcaagcatttaaagatcaatcacaatttaaataataggagggttctaatatggcaggctctcttagtgaaattaaagacaagattctctctacagaaaaaacaagtaagattactagtgcgatgcagatggtctcatctgctaagttggttaaatctgaacaagctgctagagattttcaagtgtatgcctctaaaattcgtcaaattactactaacctcttaaagtcagacttagtatctggatcagataaccctatgttatcttcacgtccggtgaagaaaacaggttatattgttattacttctgataagggtttagttggtggttacaattcaaaaatcttaaaagcgatgatggacactataactgactatcatactgagaatgatgattatgccatcatttcaattggtagtgttggttctgattttttcaaagcacgtggaatgaatgtttctttcgaattacgtggtttagaggaccaaccaagttttgatcaagttggtaaaattattgctcaagcagttgaaatgtacaaaaatgagttgttcgatgaattatatgtttgctacaatcaccatgttaacagtttaactagccaagtcagaatgcaacaaatgcttcctatcaaagaattggatgcagaagaggcttctgaggatagagtgattactggttttgaacttgagccaaaccgtgaagttatattggagcaattattgcctcaatatactgagagtttgatttatggagctattattgatgctaaaacagcagagcatgcggctggtatgacagctatgcagactgcaactgataatgctaaaaatgttatcaatgatttaactattcaatataaccgcgctcgtcaagcagctatcacacaggaaattacagaaattgttgcaggtgctaatgcacttgaataattaattagtctatagaaaaaatagtgaacaaaggtattttaaatcctttgtatcatatgataaggagaaatacatgagctcaggcaaaattgctcaggtagttggacctgtcgttgacgttgtatttgcaagtggcgacaaacttcctgagattaataatgcattgattgtctataaaaatggcgataagtcacaaaaagtagtacttgaagttgctcttgaacttggtgacggcctcgttcgtacaatcgctatggaatcaactgatgggcttacacgtggtttggaagtattagatactggtcgcgcaattagtgtgccggttggtaaggatactttgggtcgtgtcttcaacgttcttggagatgctattgaccttgaagagccttttgcagaagatgcagaacgtcaaccaatccataaaaaagcaccatcgtttgatgaattatcaacatcatcagaaatcttagaaactggtattaaagttattgacttattagcaccttacttaaaaggtggtaaagttggacttttcggtggtgcaggtgttggtaaaaccgttcttattcaagaattaatccacaacatcgcccaagaacatggtggtatttcagtatttactggtgtaggagaacgtactcgtgaagggaatgacctttattgggaaatgaaagaatctggcgttattgaaaaaacggctatggtctttggtcaaatgaatgaaccaccaggagcacgtatgcgtgtggcacttactggtcttacaatagctgagtacttccgtgatgtagaaggacaagatgtgcttctcttcattgataatatcttccgtttcacacaagctgggtcagaagtgtcagcgcttttaggtcgtatgccttcagccgttggttatcaaccaacacttgctacagaaatgggacaattacaagagcgtatcacttcaactaaaaaaggttctgttacatcaatccaagctatttatgtgccagcagatgactatactgaccctgcgccagctacagcctttgctcacttagattcaacaactaaccttgaacgtaaattgacacaaatggggatttatccagccgttgacccattagcttcaagttctcgtgcactcacaccagaaatcgttggagatgagcactatgaagttgcaacagaagtacagcgtgttcttcaacgttaccgtgagttacaagatatcattgcgattttaggtatggatgaattatcagatgaggaaaaaacgttagttggacgtgcacgtcgtatccaattcttcctttctcaaaacttcaatgttgcagaaacatttactggtcaaccaggttcatatgttccggttgaagaaactgttcgcggattcaaagaaatcctagatggtaaacatgatcaaattccagaagatgccttccgtatggttggtggtattgaggatgttatcgcaaaagcagaaaaaatgaactattaatgaggtgatgctatggcacaattgactgttcaagtagtaacaccagatggtattagatatgaccatcacgctagtctcattactgttagaacgccagatggtgaaatgggaattttaccaggtcacataaatttgattgctccccttaatgttcatcagatgaagattaatcgttctcatcaagaaggtgtagactgggtagctgttaatggtggtataattgaagttaatgaggatcaggtgacaattgttgcggattcagcagaacgagcacgtgatatagaccttaaccgtgcagaacgggctaaggaacgcgctgagcgtgcattagaaaaagctcaaacaactcagaatattgatgagatgcgtagagctgaggttgctcttcgtcgcgcaattaaccgtattagcgtcggtaaaaagtagaaaaatggtctaattagttttgtgactaattaggcttttttagtgtataatagaaggcatgaatatgatattaaatatagtaactatagttagtaattttatttttattgcccttttttatcaactttttgtagatttatttgactggtctaaaatgattaaaatgtcccctcaaaacatctcaaaattaaaagtttttattttgttgataagtatagttggtggctatgtggttagtcattttttattggaagtgattcagttgtgtcaatcaatcttttgggctctccaataaaggaaatattagctgaactatgatataatcaacttactattgttataagaatggagattcaaatggataaaattattgtggaaggtgggcaaacgcagcttcaaggtcaagttgttattgaaggagctaaaaatgcagttttacctcttttagcagccacaattttaccaagccaagggaaaacattgttgaccaatgttcctatcttgtctgatgtatttacaatgaacaatgttgttcgtggtttagatattcaagttgactttaattgcgataaaaaagaaatcttagtggatgcctcaggtgatattttagatgttgcaccttatgaatttgttagtcaaatgagagcttctattgttgttttgggacctattttagctagaaatggccatgctaaggtttcaatgccaggcggttgtacaattggtagccgaccaattgaccttcatcttaaaggtttagaagctatgggagctacgattacacaaaatggtggtgatattactgcccaagctgaaaagcttaagggagctaatatatacatggattttccctcagtcggtgccactcaaaacttaatgatggctgctacacttgcttcaggcacaacaacgatagagaatgctgcacgtgaaccagaaattgtagaccttgcgcagttactaaataaaatgggagctaaagtaaagggtgctggtacggaaacattaacgatcattggtgttgatgctttacatggtacagaacatgatgttgtccaagatcgtattgaagctggaacctttatggtggcagctgctatgacttctggaaatgttctagtaaaggatgctatttgggaacataaccgtcctttaatctctaaattgatggagatgggtgttgaagtgtcagaggaagaagatggtattcgtgtaaaagctgatactaaaaaattgaagccagtgactgtgaaaacactccctcatccaggatttcctactgatatgcaagctcaatttacagctctaatggcagtagttaatggcgaatcaactatgattgagacagtttttgaaaatcgttttcaacatttggaagaaatgcgtcgcatgggattacaaacggaaattttacgagatactgcaatgattcatggtgggagagctttacaaggtgcaccggtcatgtctactgacttacgagctagtgcagctttaatcttggcaggaatggttgcgcaagggcaaacagtagttggccaattaacccatttagaccgtggttattatcaattccatgaaaaattagcggctcttggtgctaatattaaacgtgtaagtgaggcgtaatatggcatctagtggttggaaatatgtattaaaacaaatcggtctaatagtattagtcatactattagccttgctgtttttagcggttggattgatgttgggttatagtgtttttggtgacggagagcatgcttactctattttatcgctggataaatggcaaaatattattggaaaatttttaggaaaatagaaagagccactataagttatttgatgcttatagtggtttcctttgagagttaattttagcagtagaataatacaatgacaaaaaaacaaaaacaaataacagcttcgattgtaactttgcttttttcattactggcaatagggttaggtgaaagcaaatctttgcctaatgatcacattttaaaacaggtgacagatttaattattagtaatgaatctggcaaaaatacttcccttaaaaatgtatcaggaactcctagtagagagttatctgaatctgttttgactagcaatgttaaaaaacaattgggaacaaatatagcttggaaccagtcaggtgcttttatcattaatcaaaataaaacagatttgaatgctaaagtgtcaagtgcaccatatgctattaatgaaataaagaaggttaataaccaaattgttccgactaaagcaaatgccttattaacaaaagcaactcgtcaatatcgaaatcgagaagaaacagggaatggtagaacttattggaaaccagctggatggcatcagataaatggattaaaagggagctataaccacgctgtggacagaggccatttaattggttatgctttagtagggagtttaagaggatttgatgcctccacaagtaatcctaaaaatattgccacacaagcagcttgggcaaaccaagctaatagcaaccaatcaacagggcaaaattattatgaaactttagttcgtaaagcattggatcgtcataaaactgttaggtatcgtgtgactttaatttatgacagagataatcttttatcttcgggatcacatattgaggctaaatcttcagatggaagtttagaatttaacgtttttattcctaatgtacaatcgggattattatttgattatgcaacaggaaaagtgaagcagacaaagtaatctttatctaatagtgcttgttaaagactgaaaaatttgataaaatagtctttaattgaatagaggtctgtgagactagtaaaccaagggaagctgcttagggagttcagccgtgactgcaagctgaatcagtgaaagagggtggaattcactcacaaataggactataattaaggtctgattggtcgatcagatagaaaacggatggtaccgcgtgtcaacgctccgattaaggggtagtggcacgcttttttttgttttcaaagctacttattttgacttggaggaaagatggatttacaaaaacaattagaagagttgaaaatatcaactcaagaaaagcttaaagaaatgactgggaaccacactaaagaattacaagacttacgtgtacaagttttaggaaaaaaaggttctctaacagaattactaaaaggtctgaaagatttatctaatgatttacgaccagttgttggaaaacaagtcaatgaagtacgtgatattttaacaaaagcgtttgaggaacaagctaaagtagtggaagctgcgaagattcaagcacagttagagtctgagagtgtcgacgttaccttgcctggtcgtcaaatgacattaggtcaccgtcatgtcttaacacaaactagcgaagagattgaagatatctttttaggtatgggattccaagtggttgatggttttgaagttgagaaagactactataattttgaacgaatgaatttaccaaaagatcatccagcccgtgatatgcaagatactttttatattacagaagaaatcttgctacgtactcatacttcgcctgttcaagcacgaacaatggaccaacatgatttttctaaagggcctttaaaaatgatttctcctggacgtgttttccgtcgtgatactgatgatgctactcatagccatcaattccatcaaattgaaggcttagttgttggagaaaatatttcaatgggcgatctcaaaggaacacttcaactgatttctcaaaaaatgtttggagcagagcgtaaaatccgacttcgtccttcatatttcccattcacagaaccttcagttgaagttgatgtctcttgcttcaagtgcggaggtaagggatgtaatgtctgcaaacagacaggttggattgagatattgggtgctggtatggttcacccaagtgttttggaaatgtctggtattgattctgagaaatactccggttttgcctttggtttaggtcaagaacgtattgcaatgttacgctacggtatcaatgacattcgtggcttctatcaaggtgatgttcgcttcacagatcaattttaagattttagatagcaagtagcatcattggtgtgatgataaatttatgttaacgctattaccttactcaataggaggttttctaatgtctcaaattacttttaaaaaggttggccttgataatgtgaatattttacagaatattgctatagaaacctttcggcagacgttttctcatgataatagtgaggaacaacttcaagcatttttcaatgagtcttacactttaccagtattaaaatcggaaattacccatgctgaatctgatacttattttgtttatcttgatacagatttagtgggttatttaaaagtaaactggggaagtcagcaaactgaaaaagatcttgataaagcatttgaaattcaaaggatttatcttctagatgcctaccaagggcaaggtataggtaaggctactttcgaatttgctttggatttagcttataaatcaggcttagattgggcttggttaggtgtttgggagtttaatcataaagctcaggcattttacgctaaatacggatttgaaaaattttctgagcaccaattttcagtaggtgataaagtggatacggattggttattaagaaaaagtttacactaaaaactacaaagcacttgtataaaaataaaagaaaataaatagagagaaattacatgttagtatcgtataaatggttaaaagagttagtggatgttgatgttacaacagcagaactagctgagaaaatgtcaaccactggtattgaggttgaaggtgtggagacaccagcggaaggtttatcaaaattagttgtaggtcatattgtttcgtgtgaagatgttccagatacccacttacatttgtgtcaagttgatacaggggatgatgaacttcgtcaagttgtctgtggtgctccaaatgtcaagactggtattaatgttatcgtagcggttcctggtgctcgtattgcagataactataagattaaaaaaggtaaaatccgtggtatggagtcacttggaatgatttgttcacttcaagagttgggcttatcggaaagtatcattccaaaagagttttctgatggtatccaaattttacctgagggagctatacctggtgatagtattttctcttatcttgacttagatgatgaaattattgaattatcaattacaccaaaccgtgcagatgctctttcaatgcgtggtgttgcccatgaggtagcagcaatttatgggaaaaaagttcattttgaagaaaaaaatctcattgaagaagcagaaagagcagctgataagatttctgttgtcattgaatcagataaagttttatcttactcggctcgtattgttaagaatgtaacagttgcaccaagtccacaatggcttcaaaataaactgatgaatgctggtatacgtccaattaataatgttgttgatgtgacaaactatgttcttttgacttatggtcaaccaatgcatgcttttgattttgataaatttgatgggacaactatagtagcacgtaatgctgagaatggggaaaagttaattactcttgatggtgaagagcgtgacttaatagctgatgacttggtcattgcggtaaatgatcaaccagttgctttggcaggcgttatgggaggacaatcaactgaaattggtagttcttctaagacagtggtccttgaagcggcagtatttaatggaacaagtatccgcaaaacaagtggaagactcaaccttcgttcagaatcatcttctcgctttgaaaaaggtatcaattatgatacagtttcagaggctatggattttgcggctgcaatgttacaagaattggcaggtggtcaagttctttctggtcaagttacagaaggagttcttccaactgagccggtagaggtatcaacgactcttggttacgttaatactcgtttgggaacagaacttacctatactgatattgaagaagtatttgaaaaactcggctttgctatttctggttcagaagtgaaatttactgtgttggtaccgcgtcgtagatgggatattgccattcaagctgacttagttgaagagattgcccgtatttatggttacgaaaaattaccaacaacattgccagaagccggagcgactgcaggagaattaacgagtatgcaacgcttacgtcgtagagtccgtacggttgctgaaggagcaggattatctgaaattatcacctatgctttaacaactccagaaaaagcagtgcagttctcaactcaagcaactaatataactgaacttatgtggccgatgactgttgatcgctcagcacttcgccaaaatgttgtttcaggaatgcttgatacaattgcttataacgttgctcgcaaaaacagtaaccttgcagtttatgagataggaaaagtttttgaacaaactggtaatccaaaagaagatttaccaactgaagtagagacgtttacttttgccttaacaggtctagtagaggaaaaagatttccaaacaaaatccaagccagttgatttcttctacgccaaaggtattgtagaggcgctctttattaaattaaaattagatgttacttttgtagcacaaaaaggtttagcaagtatgcacccaggtcgtacagcaactatcttattagatgggaaagagattggttttgttggtcaagtacacccacaaactgcaaaacaatatgatattcctgaaacttatgttgctgaaatcaatctatcaactattgaaagtcaaatgaaccaagcgttgatttttgaagatattacgaagtatccgtctgtatctcgcgatattgcattattacttgcagaatctgttagtcatcatgatattgtgtcagcaattgagacatcaggggtaaaacgtctaacagcgattaaactgtttgatgtctacgctggaaataatattgcagaagggtataaatcaatggcttatagcttaactttccaaaaccctaatgacaatctaacggacgaagaagtggctaaatatatggaaaaaatcactaaatcactcgttgagaaagttaatgcagaaataagataatttatattttacgttgaaaaataaataaaaaacagcatcaattaagatgctgtttttttatttaaaatttatagatgttctacggagaaagtatcaccgtgttggatgtcaccatattgaaagcctttgttaaaccaacgttggcgttgttcagctgttccatgggtaaagctatcaggcactaattttccgtaggtttctttctgaagggtatcgtctccgacggcgtgggcagcattcatggcctcttcaaagtctccttgttctaagagattttttcccctgatgtagtgagcccatacccctgcataataatctgcttgaagttctagccgaacatttaaagcatttgcttctttcttagtaagtccgtgtcgcattctattatacttatccataatgcctaactctgtttgaatgtggtgaccaacttcgtgggcgatgacgtaggccatagcaaaatcaccagtagcaccatatttatgtgataattcattgtaaaaagaaatatcaagatagatttttttatctgctgaacaataaaatggtcctgaagcagattcacctataccacaacctgtttgaattgaattggtgtaaagaacaagttttggttccttataatttccaaaaccttgggtttggaattcttgtgaccagaaatcctcagttgagccaaggactttattaacgaaatcgatttgttctctcgttgcgctattatcaacagaacgtgagacattctgagattggtaactagaaggtgaggatgagtcattaaaaatgctggttagtccccctccgccaagtagcagtaagatgattaaaaccacaagcttggttttccaactccctcgcagcaataaaagttgaagaatcggtaatccacttcctccgctagagaatgaacctccgctactggagcgacgatcttcaacattgtcgctttttcttaggtcatctattttcataagtatctccaaagtgttttataggctcattataaactattttaataagaaatgcttgaatttttaactaaatatcttcccctagatttgaagctatttttggtataatattaataaactgtaaaggataagttgaagaaggtttacttctcagttgacttataagataggagattcatgaaattactttatactgatattaatcatgatatgacagaaatcttagtcaatcaggccgcgcatgctgctgaagctggatggcgtattttttatattgctccaaactctttatcttttgaaaaagagcgtgcagtattagagaaccttcctcaagaagcctcttttgctattacaattactcgctttgctcaattggcacgttattttactttaaaccagcctaatcaaaaagaaagtttaaacgatattggattagcaatgatcttttatcgtgctttagcaagttttgaagatggacaattaaaagtttttggacgattgaagcaagatgcttcctttatcagtcaattggtagacctatacaaagaattgcagacagcaaatctgagtattttagagttaaaatatttacattctcctgaaaaatttgaagatttattagctatttttctagtggtttcagatcttttaagagaaggagaatacgacaatcaatctaaaattgccttttttacagaacaagtaaggtcaggccagctagatgtggatttaaagaacactatccttatagtcgatggttttacccgtttctcagctgaagaagaagctttaattaaaagtctgagttcacgttgtcaagagattatcatcggagcttatgctagccaaaaagcgtataaggctaactttactaatggaaatatttattctgcaggggttgattttttaagatatctagcaacgacatttcaaacaaaaccagaatttatcttgtccaagtgggaaagtaaatctggttttgaaatgatttcgaaaaatatcgaaggtaaacatgattttacaaatagtagtcacattttagacgacactgctaaagattgtataacaatttgggagtgcattaatcaaaaagatgaagtggaacatgtggctagagctatacgtcagaaactttatcaaggatatcgctacaaagatattttagttttactaggagatgtagatagttataaactacaattaagtaagatttttgagcagtatgatattccttattatttcggtaaagctgaaacaatggctgcgcaccctttagttcattttatggattccttgtctcgaataaaacgttatcgatttagagctgaagatgttttaaatctttttaagacaggtatttatggagagattagccaagatgatttagattattttgaggcttatatctcatatgcagacattaaaggtcctaagaagttctttacagattttgttgtgggggctaaaaaatttgatttagggcgtcttaacactattcgtcagtccctccttactccactggaaagttttgtgaaaacgaaaaaacaagacggtataaaaacactcaaccaattcatgtttttccttactcaggtaggtttgagtgacaatttatcgcgattagttggtcaaatgtctgaaaatgaacaagaaaaacatcaagaagtttggaaaacatttacagatattttagagcagtttcaaacaatatttggtcaagaaaaattaaatttagacgaatttttatcgttattaaattcaggtatgatgcaagccgagtatcgtatggtccctgctactgttgatgtggttactgttaagtcttacgatttggtagaaccacatagtaatcaatttgtctatgccctaggcatgacacaatcacattttccaaagattgctcaaaacaaatctttaatatctgatattgaacgtcagcttataaatgatgccaatgacactgatggtcattttgacattatgacgcaagaaaatttgaagaaaaaccattttgctgccctctctctttttaatgctgctaaacaagaattagtgttgactataccacaattattgaatgagtctgaagatcagatgtcaccatatcttgtcgaactaagagatataggtgttccttttaatcataaaggacgccaatcgttaaaagaagaagctgataatattgggaattacaaagctttattatcgcgtgttgttgacttgtatcgctctgctattgacaaagagatgactaaagaagaacaaactttttggtcagttgctgttcgttatttgcgtcgtcaattaacttctaaagggattgagataccaataattacagatagtcttgatactgtgacagtttcatcagatgtgatgaccagacgcttcccagaagatgacccacttaaattatcctcatctgctttgacaactttttataataatcaatataagtattttttacaatatgtgttaggtttggaagaacaagactcaattcatccagatatgcggcaccatggaacgtaccttcatcgtgtttttgaaattctgatgaaaaaccaagggatagaatcttttgaagagaaactcaactctgcaattaataaaaccaatcaagaagatgttttcaaatccttgtattcagaagatgcagaaagtcgttattctttagaaattttagaagatatcgcgcgtgcaactgcaaccatattacgacaagatagtcagatgactgttgaaagtgaagaagaacgatttgaactaatgattgataatactataaaaattaacggtattattgaccgtatcgatcgtttatctgatggttctttgggtgtcgtggactataaatcaagcgctcaaaaattcgatatccaaaaattttataacggtctaagtccacaattagtcacctacattgatgctatcagtcgtgacaaggaagttgaacaaaaaccaccgatttttggagctatgtacttacatatgcaggaacctagacaagacttgtctaaaattaaaaatttagatgatttagtaacaaaaaatcatcaagctttaacttataaaggattattttcagaagccgaaaaagaattcttagcaaatgggaaataccatctcaaagattccctttattcagagactgaaattgctattttacaagcacataaccaatcgctttacaaaaaagcatctgagactattaagtcaggtaagtttttgatcaatccatatacagaagatgctaaaacagttgacggagatcagtttaagagtattacgggattcgaggcggataggcatatggcacgtgccagagcgctttataaattacctgctaaggaaaaacgtcaaggtttcttaacattaatgcagcaagaggaggaaaatgatgacctttaagcctttcttaaatccagaagatattgctgttattcagacagaagaaaaaaattctgataaaaaacaaaagcgaacgcctgaacaaattgaagccatttatacttttggtaacaatgtcctggtatcagcttcggctggttctggaaagacttttgtaatggttgagcggattttagataaacttttaagaggggttccgattgactctttgtttatctcaacatttacagtaaaagcggcaggtgagctcaaagaacgtttagaaaagaaaataaacgagtctttgaaatccgcagaatcagatgatttaaaacagtttctcacccagcaacttgtcggcattcaaacagctgatattggtactatggatgcttttacgcaaaaaatagttaaccaatatggttatactttgggcatatcacctatatttaggattttacaagataaaaatgagcaagacgtcataaagaatgaggtctatgctgatttattttctgactacatgactgggaagaatgcagcttcattcataaaattagtcaaaaatttctcaggtaatcgtaaagatagcaaagcttttcgagaaatggtttataaagtttatgcttttagccagtccaccgataaccccaagcgctggatgcaaacagtttttctaaaaggtgcacaaacttacactgattttgaagctattccagatcaagaagtttcaagccttttaaatgtaatgcaaacaactgctaatcaattacgtgatttaacggatcaagaagattataagcaattaactgctaaaggggttccgacagcaaattacaaaaaacaccttaaaataattgaaaatttagtccattggtctcaagactttaatttgctgtatggaaaaaaaggattgactaatttggcacgtgatatcactaatgtgattccttcaggcaatgatgttacagttgctggcgttaaatatcctatctttaaacaattgcataatcgtatcgttggacttaagcacttagaagttatttttaagtatcaaggagaatctcttttcttgttagaattattgcaatcctttgttttagatttctcagaacaatatttacaggagaagattcaagaaaatgcttttgaattttctgatattgcccattttgcaattcaaatattggaagaaaatcatgatattaggcaactttatcaagataagtatcatgaagtaatggttgatgagtatcaggacaataaccatacccaagagagaatgttagaattattgtctaatggacataatcgtttcatggttggagacataaaacaatcaatttaccgttttcgtcaggctgatccacaaatttttaatgataaatacaaagcttaccaagacaatccaagtcaagggaaattaattattctgaaagagaattttcggagtcaatcagaggttttagacagtacaaatagtgtgtttacacatcttatggatgaagaagtaggagacattctttatgatgaaagtcaccaattaaaagctggtagtccaagacagcaagaaagacatccgaataataaaacacaagttttactattagatactgatgaagatgatatagatgacagtgatagtcaacaatatgatattagcccagctgaagcaaagttagtcgcaaaagaaattattcgattgcataaagaagagaatgttccctttcaagatatcaccctcttagtttcttcaaggacaaggaatgatggtatcttacaaacttttgaccgttatggtattcctttggtaactgacggtggggagcaaaattacttaaaatcagtcgaagtgatggtaatgcttgatactttgcggtcaattgataatcccttaaatgattatgctctagttgctcttttgagatctcccatgtttggctttaatgaagatgatttaacaagaattgctattcaggatgtcaaaatggctttttatcataaagtgaaattgtcttatcataaagaaggtcatcatagtgatttaattactccagaattatcttctaaaatagatcactttatgaaaacattccagacttggcgtgattttgctaaatggcattcgctttatgatttaatatggaaaatatataatgaccgtttttattatgattatgtaggagctctgcctaaagctgagcaacgtcaagccaatctatatgccttggcacttcgagcaaatcagtttgaaaaaacaggtttcaagggtttatcacgctttattcgaatgattgataaagttttagaaaatgaaaatgatttggcagatgttgaggtggcattaccgcaaaatgctgttaacctaatgactatacacaaatcaaaggggcttgagtttaagtatgtatttattttaaatattgataagaaattttcaatggtagacataacttcccctcttattttaagccgaaatcaaggaattggtattaaatatgttgctgatatgcgacatgaactcgaagaagagatactgcctgcagtaaaggttagcatggaaacacttccttaccaacttaataaaagagagttacgcttagctactttatcagagcaaatgcgtttactttacgtagctatgacacgtgcagagaaaaaattatatctggttggtaaggctagtcaaaccaaatgggctgatcattatgacttagtatctgaaaataatcatctcccattagctagtcgtgagacttttgtgacctttcaagattggttactggctgttcatgaaacctataagaaacaagagttgttttatgacatcaacttcgtatcattagaggaattaacagatcaccacatagggatggttaaccctagtctacctttcaatcccgataataaggtagagaatcgtcagtctgaagatatcgtgcgtgcgattagcgtgttagaatctgttgagcagattaatcaaacttataaagcggctattgagttaccgacagtgagaacaccaagtcaagtcaaaaaaatctatgagcctattctagatatagaaggtgttgatgtgatggaaactattactaaaacatcagtagattttaagttacctgatttttctacaagtaaaaagcaagacccagcagctttaggatctgctgtacatgaattaatgcaacgcatagagatgtcatctcatgtcaaaatggaagatattcaaaaagctttgacagaagtgaatgctgaaacaagtgtcaaagcggctattcagattgaaaaaatcaactattttttccaagaaacctcactcggtaagtatatacaagaagaagtagaacatctgcatcgagaggcaccttttgccatgttaaaagaagatccggagagtggtgagaaattcgttgtacgtggtattattgatgggtatctactattagaaaatcggataattctatttgattataagactgataaatttgtcaatcctctagaattaaaagaacgctatcagggacaaatggctttatatgcagaagctttaaaaaaatcttacgagatagaaaagatagacaaatacttaattcttttaggtggtaaacagctagaagtggtaaaaatggattaaagaaaggaaaaaatgatagtcgaacaaaaatttggaaatggttttacttggattaacattgaagcagagcaattgcgaacagaaacatcggaaattcaagcaaaatatttggatagtgagattattacatatgctctggatgattatgaacgagcctttatggaatgttctcatattaaaggaaaagaagtcttgacgattatttttaatactattgatctaaagcagaaagaaagttattatgagaccgttccgatgaccttttgcttatcacacgaccgtttgataacggtgacacggtctcgaaatagttatatgctagaactattgcaaaaatatctagaccgtaatccagatgtctctcctaaaaaatttttatttgcagctttaactttgattacaaaacaatattttaatgttgtatcgaaaattgatagagaaaaggatattctcaaccgtcaattgagagaacaaacaaccaataagcgcttattagccatgagtgacctagagacaggatccgtttatcttttgacagctgccaatcaaaatgcattggtattagagcaattagatgttcatcctagtcagcgatttaattctgaagtggaaaaagaacagttatcagatgctctcattgaagcgcatcagttagtcagtatgacacaattaaacagtcaggtactttcacaattatcatctacttttaataatgtcttaaataataacttgaacgaaaacttaacaggtttgaatatcatttcgattaatttagcgattattgcagcaattactggcttttttgggatgaatattccattacctcttacagaatcacggagttcatggttaattgttattgctacttcggtcttactttgggttattattgctcaaattttaaaacgagtttttaacttaagaaaataaaaatattcggtgcttacgcaccgaatatttttttatttacctaagcagaattggctgaagagctgagttattagttcatctggagctgcatccccagtgatttctccaagtatttcccaagttctagtcatatcgacttgtaagagatcaacaggcattcctaattccaagccctcattgacagcttttaaactatcaacggctttttcaattagtgagatatggcgagcatttgatagataagtagcgtcatgttctaccataccagcgttgtcaaagaaaatatcgttaatacgttcttcgattttatcgatgttttcattttctaaaaccgaaattggaataacatttttaggtaattcgttaacttctattttttgaggaagatccgttttattgagtaatacgatacgattactttctttacttagttctagaagggagcggtcttgtaatgttagtggttcggaactattgagaaccaacaacacaaggtcggcttcttctaaagccttctttgaacgttcaacaccaattttttcaacgatatcatctgtatcacggataccagcagtgtcaactagttttaaaggaactcctttaatattgacgtattcttcaataacatcacgagttgttccttcaatatctgtcacaatcgccttttcttcacgtaagaggttatttagtaagctggatttaccgacatttggacgaccaatgattgctgttgaaagtccttctcgaagaatttttccacgtctggcagttcgaagtaaattttccataagtgcttgaaactcttgtgttttttcacgcatcagtgttgtagtcatctcttcaacgtcatcatattcagggtaatcgatattaacttcaacttgggctagagtatttaaaatttcttgtcgagtgttattgattagtgtctttaaagaaccatctaattgcttaacggcaatatccattgctttatctgttttagctctaataagatccataacagcttcagcctgagtcaagtcaactcgaccatttaaaaaagcacgtttagtaaattctcctggttcagccattcgtgctccatgtcgtaaaattaactgaagaatttcgttagtaactgcaattcctccatgcgtattaatttcaataacatcttctcttgtgaatgtttttggagcaagcataacgcctaacataacttcatccaagatttcatttttatctgggtccacaatatgaccatagtttaaggtatgggattggatcgcggatagatcttttccacgataaatttttgatgctatctttaaggcatctgtaccagatatacggacaataccaatagctccctcaccgagaggagttgaaatagctgcgatggtatcaaattcttttgtaatagacataaagtctctctctttcttggaaattactaacattcattgtaacctaaagccctaaaaggtgcaatcatttgattaaaagagaagatttccataatggttttatttgaaggtatgctataataaaactatgattatactacaaggaaacaaaattgagcgctcattttcaggtgatgtgctttttgataatattaatattcaagttgatcaacgtgatcgtattgctcttgttggacgtaatggtgctggcaaatcaacgcttcttaaaattttagttggtgaagaggctccgacaaaaggagaaataaataaaaagcgtgatttgagtttgtcctacttggcacaagatagtcgttttcaatctgaaaatacaattttccaagaaatgttacaagtttttgactcattaagagaagtagagaagcgcttacgtgaattggaattacaaatggggcaagtttcaggaagtgacctggaacaattgatgaaaacatacgatattttgtcagaagagtttcgtgaaaaaggtggctttacctatgaatcagatataaaggctattttaaatggttttaagtttaacagtgatatgtgggaaatgcctattagtgaattgtctggcgggcaaaatacacgattagcgcttgcaaaaatgctacttgaaaagccagaattacttgttttagatgaaccaacgaaccatttagacattgatacgattgcttggttagaaaattatcttgtaaattatcaaggagcccttattattgtcagccatgaccgctattttttagacaaggtagctacagtaacttatgatttaacgacacattctctagaccgctatgtaggcaattattcgaaatttatggatcttaaggcagagaaaatagcgactgaagaaaagaattttgaaaaacaacaaaaagaaattgctaagttagaagattttgtacaacgtaacattgttagggcttcaaccactaaacgagcacaagctcgtcgtaaacaattagaaaagatggaacgactcgacaaaccgaatgtagagcaaaaatcagctaatatgacttttcatgctgggaaagtctcagggaatgttgttttaacacttgagaatgcagctattggttatgaaggtgtttctttatcggagccaatcgatttggacgtgaagaaatttgatgctattgcaattgtaggtccaaatggtatcgggaaatcaactttaatcaaatcgcttgttgggcaaattccttttatcaaaggagaagcaaaattaggagcaaatgtcgaaactgggtattacgatcaaagtcaaagtaatttaacaaaaacgaatactgttttagatgagttatgggatgctttttcaacaacgccagaagttgaaattagaaaccgtttaggagcttttcttttttcaggtgatgatgttaaaaaatcagtttcaatgctatcaggtggtgaacgagcgcgtttgctattggcaaaattatctatggaaaataataattttctcatattagatgagccaacaaaccacttggatattgatagtaaagaagtcttagaaaatgcactcatcgaatttgatggcacattactttttgttagtcatgatcgctattttattaatcgtgtggcaactaaggttctcgaaatttctgataagggaagtactctctatctaggagattatgattattacctcactaagaaagccgaactagaggaattagcacgtttaaatgaagaagaagtgagtgcttcaaaaacagaaatcgacgttacatcagattatgagacacaaaaagcaaatcaaaaggaatttaggaaaattacccgtcgcgttgtagaaattgaggcgcgtttggaagttcttgaaaatgatgaaaacaatatcaatggtttaatgttagaaaccaatgacatcggaaaactctctgatttgcaaaaagagctggaatcaatccaagaagaacaattgctattaatggaagagtgggaaaatctaaatatgagactagatttgtgagaaaatttcaaaaacaatagtttgtgaaaaaaagtacattttaaattgagatgccttttacgaaaacaaagaaagcggttcaaattcttgcatcttgtgaaaaaaacttatacaataattaagtaataaagatttttttggaggttagaatggtaactctatctaaagaacaacacttggatatgtttctaaaaatgcaacgtattcgtgatgttgatatgaaatttaacaaattggttcgtcgtggtttcgtccaagggatgactcacttctctgttggtgaagaagctgcttcagtaggtgctatccaagatttaacagattcagatatcattttctcaaaccaccgtggacacggacaaactattgcaaaaggtattgatattggtggaatgtttgctgaacttgctggtaaagcaacaggaacatcaaaaggtcgtggaggctcaatgcacttagcaaaccttgaaaaaggtaactatggaacaaacggtatcgtcggtggaggatatgcgcttgcagtaggtgctgcccttacacagcaatatgaaggaactgataacattgttatcgccttttcgggtgactcagcgactaacgagggctcattccatgagtcagttaacttagctgctgtttggaacttaccagttatcttctttatcatcaacaaccgttatggtatctcaacagacatcacatactcaactaaaattcctcacctttacatgcgtgctgatgcgtacggtattccagggcattatgttgaagatggtaatgaccttatggctgtttacgagaaaatgcatgaagttatcaattacgtgcgttcaggaaatggaccagctattgtagaggttgaatcataccgttggtttggtcattcaactgctgatgctggggtataccgtactaaagaagaagttgattcatggaaagctaaagatccagtaaaacgctaccgtgcatacttaattgaaaatgaaatcgctactgaagaagagcttgcagctattgaagcacaagtgattaaagaagttgaagaaggggttaaattcgctgaagaaagtccattccctgatatgtctgttgcatttgaagacgtttttgtggactaaaataacctaaagtagatgagatttatctcgttctattattcaattgattaaaaaacggatattcggaggaaataatgagcgaaactaaagttatggctttgcgcgaagcgattaatgtcgctatgagcgaagaaatgcgcaaagatgaaaaagtatttttaatgggtgaagatgtaggtgtatatggaggagacttcggtacatctgttggtatgttagaagagtttggtgctaagcgcgttcgcgacacaccaatctcagaggctgcgattgcaggttcagctatcggtgctgcacaaacaggtttgcgtcctatcgttgatttgacattcatggattttgtaacaatcgcaatggatgctatcgttaaccaaggtgctaaaacgaattatatgtttggtggaggtctatcaactccagttactttccgtgtggcatcagggtcaggtattggttcggctgcacaacactcacaatcattagaagcttggttaacacacattccaggtctaaaagttgttgcacctggtactgttaatgagtcaaaagcacttttgaaatcttctattcttgacaataacccagttatcttcttagagccaaaagctctctatggtaagaaagaagaagttaatatggaccctgatttctatattccacttggtaaaggggatattaagcgtgaggggactgacttaacaattgtttcttatggccgtatgcttgagcgtgttatgcaagctgctgaagaagttgctgaggaaggtattaacgttgaggttgttgatccacgtacacttattccgcttgataaagaattaattatcgattctgttaagaaaactggtaaattgatcttggttaacgatgcttataaaactggtggtttcactggtgaaattgcaactatggttgctgaaagtgaagcatttgattaccttgatcatcctatcgtgcgtcttgcaagtgaagatgttccagtaccgtattcacgtgtacttgaacaaggaatcttacctgatgtagcaaaaattaaagatgctatctataaagtagttaacaaaggtaaataattcataaaacaaagagggactgaggaatgagtgaaaacttagcctctttccttgtttataggttttaatttatatcgttagatgaaacatatatttgacgatatagtttagtgtgaaaggaaaactatggctgtcgaaattattatgcctaaactcggggttgatatgcaagaaggcgaaatccttgagtggaaaaaacaggtaggtgatgttgttaatgaaggtgacgtcctacttgaaattatgtcagataaaacaaatatggagattgaagcagaagactcaggtgttttactaaaaatcacacatgggaatggagatgttgttcctgtaactgagacaattggttatattggtgctgaaggtgaagaagtaacagaagcatcttcttctgaaaatacatcagttgaagaaaacgcgacacaagtaacttcagaaccagaaaaagttgaagaaacatcagaaccaagtgtgccagcagctacaagtggtgaaaaagtacgtgccactcctgcagctcgtaaattagcaagagagatgtctattgaccttgcactagtatctggaacaggggcaaatggtcgcgttcacagagaagatgttgaaaacttcaagggtgctcaaccacgtattacaccattggcacgtcgaattgctgaagatcaaggagttgatatagcagaaatcactggcagtggtattcgtggtaaaattgttaaaaatgatgttttggctgctatgtcaccgcaagcagcagaggctcctgtagaaactaaagctacaccaacaacagaagaaaaacaattaccagaaggtgttgaagtcattaagatgtctgcaatgcgtaaggctatttctaaaggtatgactaactcttacctcactgctccaagctttacacttaactatgacattgatatgactgaaatgatggctcttcgcaagaaattaattgatccaatcatggctaaaacaggcttgaaagtcagctttactgatttgattggaatggccgttgttaagacattgatgaaaccagagcatcgatacctaaatgcttcattaattaacgatgcacaagaaattgagcttcataattttgttaatattggaatcgcagttggtcttgatgatggtttgattgttcctgttgttcacaatgctgatcaaatgtcactttctgactttgttatagcatctaaagatgttattaagaaaactcaagaaggtaaattaaaatcagctgaaatgtcaggttcaacattctcaattactaacttaggtatgtttggtactaagacgtttaacccaattatcaatcaaccgaactcagcaatccttggagtaggagctactattccgactccaacagtggttgatggtgaaattgtagctcgaccaattatggcaatgtgtttaacaattgaccaccgtattgttgatggaatgaatggtgctaagtttatggttgatcttaagaacttaatggaaaacccatttggtttacttatttgattccgtaggtcttaatttgatataataagttattcgaaaaacgaaagaggaaataaaaaatggcttttgatgtaattatgccaaaacttggggttgacatgcaagaaggcgaaatccttgagtggaaaaaaaatgaaggtgacaccgttaatgaaggtgatgtccttcttgaaatcatgtctgataaaaccaatatggaaatcgaagcagaagacactggtgtacttttaaaaattgtacatcaggcaggagatgttgttcccgtcactgaagtgattgcctatatcggagaagaaggtgaagaagtaggtacgtcatcaccttcagctgatgcaactatcacagctgaagatggtcaatcagtttctggacctgctgctccttcacaagagacagttgcagcagcaactcctaaagaagaacttgcagctgatgagtacgatatcgtagtcgtaggtggtgggcctgcaggttattacgcagcaatccgcggtgctcaacttggaggaaaaattgccattgttgagaaaactgaatttggcggtacgtgtttgaatgttggttgtatccctacaaaaacatatcttaaaaatgctgaaatcctagatggtttgaaagtagcagctggacgtggtatcaaccttgcttcaactaactatgcaattgatatggataagactgttgcctttaaaaattctgtagttaagacactgactggtggtgtacgtggtctcttgaaagcgaacaaagttgaaattttcaatggacttggacaagtaaaccctgataagtctgttgttattggcgataaagttatcaaaggtcgtaacgtcgtccttgcgactggttctaaggtatctcgtattaatattccaggtattgaatcaccattagtattaacatcagatgatattcttgatttacgtgaaattcctaagtcacttgctgttatgggtggtggtgtcgtaggtattgagcttggtcttgtatgggcttcatatggtgttgacgtaactgttattgaaatggctgatcgcatcattccagcaatggataaagaagtatcgctagaacttcaaaaaatccttgctaagaagggaatgaagattaaaacatcagttggtgtttctgaaattgttgaagccaataatcaattaacgcttaaattaaacaacggtgaagaagttgttgctgataaagctcttctttcaattggacgtgttccacaaatgaatggtcttgaaaatcttgagcctgaacttgagatggaacgtggacgtattaaagttaatgcttatcaagaaacttcaattccaggtatctatgcaccaggtgatgttaatggaactcgtatgttagctcatgctgcataccgtatgggtgaagtagctgctgaaaacgcactcggcggtaataagcgtaaagcacatctagatttcactccagcagctgtttatactcatcctgaagtagcaatggtggggatgacagaagagcaagcacgtgaacaatatggtgacatattagttggtaaaaatagctttacaggcaatggtcgtgctatcgcttcaaacgaagcacatggttttgtaaaagtaattgctgaacctaagtataaagagattcttggtgttcacattattggtccagctgcagcggaattgattaatgaagcttctacgattatggaaaatgagttgactgtctacgatgtagcacaatctatccatggtcacccaacattctctgaagttatgtacgaagctttcttagatgttctcggtgaagctattcacaaccctccaaaacgcaaataattttgtttaatatatttgagattgagcttttatagcttcaatctcttttcacgtatatattgtctgaatattataaaatattagttaggaatttaaaatgaaatatatcgttaacacgtctaatgatccggcttacaatgttgctttagaagcttacgcctttcaaaagttgacagatatcgatgaaatctttattctttggattaatgaaccggctatcattattggacgccatcaaaatacaattcaagaaattaacaaagagttcattgataaaaatggcatccatgttgtccgtcgtttgtcaggaggcggagcagtttatcatgacttgaataatttaaactacactattatttctaataatacacaagaaggtgcctttgatttccaaactttttcaaaaccagttattgatactcttgctaaattaggtgttaaagcagaatttactggtcgtaatgatttagaaatcaatggacaaaaatttgcaggaaatgctcaagcttattacaaaggtcgtatgatgcatcatggttgtcttttatttgatgttgatatgtcagtcttagggcaagcactcaaagtatctaaagacaaaattgaatctaaagggataaaatctgtacgcgcacgtgttacaaatattgttgaccatctttcagataaaattacagtacaagaatttagcgatgccattttagctcaaatgaaggaagaatatccagagatggatgaatatgttttgagtgatgccgagttatcagaaatccaagctatgcgcgataatcaatttgctacatgggattggacgtatggtaaagcacctgaatacaccattgaacgtggtgtccgctatccagctggaaaaattacgacttatgctaatgttgaaaattcaacgataaaatctgtcaaaatctttggtgacttctttggagtgaaacctgtggatgatattgaaaaaatgttggagggtgtccgctacgattacaaagatgttttagcagcgcttaaaacagttgatacaagtcaatacttctcacgtatgacacccgaagagattacaaaagctattgtagactaaaatcaaaaaatctagtcaaagtcttcgcctttggctaggttttttgtatggttaagtgacgttatagtagtaaaaaaacaacgttattgataacgctggtttttatattattcaaaatctgcttttgatttaacgtctccgtattcttcaggaatctctaaagataaaatttcttcataactagggaggacaatctctttaccgtatttgttacggagggcagttgccacaagacggtaagctagattagcattacgagaaaggattggaccgtgaaagtatgacccaaaaacattcttataatgaaccccttcagtaccatcttctttgttattcccatttccataaatgacggttcctaaaggtttttcgtcttctgataaaaaggtacgtccttgatgattctcaaagccataatatgtttcattgaattcatcgttgtgaatcttgatatcaccaatatagcgattattattttggtttagcgtatagtgtcccataacgccaatgccctctattcgttctccattagcttgaatatagtattgtcctaaaagttggaaacctccacaaatagcaagtactacaccattattttgaatgaatttgttaatgtcttctttcttactgggaagatcgcgtgcaacaatggcttgttcgtagtcttgtccaccaccaaaaaatgccatctgataatagttgggatcaaatctatcttctaatgaaacgatatcaaatgtcatttgacatcctagtttttctcccacatatttcatcattaagatatttccgttatcgccataagtatttaataggttaccataaagatgagctacattaagagtgtatttataatctttggtagtaggagattttagtgaggtataagtcattaattcatctcctttctgatagcgttgtggttagcaagaatttcacgaaactccagcatagctgtatatgttgctaaaatataagcatgctcagtctcttgctgctcaatcattgtcataatatcttgcagtttatcagcttgttttatgcgtttctcatcataaccagttacacgtaagcgacgagcaatttcagagtggcgaacaccaccagcaaatatttctgggatattcatcgtgagaatagtttcaaaattagcgtcccaaatccaagaagtatcaataccgtcagcataattggcattcagtagtactgagagagagaacgggtatggagcaagtttaatcatatcaagagcttgactagctcctaccggatttttaatcagaactaaagtacattttttatttccaattgtaaaggtttcttgacgaccaaaaacggcacggcttttatcaaatccatccttaatttgacttggttctacaccaaaatattcagcaacagatactgccgccaaagcattgtaaatattataaaggccacccacgttgatattatattgttggccatcaataacgaaacctgatgaagtatttgtcagatgtgttagccttgttaaggcataatcaaggtttggacgttcaaaatcacaattaggacaagtgtagtcaccaaggttggcatatgtgttcaatcgataagttaaaattgcttgacactttggacagagaataccctcagtattatagtgtgctaatcgtggctcatgtttgtcggtattaaatccatagaattgcacagggttagtcacgcttttagaattaaaaagtggactgtcaccgttagctaagatagtagcttgcggagcgttagcagctccatctaaaatcatttgataagttgtgtagatttcgccataacggtccatttgatcacggaaaatattggtaaagacgaacaaactaggctttatatactgtgtaatacggggtaaactcgcttcgtctatttcaaggacagctatttttttaccagatttacttttcttagctgttaggaaggtcgaaacaatacctgtaatcatatttgctccacttgggttggttaccacctgaccgaaggcttcctttaaaataccaactgttaaagctgttgttaaggttttaccgttagtaccagtcacaactacaatttcataatctttggcaattgtatctagtatatctttatcgaatttgagtgctaaactacccggataagtagagccacgtcccattttacttaaaaggtaatgagcagacttaccggcagccactcctagtgctgtatttattttcataaagatattttatcataaaaagatgctttcttgctaaagaaaatattatgaaaacatggtataatgtagacgatggaaaataagaaatcaaggagttaagcaagaaactcttcgacaggctaccagtagagaggaagatatggatattttttcagctattgattcaaagttttgggcgagcattatggaaaatccatggatgatccttattcatctcatggatattatcatagtagctgttctgatttataaatttatcaaagcgctagcaggcacaaaaattatgtccttaattcagggcgttattttgtttatcatcattagatttgtgtcagaatggatagggctaacaacgattacatttttgatgaatcagattgttacttatggtgtaattgcaggtgttgtcatctttgctccagagattagaacaggtctcgaaaaatttgggcgaacaccacaactatttacgcaacgttctcaattaagcagtgatgaaaagctagtagatgcccttgttaaggcagttgcttatatgagtccgcgtaaaataggagccttgatttcaattgaacgtacccaaactttgcaagagtatatagctacaggtatcccattagatgcagatatttccagtgaattgttaattaatattttcattcctaatacaccactgcatgatggtgctgttattgtaaaagataaaaaaattgctacagcatgctcgtacttacctctatcagaatcatcttcgatttcaaaagaatttggaacacgccacagagcagcgattggtctatcagagaattcagatgcactaacagttattgtttctgaagagactggtggtatttctgttgctttgaaaggtgaatttttacatgatctttctaaagatagctttgaagcaattctgagaactcagttgattcaaaatcaagaggaaaactcaaaattagcttggtataatcaactattgaggaggaagtagacatgaaaaaattttttacaaataaattttggttaggcgttgtctcactctttctggctattttattatttttaacggcaactgcaacaagtatgaaccatcaagacaatagtaagattgcaggagcgtctgagacatatacacataccctaacagatgtgccaatagacatcaaatacgatagtgatgattactttattagtggatattcttatggggcagatgtctatatgtcatcggttaatcgtgttaagttagattctgaaataaatgaggatacacgaaaatttaaagtagtcgccgatttgacaaatatgaaaccagggactcacaaagtcccactaaaggtagtaaatttgccatctggtgtaaatgctacggtttctccaacaacaattacagtaactatgggtaaaaagaaaacaaaagagtttccggtttatggacatgttaatgataagcaaattaaagctggttatgcagtcgataagatgtcagttgatgtgtcaaaagttaaagttactagtgatgaatctattatagatcgtattgaccatgtcgctgccaatatccctgatgataaagttcttgatgatgattttaacaagacagttactttacaagctgtaacagcagatggtacagtattagcaagtattattcacccttctaaagcaactttatctgtcaaagtaaaaaaattgaccaagacagtaccgattaatttgataccagtaggacaattcagcgatagtatttcaaaaattaactacaagttgagtcaagaaaaagcagtaatttcaggaacaaaagaggctttagaagctatttctgttattaatgctgaggtagatatttcagacgtaactaaaaatacagaaaagaaaattaatctttctgcaaacaatgtttcagttgatcctgctcaagtaacagttcaattgacaactactaaaaaataatagataataaaaacgaaaaaaatggaggtagcgtttttcgctagaaaaaaattatgggaaaatattttggtacagatggtgttcgcggtgaagctaatgttgaactgacgccagaattggcttttaaattaggacgttttggaggatatgttctaagtcaacacgaaactgatcgtccgagagtttttgtagctcgtgatactcgtatttctggtgaaatgctggaatctgctttgattgctggtctactttcagtaggtattgaggtttataaacttggtgttttagccactcctggagtgtcttaccttgtccgtacagaaaaagctagtgcaggggttatgatttcagcaagccacaatccagcacttgataatggtattaagttctttggtagtgatggttttaaacttgatgatgatcgtgaattagaaattgaagctttacttgatgcgaaggaagacactttaccacgtccatcagcacaaggtttaggtactttagtagattatcctgaaggacttcggaaatatgagaagtttatggaatcaactggtattgatttagaaggtatgaaggttgcgttggatacagcaaatggagcagcaacagcctcagctcggaatatctttttagacttgaatgctgatataagtgttattggtgatcaaccagatggtttgaatatcaatgatggtgttggttcgacacatcctgagcaattacaaagtttagttagagaaaatggttccgacatcggtctagcttttgatggtgatagtgatcgtttgatcgctgttgatgaaaatggagagattgtagatggtgataaaattatgtttatcattgggaaatatctctctgataaagggcagcttgctcagaatacaatcgtaacaacggttatgtcaaatctcggctttcataaagcgctcgaccgtgaaggaattcataaagcgattaccgctgtaggagaccgctacgtggttgaagaaatgcgtaaatcaggatataatcttggcggagagcaatcaggccacgttattatcatggattacaatactacaggggatggacaattaacagccatccaattgactaaggtcatgaaagaaactggtaagaaattatcagagttagctagtgaagtgacgatttatcctcaaaaattagtaaatattcgtgttgaaaataacatgaaagataaagcgatggaagttcctgcaattgcggaaattattgctaaaatggaagaagagatggatggcaatggtcgtattctagtacgtcctagtggtactgagcctcttcttagagttatggcagaagcgccaacaaatgaagcggttgattattatgttgatactatcgcagatgtcgttcgtacagaaattggtttagattaaaacggcgttattctgctataaagtcgtcaatgttataaaataataaagagatggaattggagtggagcatcaagcatacgcctttctctctctttttgatttgagaagggagtttagagaaaatgactaaagaagcagaattattatgggctaaacacaagtatttagtcttaagtaaatctcagaaaatttatttggatattagacaaactttgaaatcaccaaattgtaccgttttagacgttcagtcactcattgaccaagcagtgcttttagaagaatcaccatcacaagtgactaatgcttatatgcatatatggggctattttaaaaataaggcagagcgtcaagaaaaagaagaatttttaaccttgctggaaaaatacaggaaaacaggttatcaacgaagaaaactgttagcttttctaaaacagctattagctaaatacccaaattcttatttacaaaactcttctattttcgaagaagagtaaaagattgatagttgaggtatataaatgagattatggcatcaagatattattgagttattgcctaggcagcaacttttaggacagcatagagagtgttgtgcattgagagggaatgggtgggggagaaaacatgagactgttgattatgtttttcgatattcaccttataggttatttgcatatcatcaattagttatggaagaaatgatggagcgtgggtatcgtgtatctaaagaatggctaattgcagaatataggggaatgaagtgcccaagatatgatacacttaatcctgttgacttggagacacctatctatcccgagcacaatcaagactatctacaagaatgtctatggaatttaaaagcaaaaggaattgaccttcctataaataagataaaatagagatttatctctattttattttggaataaaaagctatattatcaagttttagaggagtgtttttttaagggcaaagtggtaaaatagaaacatgttaaagaaaccaacctcagcatatgtacacattccattttgtacccaaatatgttattattgtgatttttcaaaagtttttattaaaaatcagcctgtagacgcttatcttcaggctcttatccgtgaatttcggtcttatgatattacagaattgcgcaccttatatattggaggagggacacctacatctataagcgctgtgcaactggactatttattgacggagttaagtagagatttaaacttaaatactttagaggagttcactatcgaagctaatccaggagatttaaccgttgataaaatagaggtgcttcaaaagtcagctgtcaatagagtttctctaggagttcagacctttaatgataaacatttaaagcgtattggacgcagtcacaatgaggcacaaatttattctacaattgatgctcttaaaacagctggttttcaaaatatctctattgacctaatttatgccttacctggacaaacgatggatgatgttagaagtaatgtagccaaagctctctctctaaatattcctcatttgagtttatatagtttaattttagaacaccatactgtatttatgaataaaatgcgtcgtgggaaattacatttgccaacagaagatttagaagccgagatgtttgaatatatcatttctgaaatggaaagaaatggttttgagcattatgaaatttctaattttacaaagccgggttttgaaagtcgtcataatttgatgtactgggataatgtagaatattatggtgttggtgcaggcgcttctggttatcttgatggtattcgttatcgtaatagagggccaatacaacattatctaaagggggtttcagaaggtaatgcaaggttatctgaagaagtattatcaaaaaatgaaatgatggaagaggagcttttcctcggtcttcgtaaaaaagagggtgtttccatcggaaaatttgaacaaaaatttggaacgtcctttgagaaacgttacggtcagattgttcaagaactccaaagtgatgggcttttgaaagaaaataatggttttatccagatgactaaaaaaggtctcttcttaggagatacggttgccgagaaatttattgtggagtaaaaaatgggtttattatatcgagaaacttacgaagtgcctttttatgaatcagacactaatcattatatgaaattaccgcagttgttggctttagcgttacaaatttcagccaaacaatctttaaaattaggaataggcgatgacatcgtttttaaaagatacggattggtttgggtcgttacagattatattattgatattgagcgtttacccaagcatgctgaaaagatagtcattgagactgaagccaaagctcataataaattattgtgttaccgctatttttatatttatggtgaagacgggcaaaaaataataacgatttcatctgcttttgtcttaatggattttaaaacacggaagattcatcctgttcttgatgatattacttcaatttaccaatcccaaagaatcaaaaaagttattcgagggccgaaatatcatcccattggagatagtaaagttaaacaataccatgttcgttattttgatttagatatgaatggacatgttaataatagtaagtatctagaatggatgtatgatgtgttggacttagattttctaagtagccacattcctaaaaaaattgatttaaaatatattaaggaaattcaatatggaacggatattaagtctcattggtatcaagatggtcttgtgacacgtcatgatattattggtggcgatgctattcatgctcaagctaggattgaatggcaggaaaaaaaggaggattaaatggcttataaaggatatcttattgatttagatggtactatttacaaagggaaaagtcgtatcccagcaggagagcgttttatcgaacgtttgcaagaaaaaggcattccttatatgttagtaactaataatacgactcgtacaccagaaagcgttcaggaaatgcttcgaggcttcaatgttgaaacaccacttgaaacaatctataccgcaactatggctacggttgactatatgaatgatatgaaccgtggaaaaacagcttacgttattggtgaagaagggcttaaaaaagctattgcagatgcaggttatgtggaggatacaaaaaatccagcctatgtggttgttggtttagattggaatgttacttatgataaattggcaactgctacgttagcaattcaaaatggtgctttatttattggaaccaatccagatttgaatattcctactgaacgtggtttattacccggtgctggctccttaaatgctttattagaagccgcaacgcgtataaaaccagtctttattggaaagccaaatgccatcattatgaataaggcacttgaaattttaaatattcctagaaatcaagcagtcatggtcggtgataattatttgacagatatcatggctggtattaataatgatattgatactttgttagtaacaacgggttttacaacagttgaagaagtaccagatttaccaattcaaccaagttatgttttagcaagtttagatgaatggacatttaatgaaggataagttattagtagttttaacttggatttggattatatcgttagcaactctagctacaatttatattgcttggttgatctatcctatagaaattcagtttttaaaattagaaaaggttgtgtatttaaaggctgaaacaatttattataattttaataagttgatgatatatctgactcatccttttatctctgatttaaatatgcccagctttccttcttcagaggatggtttaaagcattttgcggatgtaaaatatctttttactctagcgcatgggctttttgttatactaacttttccagttatttattttttaagacgtggatggaagcaaaaaagtatctttctatatgaaggctttttcaagatagctattatgttgcctatttttattgtagtatgtgcctttctgttgggttttgaccagtttttcactctatttcatgaggtgctttttccaggagattctacttggcaatttaatcctctaacggatccagtaatttggatacttcctgaaacttttttcctccattgtttcatcatttttttgttaatctatgaaacaataactataattcttttgataataggtagaaaacatttaaaattaagaaaatataaaaacaaaatgcaagccttataatagcgcttgcattttgtttgctatttttttataatacaaatatgagaaatgtcggaattataacaatgacataaaaaagcaccgaatcggtgctcactttttcaagctgaatacggactggattaaaaatcactgccttattttaacgtgctgtgctgtttcgaataattccaacaaaattattatatgttattttagtgtaataatcaagtaaaaaataaaaatcagcaaagctttaaaacttaaaacatactttaggatattttaacaaataacagatgaaagataaagataatgcttttaaaattcaaaaaaataatatataattaaagtatgttttaaaggtgttgtttttagaatggtgttttaaataaaaggagaaaagttatgaataagccatattcaataggccttgacatcggtactaattccgtcggatggagcattattacagatgattataaagtacctgctaagaagatgagagttttagggaacactgataaagaatatattaagaagaatctcataggtgctctgctttttgatggcgggaatactgctgcagatagacgcttgaagcgaactgctcgtcgtcgttatacacgtcgtagaaatcgtattctatatttacaagaaatttttgcagaggaaatgagtaaagttgatgatagtttctttcatcgattagaggattcttttctagttgaggaagataagagagggagcaagtatcctatctttgcaacattgcaggaagagaaagattatcatgaaaaattttcgacaatctatcatttgagaaaagaattagctgacaagaaagaaaaagcagaccttcgtcttatttatattgctctagctcatatcattaaatttagagggcatttcctaattgaggatgatagctttgatgtcaggaatacagacatttcaaaacaatatcaagattttttagaaatctttaatacaacttttgaaaataatgatttgttatctcaaaacgttgacgtagaggcaatactaacagataagattagcaagtctgcgaagaaagatcgtattttagcgcagtatcctaaccaaaaatctactggcatttttgcagaatttttgaaattgattgtcggaaatcaagctgacttcaagaaatatttcaatttggaggataaaacgccgcttcaattcgctaaggatagctacgatgaagatttagaaaatcttcttggacagattggtgatgaatttgcagacttattctcagcagcgaaaaagttatatgatagtgtccttttgtctggcattcttacagtaatcgacctcagtaccaaggcgccactttcagcttctatgattcagcgttatgatgaacatagagaggacttgaaacagttaaaacaattcgtaaaagcttcattgccggaaaaatatcaagaaatatttgctgattcatcaaaagatggctacgctggttatattgaaggtaaaactaatcaagaagctttttataaatacctgtcaaaattgttgaccaagcaagaagatagcgagaattttcttgaaaaaatcaagaatgaagatttcttgagaaaacaaaggacctttgataatggctcaattccacaccaagtccatttgacagagctgaaagctattatccgccgtcaatcagaatactatcccttcttgaaagagaatcaagataggattgaaaaaatccttacctttagaattccttattatatcgggccactagcacgtgagaagagtgattttgcatggatgactcgcaaaacagatgacagtattcgaccttggaattttgaagacttggttgataaagaaaaatctgcggaagcttttatccatcgtatgaccaacaatgatttttatcttcctgaagaaaaagttttaccaaagcatagtcttatttatgaaaaatttacggtctataatgagttgactaaggttagatataaaaatgagcaaggtgagacttatttttttgatagcaatattaaacaagaaatctttgatggagtattcaaggaacatcgtaaggtatccaagaagaagttgctagattttctggctaaagaatatgaggagtttaggatagtagatgttattggtctagataaagaaaataaagctttcaacgcctcattgggaacttaccacgatctcgaaaaaatactagacaaagattttctagataatccagataatgagtctattctggaagatatcgtccaaactctaacattatttgaagacagagaaatgattaagaagcgtcttgaaaactataaagatctttttacagagtcacaactaaaaaaactctatcgtcgtcactatactggctggggacgattgtctgctaagttaatcaatggtattcgagataaagagagtcaaaaaacaatcttggactatcttattgatgatggtagatctaatcgcaactttatgcagttgataaatgatgatggtctatctttcaaatcaattatcagtaaggcacaggctggtagtcattcagataatctaaaagaagttgtaggtgagcttgcaggtagccctgctattaaaaagggaattctacaaagtttgaaaattgttgatgagcttgttaaagtcatgggatacgaacctgaacaaattgtggttgagatggcgcgtgagaatcaaacaacaaatcaaggtcgtcgtaactctcgacaacgctataaacttcttgatgatggcgttaagaatctagctagtgacttgaatggcaatattttgaaagaatatcctacggataatcaagcgttgcaaaatgaaagacttttcctttactacttacaaaacggaagagatatgtatacaggggaagctctagatattgacaatttaagtcaatatgatattgaccacattattcctcaagctttcataaaagatgattctattgataatcgtgttttggtatcatctgctaaaaatcgtggaaagtcagatgatgttcctagccttgaaattgtaaaagattgtaaagttttctggaaaaaattacttgatgctaagttaatgagtcagcgtaagtatgataatttgactaaggcagagcgcggaggcctaacttccgatgataaggcaagatttatccaacgtcagttggttgagacacgacaaattaccaagcatgttgcccgtatcttggatgaacgctttaataatgagcttgatagtaaaggtagaaggatccgcaaagttaaaattgtaaccttgaagtcaaatttggtttcaaatttccgaaaagaatttggattctataaaattcgtgaagttaacaattatcaccatgcacatgatgcctatcttaatgcagtagttgctaaagctattctaaccaaatatcctcagttagagccagaatttgtctacggcgactatccaaaatataatagttacaaaacgcgtaaatccgctacagaaaagctatttttctattcaaatattatgaacttctttaaaactaaggtaactttagcggatggaaccgttgttgtaaaagatgatattgaagttaataatgatacgggtgaaattgtttgggataaaaagaaacactttgcgacagttagaaaagtcttgtcataccctcagaacaatatcgtgaagaagacagagattcagacaggtggtttctctaaggaatcaatcttggcgcatggtaactcagataagttgattccaagaaaaacgaaggatatttatttagatcctaagaaatatggaggttttgatagtccgatagtagcttactctgttttagttgtagctgatatcaaaaagggtaaagcacaaaaactaaaaacagttacggaacttttaggaattaccatcatggagaggtccagatttgagaaaaatccatcagctttccttgaatcaaaaggctatttaaatattagggctgataaactaattattttgcccaagtatagtctgttcgaattagaaaatgggcgtcgtcgattacttgctagtgctggtgaattacaaaaaggtaatgagctagccttaccaacacaatttatgaagttcttataccttgcaagtcgttataatgagtcaaaaggtaaaccagaggagattgagaagaaacaagaatttgtaaatcaacatgtctcttattttgatgacatccttcaattaattaatgatttttcaaaacgagttattctagcagatgctaatttagagaaaatcaataagctttaccaagataataaggaaaatatatcagtagatgaacttgctaataatattatcaatctatttacttttaccagtctaggagctccagcagcttttaaattttttgataaaatagttgatagaaaacgctatacatcaactaaagaagtacttaattctaccctaattcatcaatctattactggactttatgaaacacgtattgatttgggtaagttaggagaagattgatatggcaggttggcgaaccgttgttgtaaatacacattctaagctctcttataaaaataatcatctgatttttaaagattcttatcagacggaaatgattcatctatcagagattgacattctaatcatggaaacaacagatatcgttttgtcgaccatgctgattaaacgtttggttgatgaaaatattttagttatattttgtgacgataaacgcttgccaacagctatgttaatgccgtactatgccagacatgattcgagtttacaattatctaggcagatgtcatggattgaagatgtcaaagcagatgtttggacatcaattattgcacaaaaaattttgaatcagtctttttatctcggtgagtgttctttctttgaaaaatcccagtctattatgaatctctaccatgacttagaaccttttgatccttctaatcgtgaggggcatgctgctaggatttatttcaatacactttttggaaatgatttttcaagagagcaggataatccaataaatgctggtttagactacggatattcattgcttttgagtatgtttgcgcgtgaagttgttaagtgtggttgcatgacacaatttggcttgaagcatgctaatcaatttaatcagttcaacctagcaagcgatattatggaaccatttcgcccaatcgttgataggattatttatgaaaataggcagagtgattttgtcaaaatgaaaagagaactcttttctatgttttcagagacatacagctacaatggtaaagaaatgtatctctcaaatattgtcagcgactataccaaaaaagttattaagtcgctaaatagtgatgggaatggaattccggagtttaggatatgagttatcggtatatgcgaatgattttaatgtttgatatgcctactgaaacagcagaagaacggaaggcgtatcgtaagtttagaaagtttctcttgagcgaaggctttatcatgcatcagttttctgtttatagtaaattattactcaataatacagctaataatgctatgataggtcggcttaaagtgaataatcctaaaaagggtaatatcacactcttaacagttacggaaaaacaatttgcgagaatggtttacctccatggagaacgcaacacaagtgttgccaactctgatagtcgcttggttttcctaggagattcttatgatcaagattaattttccaattttagatgaaccattagtgttaagtaatgctacgattttaacgatagaagatgtttcagtttattcttcattggtgaaacatttttatcaatatgacgtagatgaacatttgaaattatttgatgataagcagaaaagtctgaaggcaacagagttaatgctggttacagatatcttaggatacgatgtcaactcagcacctattctaaagttgatacatggtgacttagaaaatcaattcaacgaaaagccagaagtgaaatcaatggtagaaaaattagcagctactattacagaacttatcgcatttgagtgtctagagaatgagcttgatttagaatacgatgaaattaagattttagaactcattaaggcactgggagtcaaaattgagacacagagcgacactatctttgaaaaatgttttgaaattatacaagtttaccattatttaacgaaaaagaatctcttggtttttgttaatagcggagcttatcttaccaaagatgaagttataaaattatgtgaatacatcaatttaatgcaaaagtcagtactctttctagaacctagaagactctatgatttaccgcaatatgttattgataaggattatttcttgataggcgaaaatatggtataatattagtaaaagcacagtaataacaaggaatcatcgaaactgaagtcctgctgagacgaatggcgcgattacgaaagctcaaaagaaaattttctacgaggttttagagctgtgctgtttcgaatggttccaaaactaattgccaatgcttacaatatcttcgtcagttttagagctgtgctgtttcgaatggttccaaaacatgttctgaattacctttctcgacactccggttttagagctgtgctgtttcgaatggttccaaaacaccatcaaggctcttatctgcagattgttagttttagagctgtgctgtttcgaatggttccaaaacaaatggttgccaatgactttctagagtgatgttttagagctgtgctgtttcgaatggttccaaaacacaaaatcttttgttgctcctggacgtattgttttagagctgtgctgtttcgaatggttccaaaacatgtaaggtattgtaaaacttcttcttgcggttttagagctgtgctgtttcgaatggttccaaaacactgttcctataattaaaataaaagaggtagttttagagctgtgctgtttcgaatggttccaaaactgttccagtaaaaagtaattttaaagcattgttttagagctgtgctgtttcgaatggttccaaaaccgctcgattgatgctatcaactatattgaagttttagagctgtgctgtttcgaatggttccaaaacttcttcaagagaacttgtagaacagcttcagttttagagctgtgctgtttcgaatggttccaaaacaaggtacttttagcttgttcttgtggtgttgttttagagctgtgctgtttcgaatggttccaaaacacagctactgtaaattctgcttttacggttgttttagagctgtgctgtttcgaatggttccaaaactagtgcagttgtcaaggagattgtgagcgagttttagagctgtgctgtttcgaatggttccaaaactttaacctttgaaaatgtgaaaggctcgtagttttagagctgtgctgtttcgaatggttccaaaacgcgatgatggtaagtcatcatggacagcgtgttttagagctgtgctgtttcgaatggttccaaaacttttacacacgatgtcagatataatgtcaagttttagagctgtgctgtttcgaatggttccaaaacagtactgcactaggaattgtagagatcaaagttttagagctgtgctgtttcgaatggttccaaaaccgtaccatctatcaatttaccgcaagctgtgttttagagctgtgctgtttcgaatggttccaaaacttaaaagatttaaactatcaagcgtcaattgttttagagctgtgctgtttcgaatggttccaaaacttctaaatgctggtgactgctttgcataaagttttagagctgtgctgtttcgaatggttccaaaacttgctgctagacccaaacagtttatttttaggttttagagctgtgctgtttcgaatggttccaaaactccttttttagataatgtgcgatcacggacgttttagagctgtgctgtttcgaatggttccaaaacttttaccaatgcttccatatcgcttatatgttttagagctgtgctgtttcgaatggttccaaaactggttatacatttactaatccatcagcattgttttagagctgtgctgtttcgaatggttccaaaacaagctaattctcatctcaccgagatggatagttttagagctgtgctgttattatgctaggacatcattgtggtgttctagttttttgttatactgaaataaattttcagagaatgtgggggaaggcggtaattagattaattcaagacgtaattcagaacttagttggccaagctaacgaaatcaccccaatttatcagtttgattgggaaacttatatattggcgactaaaaaatatgaacgtcatttagaggtgtgtctattagtagaaaattcgaattgtttttcggattcaaagataatgtgtcaataaaagagatatgaaaggctataattccaaccttatggttaaagggctaggttgttctacgctttacttaattattagtttgacagcgttggttcttttagtgattgctggtgttttctttgtcattaatacttgcaagcttacaaggaaagcagtggagaacctatccataatcaactaacagctatgatggatctcacctattaatatagttaaggagtgtccaatactccttttttgaaatacagttggaagttacagaaaacatattttcatgttataatagtggagaaagaaatgaggtgctaatattatggaacaaaccttttttatgataaaacctgatggtgtaaaacgtggttttattggagaagttattagtcgtattgagcgtcgaggcttctctattgatcgcttagaggttagatatgcagatgcagatattttgaaaagacattatgcagaactgacggatagaccattctttccaacattagtagattatatgactagtggtccagtaatcattggagttatttcgggagaagaggtcatttcaacttggcgcaccatgatggggagtactaaccccaaagatgcccttccaggaactattcgaggagattttgcacaagctccctctccaaaccaagcgacatgtaatattgttcatgggtcagactcacctgaatctgcaactcgcgagatagccatttggttcaataactaatagacttaatgaagattgatgttcaagtgttaattctcttttacatcggtcttctttttgatataatattctagagtctataggactgttttaatactttagaagttaaacatatcaaattgtataggaaatagaatgaatattgaagatttgaagaaacgtcaagaaaagattagaaacttttcgattatcgctcatattgaccatggaaaatcaaccttagcagaccgtattttagagaaaacagaaacggtttctagtcgtgaaatgcaggcgcaactgttggactctatggatctagaacgtgagcgtggaattactataaagttaaatgctattgagcttaattatactgctaaagatggtgaaacttacatttttcacttgattgacacgccagggcatgttgacttcacatatgaagtatcacgttcattggcagcttgtgagggtgctatactggttgttgatgcagcccaaggaattgaagctcaaactctggcaaatgtttatttggctctagacaatgatttagagatactaccagttattaataaaattgatttaccagcagcagatccagaacgtgtacgtgcagaagtagaggatgttattggtctagatgcttcagaagctgtgcttgcctcagctaaggcagggattggtattgaagaaattttagagcagatcgttgaaaaagttcctgcaccgactggggaagtagatgctcctcttcaagctctaatttttgattctgtttatgatgcttatcgtggagtaattcttcaagtaaggattgtaaatggtatggttaagccaggagataagattcaaatgatgtctaatggtaaaaccttcgacgttactgaggttggtattttcactcccaaagcagttggacgtgattttttagcaactggagatgtagggtatattgctgcctcaattaaaacggttgctgatacacgtgttggtgataccattacccttgctaataacccagcaatagaacccttgcatggctataagcaaatgaacccaatggtttttgccggtctttatccaattgaatcaaataagtataacgatctgcgtgaagcccttgaaaaattacaattgaatgatgctagtctacagtttgaaccggaaacatcacaagcattagggtttggtttccgttgtggtttcttaggacttttacatatggacgttatccaagagcgcttggaacgagagttcaatattgatcttattatgactgcaccatcagtagtttatcatgttaatacaactgacggtgaaatgcttgaagtttcgaatccatctgaatttcctgatcctactcgtgttgacagcattgaagaaccatatgttaaggcgcaaattatggttcctcaagaatttgtcggtgctgtaatggagttagcacaacgtaaacgtggtgactttgtaacaatggattatattgatgataatcgtgttaatgttatttaccaaattcctttagctgaaattgtgtttgacttctttgataagcttaaatcatcaacacgtggctatgctagttttgattatgaaatttccgaatatcgtcgctcacaattagttaaaatggatattcttttaaatggtgataaagtggatgctttaagctttattgttcacaaagaatttgcctatgaacgtggtaaattgatcgttgataagttgaaaaaaatcattcctcgtcagcagtttgaagttcctatccaagcagctattggacaaaaaattgtggcccgttctgatataaaagcactacgtaaaaatgtcttagcaaaatgttatggtggtgacgtttcacgtaaacgtaagttgcttgaaaaacaaaaagctggtaaaaagcgcatgaaagcaattggttccgtcgaagttcctcaggaagctttcttaagtgttttatcaatggacgatgatgacaaaaaataattcagaaagatgatatcatttatctattttaaagtaacttagcttcgtgcttaagttactttttctttgtctgcaattatcaaataatatggctttataatatatttgtttaaatataaatgagctataaatgagtttttgttagtaactaaataataaaaagatggcaaatagtattgcaaaaagaaaaacatctgatataattaactagttaactaaaacgaaaaaaacatttatggaggactcatgaaaggtcaaaaaattattgctctagctggtcttgtcctgtcatgccattttgctcttacggcatgtcatactcaagaacacaaaaattctcatcatattaaaacaaagcaggttgctaagaaaaaagctaataaaaagaaagtctctgttaaggaaagtcataaaaaacgcaagggtgttgcaggggttgactttccaactgatgatggctttttactgactaaagattcgaagattttatctcatacagattctggaatcgttgtagcacatggaaatcattctcattttattttttactctgatttaaaaggttcaaaatttagctatttaatccctaatgctaatacaaaaactaataaaaatcaagcggtaagaaactttaaagcaggggcggtagctgttaatacattaaatgatggctatgtttttaatcccgcagatattgtttcagaagatgctaatggctacgtggtcagacatggtgatcatttccactatattccaaaagcaagtttatctcagcaaaagcaagtacaagcaagtagagctgtttcacgtttaggaaatcaaagtaatagccattacagggttaatagttctaaaattgcagggcttcactacccaacaagtaatggtttcttatttaatggacgaggaataaaaggcactaccccaacaggtattttagtagaacatcataatcatctgcattttattagttttgctgatttaagaaaaggggggtggggatcaattgctgaccgttaccaaccacaaaagaaagctgattctaaaaaacagtcaccatcaagtaaaaagccaagaactgaaaatactttacctaaggacatcaaagataagctagcttaccttgctcgtgaattacatttagatatttcacgtatcagagtccttaaaacactaaatggtgaaattggatttgaatacccacatgatgatcatacacatgttattatggccaaagatattgatctaagtaagccaattccaaatccacatcatgatgatgaagatcatcacaaaggtcatcaccatgatgagtccgaccataagcatgaagaacacgagcacactaagtcaaataaattatctgatgaagatcaaaagaaattaatttatttagcagagaagcttggtttaaatcctaatcaaattgaagtattaacgtcagaggatggaagtatcatctttaagtatccacatgatgaccactcacacaccatagcaagtaaggatattgaaattgggaagcctatcccagatggacaccacgatcactctcatgcaaaagataaagttggtatggcaactctaaaacaaattggttttgatgatgagattattcaggatattctgcatgcagatgctccaacaccattcccatcaaatgaaactaatcctgaaaaaatgcgtcagtggcttgcaactgttactaagattaacattggacaaagaaccaatccattccagcgttttggtctatcattgatgcctaatattgaagttctaggaattgggtttactccgattaatgatatgacgccagttttgcaattcaaaaaacttaaacagctttggatgacaaatactggtattacagattattctttccttgataagatgccactattagaaggattggatatttcacaaaacggtattaaggatttatctttccttacaaaatataaacaattaagtcttattgctgcagctaataatggcattacttcgctaaaaccattggctgaattaccaaaccttcaattcttagttttgagtcataacaatatctctgacttgacaccgttatcaaacttgacaaaactccaagaattgtaccttgatcataataatgtgaagaatttaagtgcactttctggtaaaaaagatttgaaagttctagatttatcaaacaataaatccgcagacttatcgactctaaaaacaactagtcttgagacgcttcttttaaatgagacgaatacaagcaatctaagtttcttaaagcaaaatcctaaggtatctaatttaacaattaataatgcgaaattagcatcattagatggtattgaagagagcgatgaaattgttaaagtagaagctgaagggaaccaaattaagtcactagtattgaaaaataaacaaggttcgttaaaattcttgaatgtgactaataatcagttaacatcacttgaaggtgttaataattatacttcacttgagaccttaagtgtttctaaaaataaacttgaatctttagatattaaaacacctaacaaaacagttacaaatcttgattttagccataacaatgttccaacatcacaattgaaattgaatgaaaaaaatattcctgaagcagtagctaagaattttccagcagttgtagaaggttcaatggttggaaatggtagtcttgctgaaaaagcagctatggcttctaaagaggacaaacaagtttcagataatactaatcaccaaaaaaacactgaaaaatctgctcaagcgaatgctgatagtaaaaaagaaaaccctaaaacacatgatgaacatcatgaccatgaagaaacagatcatgcacatgtaggtcatcatcaccattaatcttttacagagctaatatataaaatccttcaagaatttcttggaggattttgcatttatatgctaaatcatttatttttttagaaaattagctataatatgactatggttaaaagagaagatgtgattttaaatgcaactgaaaatatggttcaccataaattaaaaaatgatccaagtggccatgactggtttcatattgttagagtaagaaatcttgcggtagaattagcacacaaagaaggggctaatacctttatttgtcaaatggctgcacttttgcatgatattattgatgacaaaatctgccaagatagtaagcaagcgtcgtatgaattgactcaatggttatatagtcaagatcttgccatagcagaagtagaacatatccttgatattcttgaaaatatttcattcaaagcaggaactggattgactatgaaaacattggaaggtcaaattgttcaagatgcagatcgcctagatgctatgggggctattggtattgcaagaacgatggcttattcagggagtaaaggacgtttaattcatgaccctaacttaaaaccacgagaaaacctcactttagaagagtatcgtaatggtcaggatacagctatcattcatttttacgaaaaattattaaagttaaaagaccttatgaatacaaaacaagggaaaatgcttgctcaaaaacgtcatgattttttagaactatatttagccgaattttatgctgaatggaatggtaaacgttaggagtagatatgattcgtagagcgaaagaaaaagatttgcctgatattgcagagctattgaaacaaattttaatgttacatcatgaggttcgcccagatatttttcatacaagaggaagtaagttttctaaagaacaattgaaagaaatgctgatagacgaatcaaagcctatctttgtttatgaatcagacgagggtaaagttgttgcccacttgtttcttcaattacaagaaaaacgtgacttacctcgaaagtcatttaaaactctctatatagatgatttgtgcattgatgaggaagtaagaggtcagcaaattggacaaaagttgatggattttgcaagacaatatgctaagaaacatgggtgttataatataactttaaatgtttggaatgataatcagagagcggtctctttttatgaaaaattaggttttaaacctcaacaaactcaaatggaggagatactataatgaaagaaacacaagaagaattacgtcagcgtattggacatacagcttatcaagtaacccaaaattcagctacggaacatgcttttactgggaagtatgatgatttttttgaagaggggatatatgtagatatcgtcagtggagaggttttattctcttctttagataaatttcaatctggttgtggttggccagcattttcaaaaccaattgagaatcgaatggtgacaaatcatcaagatcactctcatggaatgcatcgtattgaggttaggagtcgtcaagctgactctcatttagggcatgtatttaatgatggaccggttgatgcaggtggtttacgctattgtatcaattcagctgccttagattttattccttatgaccagatggcaaagagaggctatggggactacctatcactttttgattaataagagacgacttaagggtatatcttaagtcgttttttatgtatggtaaaaagaattggtggcaggtgtattcttcatcagtttattttctgaaaaaagagtataatataggtatcaaaaatgaaaacgttttagagaaggagactagaatatggcttctacaaataatgtttcagatacaaacacacgttttgctaaagaggagttagaagaggttttcgaagaattagggacaactcaaggtggtttatcagatgaagaggttgctgtacgtcagaaaaaatatggtttaaacctgttatctgaagtaaagcaagaatcgattattttattgtttctgaaaaattttactagtcttatggcaatactattatgggttggaggatttgtggctattgtttctaatagcttagagctaggtcttgccatttggatggttaatgtgattaatggtatttttagtttcattcaggaataccgtgcaagccaagcaacacaagctctcgagaaaatgttaccatcttattcacgtgttcttagaaaaggctcagaagaaaagatattatcagagcaactagtcccaggcgatattgttcttattgaagaaggagaccgtatttcagcagatggtcgcttgattaaaacaacagatttgcaagtaaaccaatcagccttgacaggggaatcaaatcctatttataaagatagcaatgttgaaaacgaccagtctaaaacattgattgaatgtgataatatggttttcgcaggaacgacggtctccagtggtagcgcaacaatggttgttacggcaattggaatgcaaactcaatttggtcaaatcgctgatttaacacaagggatgaaatcagaaaaaagccctcttcaaagagaacttgatcggttgaccaaacagatttctatcatttcaattacggtaggaattatctttttcttagcagcgactttttttgttaaggagccagtgtcaaaatcatttatctttgccttggggatgatcgttgcatttatcccagaaggtttactacctaccgttacactttctctagctatggcagtccaacgaatggctaaagaacacgcacttgtcaaaaaactttcttcagttgagactcttggagcaacctcagttatctgttctgataagactggtacattaacgcaaaatgaaatgaccgtcaatcatttgtggcaaaatggaaagagttaccaagtgacaggactgggttatgctccagaaggacagattctttttgaaggtgacaatatttgctttggtaatagtgatagaggagacttagaaaaacttattcgttttgctcatctctgtagcaacgctcaagtattaccaccaaatgatgatcgttcaacttatactgtacttggagatccgacagaagcttgtttgaatgttttattggaaaaatcagggataaacatacaagaaaatcgtaagtttgcaccacgtttgaaagaattaccttttgattcggttagaaaacgcatgacaactattcatagcttaggaggcgatgaaaaggataaaaaaatttcaattacaaaaggtgcgccgaaagaaatacttgatttatcagattatgtcttatctgatggcaaagttatccccttaaacaaggaagaacgtaataaaatacagttggctaacgatacatttgctaaagatggacttcgcgtcttagctgtttcatactgcgatattgaaggcttttcaaaagaacaatggacgcaagaaaatttggaacaacacatggtgtttatagggttgatagcaatgagtgatccacctcgtgaaggcgttcgcgaagctattgataaatgtcatgcagcaagcattcgtattattatggtgactggagattacggattaacggcactaagtatcgctaaaaatattggtattattcgtaacgatgatgctaaagtaatttcaggtttagagttatcagaaatgacggatagccaattgaaaaaagaattgtcaggtgaagtcgtttttgctcgtgtagcaccagaacaaaaatatcgagtagtaacgatattacaggagatgggtgaagtagtagcagttacaggagacggggtcaatgatgcgcctgcgctaaaaaaatccgatattggtgtagccatgggtgttaccggtactgatgttgctaaagaatcagctgatatgattctgacagatgatcattttgcttctattgtacatgctgtggaagaaggacgggctgtttatcaaaacattaagaaattcttgacgtatatttttaatagtaatactcctgaggctgttccgtcggcattcttccttttttctaaaggttttattcctttaccattgactgtaatgcaaatacttgctgttgatttgggaaccgatatgcttcccgctttaggtctgggcgtggaaccaccagaaacagacgttatgaatcgtcctccaagacggctaacagatcgcttattggacaaagggctacttataaaatctttcctttggtacggcactattgaatccgtattagctatgggtggttttttctgggctcattacttacgttatggtaattttacttttttcgtcgcaaacggcataccgtacagagaagcgacaactatgacacttggagctattatctttagccagataggtatggttatgaatagcagaacgagctatcaatctattaaagcactatctatttttggtaataaattaattaattttggtataataatggagattttagcatttttagtcttagtatacgtgccactattccataacttattcaacacagcaagcctaggtttatcacattggctctatttaataagctgcccatttatcatgataggtttagatgaagttcggaaattattcagcagtagaaagaataaacggtgatgtcaaatataataacttatttaaaaaataattcaaacttaacttttgatgaattagcattaaacgatgttgacattctttgtttaaatgaatttggctatatttcttttgaaaaacttataaacactacagaaatgaagtcagttttagtctgtgagttatatcatgagtaccttcaaactatggctaaatcatatagctttatgttcacatcacaacgacatgatttatgtcagttaatgatgacctcgaaacgttttaaaaacttaactttatcttattatcgagctgagattagtttagaatttgaaaaacaatttgcagctatggtttttactattcctaacattaattatcatcaggttgtatttcgtggtactgatgccaaccttattggttggaaagaagattttaaattgacttatatgagagaaatatcggctcatcgttcagcgattaaatacttaaatacaatactgccttattttgataaagtagttctctcaggtcattctaaggggggtaatttagccttgtacgctgcaatgtttacaaagccagatttaaaagcaaaaattgatttgatttggcttattgactccccaggactacaaaaaactttgttacctactacagagtataaaactactaaacaaaagtgcattcgcttactaccagaagaatctattgttggtatgatgctttatagtgatatagagccgctaattattagtagcaatgcgcgtggaattctgcaacacgatgttacaacttgggaaattcaagaaccagctattttaaagactggaacaggactatcgctaaaaagtatttgttttgaaaagacatttcaacagtggatggctgaattaaaaagtcaagaaagaaaattattttttgatttattatttgatagcttcctatcaagtggcgtatctagtttggatgacttcaacttggcttccagagcaaaaatgatgaaagcttttcatagctttagagaactagatgatgataaaaaaaggttatttaacaaatctttaaaattattagtaaccatattttggggagcttatcatgataatagcagagagactaagtagctttcctagaattgcattagtctaaacatggtgctaaataaactagcaaaatagcacactaaaaatactactcatattatgctgagtagtatttttagtgtgctatttgatgaagttattctagagtttatgatttttgttttcggaaatactttttagagtattgaagaattccttcttatctgaaaattcgctaatatgttccttaatagcttcatctgaccaattccaccactgagatgcatttaataatgttatttcttcctctgaaaagcgatatttgataattttagcaggtgttccagcgacaacagcatagtcaggaatgtctttggtaataactgaacctgctccaataattgctccattacctattgtaacagatggaagtatagtgacattagttcctatccagacatcgttgccaataataacttttccatttttcttttcatctattaagtccgccctatcctcatttataaatccccttgacttatagtaaataaaagggttagtggtaatgtgatcggttggatgattcagaccagtaatagtaacgttctgggctattgagcaaaatgctccaatttcttttaagttaacgccttcgtaaaagaattgttgatatccatatgtgtactttcctaccgagaatccatatttagggtaactggcaccagtactcatatctgtcctcataggatcatttttaagctctaaacgtttctctaaatgtttttttaaaatactagccataactagcctccaatcgtagactaaatagattataacattttttcctctaaaaaccttaccttttttaataaattctataaattagaatgataaagaacttattctcggatattgacaaagagtgagctaatgaggtggcctaattcaatgttagagtctgttcccagtatttttttcctaagatagaggcaatgtatgaacaaagaaacatacttaaaaccttgtaataacaaggttttaagtatgtatagtaagttatggtaaaatgatatggagccggtgggagtcgaacccacgtccaaacatctgctaatatatttgtctacaactataggttatgtattgatttaactaggtgatgacacataactcaagccctcacatagcgagtctataaatctctttttaactaactagacagtagccaaacgtagtttgctgataaataagaccttctagcaaaacgcaaacaatcttgtgaagatcacgcaggctgttttttaggcagctaatgcgtaagaatttgtattttttgcagttatatttaactggcattttacatctgccgatgagtcgcgaaatatacctcataatgcctgtcgaatccgtaacgaccccaaaagtagaataaagcataaaaacttaccaatatagtataacaaatactatttaaaatagcaaaaatttaacagttgtgttatgattaaagcatgaatatgaaattatcaaaacgttaccgcttttggcagaaggttattaaggctttgggtgtcttagcgttaatagcgactcttgtcttagttgtttatttgtacaaacttggtattttgaatgatagcaatgaattaaaagacctagtacacaagtatgaattttggggtccaatgatttttattgtggctcaaattgtacagattgtttttccagtaattcctggaggtgttacaacagtagcaggtttcttaatttttggtcctaccttaggctttatttataactatattgggattatcatcggaagtgtcatccttttttggttagtcaaattttatggacgaaaattcgttttgctatttatggatcagaagacatttgataaatatgagtctaagctagaaacatccggatatgaaaagttttttatcttttgtatggcatctcccatttcaccagcggacatcatggtgatgattaccggtctatctaatatgtctattaagcgctttgtgacaatcattatgataacgaaacctatttctatcatcggttatagctatttgtggatttatggcggtgatattttgaaaaattttttgaattaaaacaaagtataaatttctaattatctttttatattttcttaaatgctcgtaaagccttattctatgtgctttcgagtatttttactgtaggaagatacttcacgtttctttgcatatttcctcatgtcttagctgtcagaagtggtaaataagtagtaaattcatttgtactactaagcaacaagacgctcctgttgcttctctttattcaagcgtttcatttctgccattgcagaatcgaatgttgcatgtgcgtaatagttcagcgtcatggctatattagcatgtcccataatgtactgtaatgcctttggattcattcctgcatttgcatagttggtacagaatgtatgtcgcaaactatgtggagtgatgtgtggcaatttatcctcgttatacttattgtatttcttaacaagacctttcatcatgccgttgtaatcacttgccacttttggatagttctttctattaagaaagaggaaatcactatatccatcaatctcaacacgcttatcattctttcgattcgctaacactcgcttaaatgcttgataggcttcttcaaccataggaacttgacgttcgccacttttggtctttggtgtttcaatgtagtacccaatttcagtatctctcaatagctgatggtctatattgacaagacgattctcaaaatctaaatctggaagtgtcaaaccaccaaactctgaaatacgaagacctgtttttaagagtatcagaatttcatcataatttttgctgtaggttttatcagcttttgcaaaggctaacagtttttcttcctgttcttctgttagtacggtcttagggacagtatcatcatcaagaactgctttcagttgaaagtcaaatggattcttccgaacacaatcatcttgtatagcaatatagaatgaagcctttaaagaacgtttgtagttattgatggtttgataagcataaccattttcactcattctaatagcccattctttagcgtctgatggcttaatactgtcaatacttcttacacctaacttgtctttcttcaaaatatccataagatatttgcgtccagtttcagtgttttttctaacctttggtctttgagcgttctgttttgcgtaaagctggcagagtgtcattttctttcctacaacatcaataccatcatgaatgtctttctgtaactctgcgattttctctctaagtgagatacaatcacgctttcctgctggtactcggtctgtagccacaagtttccacgagtaaacaaattgcggttctccaaatgaatctatatatttgtataagtatcttccgtcttttcgttggctctctccagtctttaagattcgacctttattgtcacgtcttttttctgacatggcatttgctcctttcctttatggaaagagccttgatacgacttaatactattttatcatatacaagaccctttggcgacgctagattgcgtccaatgtatctataattttttcaaattgttttcgtttaatctgaatacgattgccattcataatcagccaatttgcatttttattttcctctgccaagcgtcgtagcttgttttcgccaatacgaaaatattttgacgcttcttcaatggttagggtataacgttcccaaataggaatgtcagtctgcttcataaaatcctcctttccaaatcacttatttggatttcataaaagttgttttaccagcaatcgaacagctttagcaaagctcacgggagttccacccctgcatggttctcatgtagccatactcattgcctgcgacggttttatcacgctcggactattgactgtatgggagtatcattatcacgataagaatgtcgttgcaggcaatcctgctaaagattgcttctcggatcactaacatgaatcgctcgctatctttataagataggtcatggcggttagttccgttggctcttttcttatcgaaacgtattcgattacttttattcagttttcaaagaacaatggctcgttagcctatcaaaacacattgaaagctcaatatgctttggtggaataacaaacctccctgttcgggaagcgtggaatggtttagcacgcttccacgaaaggagagaggatattacttaatttcaaatgacaaaatctttgtaatcagtctggtttccattcttccacgtaagacttcatcaacgaccatactttgattgccatattcatctttcataagtcgtagggaacgcttcgttatgtaccctctgtaatgatgtagaatctggttaatcgcttcggtatcgccatctgttgcctttacaatgagaggaaagggaatcataggatattgtgttttcattcttcaaattcctccataaactttttaattaaggctagtccactggttctatgccgatagacagtagaacggttcaatttcaacaggtctgcaatttctgaatcgctcatgtccataaagtaaaacagcagtagaatttcacgtttcttgtctggcaactcacgtaatgcttcactcaacaaatcattttcaacgcctactgataacccattgagtgtaaaaatctgaaagtcagttgaatagttatctgttgtcgcaaactggctaacaagataatcgccaacatccgaaaaggacacctcacgctttgcaatccttgaaagataaagcatataattctttcgctcgtcttccatagcacgtttacagatatagtcaaactgattttctattgtggtctgaaaagaagatggtttcatgtttctcaccccctttctgtctaggaaaggaagtgagccttgctcgtttatctcctttcactcttagtcccaatgtgaaagggggatttgttgcattactgataaataaactttgtaaaaaagttctgaatagccaaaaaagcatataaacagatttatttctctgtttacatgcttctgttattctatctatatgatttataaaaccacattggtggacgtacttatctattgcagatagacgactttttttgacaataacccaatgtaaggaaatttattgtatatgatgtacttcatggcgacgttgacctccaacaaaccgccatttggaagtaatatacaatattttaacagcgtaaatagcactaccatataacggttttttttattggcgtttagtagtgctttttattaaatataaacctataaaccatataacacgtttttctatacctgtttttaattcagtaggaacaataaaatgtatagaggtggtctactatgcgtaaaaaagaagataaatatgattttagagcctttggtttagccattaaagaagctcgattgaaacgaggtttaactcgtgaacaagtgggagcattgattgaaattgacccacggtacttaactaatattgaaaataaagggcaacaccccagcatacaagttctttatgaccttgtatcgttacttcatgtttccgttgatgaatttttcttacctgctaataacttggtaaaaagcacccgacgattacagatagagaaatacatggatagctttacagacaaagaactatccttaatggaatctttagccagcggtatcaacgaagcaagaaacatcgaagactaattaaaagaatccatacataacggaaagagccgataaaatgagattgtattaatctcattttatcggctctgcgtctttgcgtctggctctgtaatcacagttactttgaactgctttatttcaattaaattttcttgtctgcatttcggacaatagagggggaatttttttaattcagtatcttcccttatctttaatcgtgttttatttccacatacaggacacaatatccacttgtagtttataataactatctcctcctttacactttaattcaaatctttattaaaaaatatttcatcttatttaacaagaaaccatatttatataacaacataaaatacactaagttattttattgaacatatatcgtactttatctatccgactatttggacgacggggctggcaaacaggttcaccggtagtaacatggtacccttttaactctgttaaacaaacactacgtccatttgtaaagaaagttaaatcactacgatattcttgaatacaccgagcagggatttctccactaagaatgacctcattatttttcaattgagtgtctacgatgttcgcacaatatttaggagcatcgttgtatgctcgtgaaagatattcctgtggcgcataaattttaaaactaagatatggctctaacaattctgttccagctttttttaagacttgttccaatacaataggagcaagcatccgaaaatctgctggggtactaacagggctatagtataagccatacttaaaacagattttacaatccgtcacattccaaccatataatccttgttcgcaaccatagcgtatcccttccataactgcattttgaaatgattgatttaagtatccaagagaaaccgagctctcatactgcattccacttcccaacggaagcggtgatacagataaaccaatggaagcccagaaaggatttggcggcacttcgatgtgaatggtatattctgcattttttaacggtctctccatataaatgactgtaggctcttttagttctatctccacatgatacttttcttgcaacagtgcactaatcacttccatttgtactttccctaagaaagaaagtataatttcatgtgtcgtagaatccacgtaatatcgtagaagcggatcactatctgagatttccaaaagggcatcaagcaacatttctctctgttcaggtttactcggttcaacagttgtttgtagtagagggtgcggattttcaatcttttttctctgtggcaatagttttgtatctccaagaacactatttaacttcaaaaactcattttgcaaaataacaatttctccagaataagctctatcaatcttacataattcaccatttattgaagtatacatttctgtaacttttattttttctttttctgatactctaaccgaatctcgtaaatgtagtactccactataaaggcgtatatatgcaagacgttgtcttttttttgtatattcaattttgaaaacatttccgcaaagttcagacggacctcgatgtgttgatgaataaaatttattcgtaatcacttctataaggttatcaatccctatattgttttttgcacttccgtgataaacagggaacagggaacaattatgaaatcttatgctttcctcttgttcgagttccaatgcttctaatgatttaccggacatatatttctctaaaaggtcatcgtttccctctattaccgtatcccattgttcagattcggtaaagttcgtcacacacatattaggatacagttctaccttctgtttgattacaatttcggcagaaagtttctctttaatatcctgataaaccgttgataaatcaattccattttggtcaatcttattgataaaaaagattgtgggaatccccattttcctaagtgcatgaaataatatacgagtttgtgcttgtacgccatcttttgcagaaatcagtagaattgccccatctaaaactgataatgaacgatatacttctgctaagaaatccatatgtcctggcgtgtctatgatgttcaccttcgtattttcccactgaaaagaggttattcctgtctgaattgtaattcctctctgacgttctaaaagcgtattatccgtcctcgttgtacctttgtccacgcttcctaattctgtaatcgctccactgttatataataagctttctgttaaggtagtttttcctgcatcaacatgagctaaaactccaatattaataattttcatgtgattttcctccattcaaaaacccaaaagggcataaaaatcccagtgataaatacttttatcactgggatttttatgcataaccataggtatacaaagcatacagatattctctggatactttagaatcacatgataaaggtattcttaaactgggtacaaaaaactaagccctcctaaaaaaggacatctaattatttgttcccgctatcaaattgacagtttatttaagaataccttgccgcatatttattaactccttttaaatagtcacttaaataatagcacgtaagagcatatttgtaaaggaatctccaattttttatcaaaaagagtacatgattacaaagtatctgtaatcatgtaccaatatttgttattttacaatcttccaattactcccgttcttttcaagtaccaaatcaaattgagatacctgcgttgctttggtctgctggtcgatatactccactgtcagcgataccgtgacttgattatccttacgattgtgaataggatttaccagttcttgaaagatgtactcttttccgattggttttaatatcccgtcattcacatagtaggaaagttcactggctgtcgctgtaggatagagcttgaagaacgtcgttaaaaactcattgatttcattggttgtaatggaatcaaccgtcccctcactttcaatggcttttggtttataacttgatttcttaggtatgttggtaatggtcggattcttaaccagtaccatatttccagaaccatctacatagacactcactatataagcagagtggacggtctttgtattttctccctctgtaatgagctggtctacactgtaggttacattaaactcattgtcgccagttggctctaccgtccatatctgaaatcctcttacagaagacgatacaggaatatctttgcgtactgtatcaacattgagagcttgaagttcatctgtcagatagccttttagactttccattcgattatcaatggacttatcggattgctcccatgaatagtagactttcgcaaagttctctacaaaattttctacatgatgagtatcaacgtattccttttctatgatagttgtttcgtgaatagtatgagtatctatagctgtaaagtgcttgaatatcgcaaagctgaaactaagccctaaaagtacccacaaggcaatcacaacctttttatgaggattgaccttatagacacgaggtttcttttcctttggtatctgtttttctttattctgattttttctaaatttcatcattaaatcttcctttctcattgtttgattcgtcctgctcccactaaatgctgttgccagtaggggcttgttaagtcggcataaccgattgggtcgcctgcatgaaacatacggttattgccaaggtatatcccaacatgagtaatataagagccagcgttataggtagaatgaaagaaaaccaaatcgccagcttgtgcttccgatagtgggatatgctgggtcacatcatattgctgttgtgcggttcgtggtaagttaattccagcttttccatacgtccattgtgtcagtccgctacaatcaaaagaagtagtcggggaagctccaccgtaaacgtatcgccagccctcatatttcagtgcttcgtccatgatggcttgtaccgtatcatcatcaaactctgttgtgacaagatactgcgttaccagttgcacataaaacatattgccatagttgtatcgccagcccccattgataggtatggctatgggattggggtaagacactttttcgccacctgaatactcttttgagaaactttgagccagttcaaaggtatatttatttccacgattagccacataccctaagaaaccaccaccataattgtaggactggataaccgattctaaatctacactgagcctttcgctactggctaataattcactgaaatacttcacaccttgcttaatggattcttctgtactcaatgaattaggtggaagaccgagggattccgaggactgcataacatcttccgcagtaccgcccgattccacctgtataatcgcaagaagtatgttgacatattcttcaacgccatattctttggcatatttttctaccataggcttatgagccagcacttctgcggaaacattcacacctccataatgaatattggaaattccgctgtcctgttcatctgaaaataaaatggcaacaaacagaagcagtgagaagaccatcaagaataatccagaaccaccaatcactaaagttttcaacttcatggtttcttaccgactttcttaatggtggcggttttgattggtggtctacttcttgtattttgtagtggtactctttgaacagtagacggacgttcttttgtgattggacgttgtgaagttctatctgctgtagtggttgaagttgctggcttttgaacggttttttcttgaacggtattgccttggcgttccacttttggacttgaaaaatcggacttaactgctggacgctcttgtttggcttgttgagattccttatatgaagtctgaatattagactgttttgaggtctgttcatcatgatattgttcttgtcttgtagtcggtctttcatgaacagaagaagcaggctgttttttctgtttgacctgttccatttcagagcgacgcttcgcaatggtttttcgcctttgttcctgctgttccttgcgtccactggctctgtccgctttggtttgagaaatactactggttaaatcacggacattctcttttactttggattttccttgatatactgcatatcttgcattggtcggcaaatctttaacctgttctttcaaaccactagcagtgtctaccattctgtctttggtatcagctactgtaccgatggtttgaccgatacgttttccaagtgttgatttttcctttccgtctggtcgggagtgatctgcttgtgtccttgcagaactccccgaacccgactgtccttttttacctgtaacaatggcagacccagcccctagagtagtcatggaacgtccaagtttccgctgtagacggtgcatgtgagcgtgcataagcatacgaggttttctcatcacacgacttcccacactttgagaatcgttactctgtagagaaaacatactcattaaatcgcccagcttgaagtagattcctgcaaaggtcacaatctgtagaaaagcaatcaaaaagaacggataaccagccgataaggtatagagcatggttgaaatactaaatgctgtcgtaataatcaatgtgattccagctcgtgtcaaaatggtattaaagagctttgttatggctcgttttgacataccatcaaatgatggaatcatgcttaaaataaagctcacaggcagaaacatagcatagatgataaaaagtacctgcgagaaaatcatgattcctgttaataggaatacaaatatggaaatcccaatattgaagacaaataggaagaagactgtacctaaacggttaatggtctttgtaatggttagattggtattgcttctgtcttcaatttcttccgcaacaattttttctctgtcttcgccattgttggaatctgggctggtggagagcaggctttccacacggtcaataccgatactttcaatgtctgaactgttgtattgaagcagtagccacggttgctgaacctgtatggaaaacaggctatctctgattaagtccacgctgtccttgccttgactatcggaatggggcatgacaatcttcgtgccaagtgataaactggcattactgatgtctgatgaaaagtcattgatttttttaatgtagtcgggagcgtaggcaataaaggaagccgataggataaacaccagcacaaaattcataatggcatgaattgcctttgtggtttctctctttatcagtcccgtataggcaacataaaccccaagaaccaaaatcaagagtaagaggaatccaacatagaaaccctctgttgaaaatccgtttgcactcacaccagctaaggtctgcatattcttaccaatggaatctgctgtagcggaaatgaagtctaaggaataggcttcctgtactaagtaacctgtcgcattggaaacatacaaactgattgtccaaataaaattggtaatggcatatagtccatacatgacctgttttccaatcccgtccgaccagttccacggaagccagccccagctattatccacataaaaatccagttgatagttttcaagtgggtatcggctgtattcatttgccacattgaccgtatcatctaccaagcccgcagcttgaaccaccgttcccagcatggctaaaagaaaaatggcaatcacaagtgtgaaagccactgtcattgccactttacctagacgtttcagcgtccagtttgattttattctgtttactattgatggtttcacatttacacctcttttcgcacaggtggtctggtatcaaaggcatggagcagttcttcaaatacagggtggaactgtatcacaccgacacgaccatataaatcactgataaggcattgcccgttttccaaatcacgcaatcgcttctgattgttttcgtcctctgggtctacaccaaaaaaggctaaggtctttttaatctcgttaaggtcagtggaacgaaatgcaaattttaagccgaggttatttttcagtttttcatctaagaggtcgtctgtattttgggtcacgaaatataccccagcgttcatagcacgaccagcccgaaccagcttcatagatagtgtttttccttgtgctacctgtaaaaagctccatgcttcgtctaaatctacaatcttgaaaatgcttcggtctgtatggataaagtctaaagcaaaggtactaatgacaatcagcatagcaacggataaaagctccatagtggtatattcctcaaaggaagtttccttgtcgggaagtaccaagtccgcaacctgtataatgttcagttgtttttctaagctgatagactgctccacataaccattactgaataataaatgtgcaaagtcatagtctgtaaaactttcgatatggtcggctatactggtacttagtggcgtattctcaacccgtaattcctcaatcactttcatcaaccctcgtacttcactattggttactgcacgaatggcttttctaaggattgggaagcgttccccatcacgagaggaaatccccgtaaggaatgtcagaatatcaatagccagtgattcagaatctttgggatttttcataatcacataagggtcaagtaagcctttgtttttctcatcagaagtcagagtgacgatattgatttcatgggaaatctctggcaaggtttctttccatctgccacgttctgcttttgggtctacaatcactgcttgtgccccataaagcaccgcataatagacgataaggttattcgcaaaggatttaccaccacccagcgaaccaacaaaagccgacgctaacgcattggttactgaacccttaaccccttgactggcaagagcaggtttcagatagacattgcgtccagtatctaagctgtagccaacataaatcccctcattttcccccagcatttgagtagcaccaaaacctaaaccagcgaggaaatcagaggtcacgtattgaatataatcattcatataacgcttgctggcaggtaaaaattcttcatgtaagccgagcatatccccaaatggtcgtaccagttttacgcttaaatcgtcataaaaatctttcacttcattacaacgacgtttgagttcgtcaagatcatttgctgatacccttaccacataagacagcttgtacatagattccttgctttggtctaaattggtttccagctcattcacactttccagagcttccgccacattggagctggtttcattatcactttgccaagcgtggttatccaagtctttcagttctttctttttttgcggacagtagatagggctttacgattcgctacaatttccacattcattgacgtatcaatcgggaatgtaaattgctgttgctggtagtagaagatttcagaggacgggaagtccagttctccgacaatgctgttaatggtaaagtaagctacatagacggtttcatcttcctgctggattttcaaatatcgctgtttttcttccaccaaacagcgagtaggcttaatcaagtcatagtatttaatcagcgtttcattatccagctttttctttgatagatggtactcatactcttcataggcagtgcctgtctgtccgtaaaggtgttcaatcagatagccgaagtcgtccttatctaacctgcggattttgaaacgacgagagattttattttctaagagcttttccatcttctgaaaacgcaggatttcatcattactcatactaacaaaatcgcccatcagcttatggttcacatcatagacaaaatcagacaaagcattttttgcttcaacggtaagacttttcatagaaaactcctgatcgttgagaagcaacttaaagccgataaagaaacggtagttcacttgattttcgccaatcatggatattaaagcgtctgtctgttggtcgattttgtcataggcaaccgctttgagcttgccagtgacttcatttttggaacgctcttgtgcagaacgtatgctggattctgtactgatttgtaaagcatgaattttgccatcacgattttgtgcgataagctgtctgaaagaatcatgcacttgtattttctgttctggacttagaaatgagtaattgtaaggaacaagctcatagtaagcataacattccccgtctttattccagacgagattgttttcaatgtatttaattggatatgccataaaattcactcctaactgctgtaatggcttcttgtggctggtttctgccaagcgttactttttttcctgcataggtcagctttggtcgcagtgcataagcaatgacagacttcaaaaatccataaggctttttaccatcaaaagtttttgtagacataaaccatgtgaaagccacaggaatcccaaagtatttgagaaatgctccctctatcatggaaagagggggcaagttgccaagtatcatcactgcaaagagtgacacgacaaaccatgtcatttgcgtaaaggttatgggaaacggaagtctaaaatcattgatagaatacagtaccttttccacagaccagatactggtatagcttcgtattttcttcatgtaatcaatcctttcataaaaaataggggtagctgattgagccaccccgtaaaatagaaaatctgccagtagtaatgtaccgacagatttaatagacgatttcaaaaatcccatgattggttgagataaacgttcctgaaaggtctaaatcccgaccataggcttgataatcaatatagttttgaagactagctggtacttcgcctaaagcacccgtttcttcaatgtagtagcgtgccacgtcatacatatcatcacaatcggaatgaatgataatatcctcttgatgttcgcttagttcttcaatgcttgaaaaatgagtgagcagagcagatagctccgattgtaattcttcgggtaattccgataccatttcccatagtcgattgagttcgccaatggaagtgtattcgtcaaccgtaaagggtaactcgtagtcatgaatggcgtattcctcatattcatcattcaagccgattttctctttgacttcctcaaagtcaatgggaaaggtaaaccacgcaccgaccaattcgccctcattgtatttgcctaaattcgcaatatagacttgcatatcgtccatatattcacgtcctttctttgtagagattcaaaaatccctaccgcacttcgtttggtgtaccattcctttgcggaacataagaaaaccacttatattccacaaaagaacggttttatttaagcaccaataatgcgattgaatagctctagtaaaatgtcttttactccagcagcgttgaagactaagccaaccgcaataatcgcaataattaaaaagccaatcagtttgctaaactcacgcttgaagccaagatacaagccaatcacaacgattgctaaaagcaccagtgattgagcgtttgatagaaaccagttataaaggttttgtccaaaattcataaaaatgttctcctctctatattcaatgaatttgtatttgagttatttttttgttgttatcacgtcctgttcttttactgactgttgcttcaaaatctgcttgtgtcggtctgtcagtttcgcatggtcgagaatgtcttttacaacctgcgtctggttgatttcatcaagtttaatcgcaacctttaaggtcggggcaacttgatgagatagccagttcagcgtcctttggaaggagtaaggctctggttttgtggttagttttaatcgttcacgattgttcccaataaaccaagcccattcttcattcagtttccaatcagaacgaggtttggaatcgtctttatctacaaaacggatataccgattgataattttaaaggcggtatgctctggattgtcatagacgagtaaatcacggactgcataataggcacgctcatttttcaatcgaatctcaaaacggttttttacttctgcgtcttcaatgggaatatcatttttcttgtactgctcgtagtccttttcatagatacagaaataaacttcactttgtaatgaaccgatatagagggtgtttcccatacattccttttcctctttgcgtaccagttcgccactgcgatagcttttaaaactgcggaagacggagatacattcttcctgttggcacttttcagtgagtacagggatatttaaaatccctgtcttatcgttaatggcaaggtcaaggcgtttcatcacaccgccagccaccaaaacgtccataaagaactcataccagcttctttgttgtgccagaagatagctttcaaattgtctgcacccacgacctttcaattccaccagaactcctttgtccagttcatgggagcaaaggacgaatatgtcgcctaaagcataatgctctgaataagaatagaaaccatagtcctcatgaagaaaataggacagtttcagttgtaagatgttttcgaccacctgctgtacgtctgttgtcggaaagcgaattcttacataatcaaacagcatttcaaggggagcgtcgggattgaagcgttccagagcttcccaaagggactgctgtaaatcctctgatggcttgacttttcctgtttcaatatcgcttagatactgccttgtaataccagtcgcaacagctaaacggttttgagatagtccataagccaagcgtttttcttttaaatgctgtaaccaagtttgttcattcagtaaaaatccctccaatcaaaaaggcgtatgtcaacttttaaagcccatttgacatacgctgaaattttgtaaatcccttgtaaccaaaggattttctaatgtttttttgactgtttcctgtcgatttgtacccccctgttagatacggggggttaagtgctggcgtggctattgccacaccagccagcaagatcagtccacacctgcgacttccgcttcgcacgtcgcctgcgtggactgtctgctgttggataactttttaatttcctccaagaaatcatatccttttggtacaaggggagtataaaactctgatatgacacttgttcctacatcaacatagccacgacctttgattcgctttaagaagaaatccttttgtacgtcactgccaaacatcatgccatagcccatttcagacatacgacctaaagccactctgaaattaaactgatcacggattccgtcgcctaaatattttgcgtctggacgttgacaagccagtattagaaagaagccagcttgacgacctaacatgacaatctgtttcagcttattcataactgcggtgttttcttttgttcccagcatttccatgaaagcgacgtattcatcaaagattaagaagtgtgccgggagacctaagtaagcataatttttgccagtcttatagttcttcatctgcttcatttcctcactacgtttcatcatttcttcatagaatgtttcaatgcaagaaagcaagtcttcttttctatagtagacatttgccatcacagaacctaagtccgcaagatcagcatttttcgggtcaagaatatacagttttgaatctgtatgaagcaaggcttcaatcagtgtcagtataaagtaagttttaccgccacctgtaccaccagcaatcaacatatgagggagcttatcatattcccaccatacgtttttcattaagcgaagtttaccatctttagcttctacttcatcaatagaaatacgactggctatggtgtcatagagcaaagtatattccacataggaatcctttaactctttatccgtcagctcacagtacaagccactctctaatttcttttccaagtgtaagagttggtcttgatattttcccagcgtgatttccacccgtatctgtatcaagccatttttaagtcgataatacattttagggaagtaggttatcttttcctttgtacgaccagcactatctttaaagaaaccctctgttttgacctgttcagattcataccacttgttttcaagtatcatctttgccagtttttgacggtggtaaagttgtttaaccgtatcatagcgaacccgtttgaatacaaacgctaccagcaagcagataagaattgcgacactgaaactgataattaaatagggaatgtcaatcttatctgcttgtgataggttaaaatcctgccagttgatctgctggattgtcttcacatgaaacagtccgacaaccagcaggaaaacaggcaggagtgacgctatcgtaaaatgaaagactaaatctttaccagatgggcgaatccttttaccacgctgtttcatgcgaaaaagtctcctttctacctagcgactatttgtcttgtgtcggttctttctttgcttgtggttgagctttgaatgaactagaatcctttgtcagcacaatatcgtctgccttgatataccagtcaacatctgctccttgataggtggcagtagcaacggtgtccgcaatgggattgataagttccacccgtgcgttataatcaaactctttcaaaggcacgctggcaggaatacttacttgaatcatgcgtccttgtcctttggattttaagtcataggtacgttccttgatttcatctgaaaccgacccgtcttcattttggattctcacttcacgacgtagagcagagaatttcaattctccaaaagtcgtgtctttatctaatacaatgccatttgctaatctcatcatttttcctctctttctttattcttttatcatgtcgtcagcatgtaaaaggtaatttgtaaaaccacgagtgccgattttgtagccctctgcggtaatacgtggattgactaacttcacacgttcctcaaagccgaaatgtttttcgccagcttcagcaggaagcaccaccacaatatcatctgctctttgaacatcagaatagagattatagcttcttgataagacagttagccgtccgttgattcttcgctgaacgactttatcctcgccagcaaattctaaattgccgaatgttttttccatgttgggaatcacaaatttaagttccatatttttacctatcctttcttttttattggctgaatgaatgtttgatggtcttaaagagtggggaacgaccttttgattcttgattttttgttttcataagttcacttcctttcaaaatcgggtaaaaaaatagacacctcattttttgaagtgtctacctattaaatattcaaattttattggaagtatctttatatcttcacttttcaaggataaatcgtcgtatcaaagctcattcataagtagtaaattagtagtaaattgagtggttttgaccttgataaagtgtgataagtccagtttttatgcggataactagatttttatgctatttttatttataaaaataaaaaaaggttggagatatatctccaatctttttattgtatattaagtttgtacttaataatagagtgtgtcaacatatagaatatagcaatttcaacaatgctaacaagtatattgtagagcaatacaggttgagagaatgttgcatttgcatgagagttgaataaatcaatatgaaaaatactatctattattaatgttaagaaagtaattaagagtgatattccaaaataagaaacaattcccatcaatacacgtttgtttgtaaataattgccctacagcgatagagagataaatcagtaatgtccctgcaacgtacgatagaaagaaataggcgataaaaagtggagcgttcgaagatgaaataattttatagatttctggaaaagcgacaacgaactgaccaatacctactaaaggtaatatgaccaatatgattccaataatgacaataaaaatattaaaaatactccaaagaagagaagctagtagctttgaacaaataatctgattcgtagttactgggagcgttaaggttagatatccttgacggccgaagatattgctataaaaacgtttgataataatagcaagggtggataacagagatcctgaaataaccatcgctaacaataaaacgagtattatagtgaatatttgggcgctagtactattagtatcagtagaaaaattgccgccaagtgcctttaataccagtcctaaaataatagatactaataaaaccgcagcgttgagtgttagataccacttaccaactgattttaattcatattttaataattttccaaacatatcaatctcctttatttcttgaatctttcacgaaagagagcatcaatcgaacagttgtgctcttctcttaagtcatcagcattgccttgtaggtcaatttctccttctttaaggaagataacttcatcaaggataggttcaatgtcagaaattaagtgagtcgaaattaaaacagaagcatcattagagtagttgctaatgattgtttttaaaatgtagtcacgcgctgcagggtctacaccaccaataggttcatcaaggatgtagagcctagctttacgactcataacaagtattaattgaactttttccttgttcccttttgataggttttttagacgttccctaggatttaggttaagatcctcaaatagttgatatgctacctttgaatcaaaatcgttatagaaatcttcaaataatgtaacgacgtctttgattttcatattttcttgtaaatatgaagtatcagggagatatgaaataatttttttggtttcaacagacggtctgtaaccatcaataacgatatctcccttatctggctgaagtaatccatttatcattttgatgattgttgtttttccgctaccatttggacctaataaacctataatctttcctgttggaatacttacagtcacatcattaacagcagtatgtttgtgatatttctttgtaacatgatgaagttgtaataactgtgtcatttaattaatctcctttataaaatgatcgagagcaaccgtaatttcatctaatttatatcctatttttttcatgttgttgacaaaagttgctaactctgcttttgcaacttgttgacgaattttaccaattagtaagttgtcttctgtaacaaagcgtccggaagtacgttgtgagaataccattccttcacgttccaattcagtgaaggcacgttgcatggtatttgggttaacaccagcttcttgagctaactctctcacggtaggcaattggtcaccactttttatttcttgactaacaatttgcatctttatatgttcagcaatttgtgaataaataggtgatttttcattgaattcccaagccatagataactcctttcataatcttgtactttttgtactataaaaatagtacaaaaaaatatttgaaatgtcaaggaattatcattgagactttaatcgtttattgtttcatagtataatagtaaaaaatcgtaaaaaggggctactatgtttgcacaacttgatacaagaaccgtttattcttttatggatagcttggttgatttaaagacatatgtctctaaatcgaaatcattaggatatcaaactattggtatcttggaccacagtaatctttatgcagcatatcattttattcaagaggcgcaaaaggcaaacctaagaccaatagttggatttagctttgatatagtggttgaaaatagatcaatagaagtttactgtattgcgataaatacagttggttataagaatctcttgaagttgtcaacggctcaaatgtctgagaagatgtctctaaatttattgacagaacatcttgaaggggtgcaattgattcttccctatcaagatgttcttgatcagctcaatttaccctttgattatgttattggtgttaatttgacctctccgcagattccatataccaaacccattatagccatagatactgttcgatattttcaaaaaaatgatattgagacattacagatgcttcatgctataagagataatgtcctgttaaaagacgcacaatatgcgagcaaaaatcaagaattaaaaccttgtcaagaaatgactctagcattcaaggaacgttttcctgaagctttagctaacctagaatctttggtagagaatgttgcttatcactttgattctgactttaagttacctatttttaatagagaaattcctgctggagaagaattaagaaccttaactcaaaataacttaaaaagtaaaggtttatggagcgatgcttatcaagagcgtctcgaaaaagaattaacaatcattcacaaaatgggctttgatgactatttccttattgtgtgggatttattaagatttggtcgtagtaagggctactatatgggaatgggacgtggttcagcagcgggaagtttagtctcatatgctttaaatattaccggtatcgatcctgtcaaacataatttaatttttgaacgttttttaaatgaagagcgttattcgatgccagatattgatattgatcttccggatatttatcgtggagaattcttgcgctatgtacgtaatcgatatggttcaatgcattctgcacagattgtaaccttctcaacttttggtgcgaaacaggctattcgagatgtttttaaacgctttggtgcatcagagtatgagttaacaaacataactaaaaaaattcatttcagagataatttgaccagtgtttataaccgcaacttagctttcagacaaataatagatagtaaaattgaataccaaaaagcctatgatattgctaagcgtattgaaggaaatcctagacagacttctattcatgccgctggggtagtaatgagtgacgatttgttaacagatcatattcctttaaaaaacggtgaggatatgatgataacgcaatatgatgctagttctgttgaggataatggtcttctaaaaatggactttctaggtcttcgaaatttgacatttgttcagaaaatgaaggagaaagtcgataaggactacggtatctctatacaattagaaactattgatttagaagataaagagactctaaaactatttgcagctggtcaaacaaaggggatttttcaatttgagcaaagtggagctattaatttgttgcgacgtattaggccagagtgttttgaagatgtggtagctaccaccagcttgaataggcctggtgcaagtgattatactgagaattttataaaccgtcgttttggtaaagaaaaaatcgatttagtagatcctgtcatagctccaattttacaacctacctatggcataatgctctatcaagaacaggttatgcagattgcccagacctacgcaggttttacgctaggcaagtctgatttgctcagacgtgctatgtctaagaaaaattctaaggagatgcaaaagatgtctcaatccttcttagagggtgcagtatctaagggacatcgtcaagaagatgctcgacttatatttgaacgcatggctaaatttgcaggttatgggtttaatcgcagccatgcgtttgcttattcggctttagcttttcaattagcctatttcaaagcccattattccgatgtcttttatgacatcatgataaattattcaaatagtgattatctaatcgatgctattgattttggttttgttattgaaaaaccttcaattaatactatttcatacagagaccgcatctataaaaagaaaatttatttaggtttaaaaaatattaagggtgttcctaacgatttggcttattggatttctaaaaatcaaccgtttcagagtattgaagattttctaatgaggctgccacagcagtttcaaaaaagtggttttatttctccgctaattgctattggagcatttgacgaatttgataataatagacggaaaatcacctctaatcttgattctttatttacatttgtaaatgaactaggtagtttatttgcagatacctcatatcattggctagaagtagaagatttctctaattctgagaaatatgaaatggaacaagatatcttaggagtaggaatcagcccgcaccctttagtggggatttcacaaaaagctagccgtccgtttataccaattagtcaagttcaagaaaatagcgaagctactattttagttcagctaaagcaggtcaaagttattaggacaaaaagttctgggcaacaaatggctttcttgactgttatggatattaattcaaaaatggatattactgtttttcctgaaactttcaatattgtaagagatgatttacaagaagggaaatattattacttgcatggaaaaattcagaagcgagatgagcgattacagatggttttaaacggtgttcaagaagcaacggaggaacgtttttggatacttctaaaaaatcatgataacgacaaaaaaatatcggaaatattgtccaaatacaaagggcatattcctgtctatttgcattatgaaacaactaaagaaactatccaaagcaaagtacatttggttagaaaagatagtggcttagcccttgatttatctgaatttgttgtgaaaacggtttatcaataaaattgcatataaagtgcagaaatttacaaattaatatgctataattaaatcgttaaattaataaaaggagtaccaattaaatgaaacgtattgctgttttaactagtggtggtgacgcccctggtatgaacgctgctatccgtgcagttgttcgtaaagcaatttctgaaggtatggaagtttacggcatcaaccaaggttactatggtatggtgacaggggatattttccctttggatgctaattctgttggggatactatcaaccgtggaggaacgtttttacgttcagcacgttatcctgaatttgctgaacttgaaggtcagcttaaagggattgaacagcttaaaaaacacggtattgaaggtgtagtagttatcggtggtgatggttcttatcatggtgctatgcgtctaactgagcacggtttcccagctgttggtttgccgggtacaattgataacgatatcgttggcactgactatactattggttttgacacagcagttgcgacagcagttgagaatcttgaccgtcttcgtgatacatcagcaagtcataaccgtacttttgttgttgaggttatgggaagaaatgcaggagatatcgctctttggtcaggtatcgctgcaggtgcagatcaaattattgttcctgaagaagagttcaatattgatgaagttgtctcaaatgttagagctggctatgcagctggtaaacatcaccaaatcatcgtccttgcagaaggtgttatgagtggtgatgagtttgcaaaaacaatgaaagcagcaggagacgatagcgatcttcgtgtgacgaatttaggacatctgctccgtggtggtagtccgacggctcgtgatcgtgtcttagcatctcgtatgggagcgtacgctgttcaattgttgaaagaaggtcgtggtggtttagccgttggtgtccacaacgaagaaatggttgaaagtccaattttaggtttagcagaagaaggtgctttgttcagcttgactgatgaaggaaaaatcgttgttaataatccgcataaagcggaccttcgcttggcagcacttaatcgtgaccttgccaaccaaagtagtaaataagaatttgtcaatttgacactttaaataaaaaggagctcataaattattatgaataaacgcgtaaaaatcgttgcaacacttggtcctgcggttgaattccgtggtggtaagaagtttggtgagtctggatactggggtgaaagccttgacgtagaagcttcagcagaaaaaattgctcaattgattaaagaaggtgctaacgttttccgtttcaacttctcacatggagatcatgctgagcaaggagctcgtatggctactgttcgtaaagcagaagagattgcaggacaaaaagttggcttcctccttgatactaaaggacctgaaattcgtacagaactttttgaagatggtgcagatttccattcatatacaacaggtacaaaattacgtgttgctactaagcaaggtatcaaatcaactccagaagtgattgcattgaatgttgctggtggacttgacatctttgatgacgttgaagttggtaagcaaatccttgttgatgatggtaaactaggtcttactgtgtttgcaaaagataaagacactcgtgaatttgaagtagttgttgagaatgatggccttattggtaaacaaaaaggtgtaaacatcccttatactaaaattcctttcccagcacttgcagaacgcgataatgctgatatccgttttggacttgagcaaggacttaactttattgctatctcatttgtacgtactgctaaagatgttaatgaagttcgtgctatttgtgaagaaactggcaatggacacgttaagttgtttgctaaaattgaaaatcaacaaggtatcgataatattgatgagattatcgaagcagcagatggtattatgattgctcgtggtgatatgggtatcgaagttccatttgaaatggttccagtttaccaaaaaatgatcattactaaagttaatgcagctggtaaagcagttattacagcaacaaatatgcttgaaacaatgactgataaaccacgtgcgactcgttcagaagtatctgatgtcttcaatgctgttattgatggtactgatgctacaatgctttcaggtgagtcagctaatggtaaatacccagttgagtcagttcgtacaatggctactattgataaaaatgctcaaacattactcaatgagtatggtcgcttagactcatctgcattcccacgtaataacaaaactgatgttattgcatctgcggttaaagatgcaacacactcaatggatatcaaacttgttgtaacaattactgaaacaggtaatacagctcgtgccatttctaaattccgtccagatgcagacattttggctgttacatttgatgaaaaagtacaacgttcattgatgattaactggggtgttatccctgtccttgcagacaaaccagcatctacagatgatatgtttgaggttgcagaacgtgtagcacttgaagcaggatttgttgaatcaggcgataatatcgttatcgttgcaggtgttcctgtaggtacaggtggaactaacacaatgcgtgttcgtactgttaaataatttttgaattcaaacctattatttaagaataccttaaataatgggttttttatatgttttgctttttattattcgattattgtgactagaataggatatgatattaataattaccctcctttttttatctatgaaaacatgatataatggaaaaaagattaggagtagttatggttaaacgcgattttattagaaatattattttagcattgattgctgtattgattttgattctcttgagatattttgtttttgcaacctttaaagtacataaggatgctacaaattcttattttagcaacggagatgttgttgttgttaatcgtaataggacgcctaagtacaaagactttattgtctataaggttggaaagattttctatattagtcgtgttattggtgagccaaatcaaaaagtgagagtaatggatgatattttatatttgaatgatgttttcaaggatgagccttacattgaaaaaatgaaaaatgcttattctgaaaagaaagacggtcaaatgccctttacttccgacttctcagttgaaacattaacacgaaataaagaaagcagagttcctaagggttcttatcttgtgttaaatgataatcgacaaaataaaaatgatagtcgaaaatttggattaatcaaagagaaagatattcgtggtgttattacctttaaagtataccctctaagtgaatttggttttacagcttcagagtagtaaaagaatggtattatttgataccattctttttatgtaataaaatggctaagaaatatatttttttaagatagatagaatttttgatagcgtttatctcgttatcacagaaaatcaaaaagactataccaatttttttattgacaaacaaaaacattaattatatactgtttttgttactttttaacggtatatattaatatataccaattcaaaaagaaagtttagatagaaagtataagagaaagctcttattggtaataataatatgtgtggtatcgtaggtgtagttggaaatacaaatgcaacggatattttaattcaaggcttagaaaagctagagtaccgaggatatgactcagcaggtatttttgtagtaggtgataacaaaagtcaacttgtgaagtcagtcggtcgaatcgcggagattcaggcaaaagtaggagattctgttagtggtacgacaggtatcggtcatacacgttgggcaacccatggtaaacctactgaaggaaatgcacatcctcacacttcaggatctggtcgttttgtattggtacacaatggtgttattgaaaattaccttcaaattaaagaaacttacttaacaaaacataacctcaagggtgaaactgatacagaaatagctattcatttagttgaacactttgttgaagaagataacttatcagtgcttgaagcctttaaaaaagccttacatattatagaaggatcatacgcatttgctcttattgattctcaagatgctgatacgatttacgtagctaaaaataaatcacctcttctaataggtttgggaaatggttataatatggtgtgttcagatgccatggctatgatacgtgagacaagtgaatatatggaaatccacgataaagaactcgttattgttaaaaaagatagcgttgaagttcaagattatgatggtaatgtcattgaacgtggtagctacacagcagagcttgacttatcagatattggtaaggggacttatccattctacatgcttaaagaaattgatgagcaaccaactgtgatgcgtaagttgatttcaacttatgcgaacgaatctggagatatgaatgtggattctgatattataaaatcagtccaagaagcagatcgtctttacatattggctgcaggaacgtcatatcatgctggttttgctgctaagaccatgatcgaaaaattaactgatacacctgttgaacttggagtttcttcagaatggggttacaacatgccacttttgagtaagaagccaatgtttattttacttagtcaatcgggagaaacagcagatagtagacaagttttagttaaagcaaacgaaatgggaatccctagtttaactataacaaatgtgcctggctcaacactttctcgtgaagcaacctatacgatgctcattcatgcaggacctgaaatcgctgttgcttctacaaaagcatatactgctcaagttgcaacgttagctttcttagcaaaagcggtaggagaagcaaatggtaaggcagaagcaaaagattttgatttggttcatgaattgtcaattgtagcacaatcaattgaagcgaccttatcagaaaaagatgttatctctgagaaggtagagcagttgttaatctcgacacgtaatgccttctacattggtcgtggtaacgactattatgttacaatggaggctgcactgaagctaaaagagatttcttatattcagacagaaggttttgctgcaggtgaattaaaacatggtacaatttcgttgattgaagacaatactcctgttattgctttaatatctgctgattcaactattgcagcgcatactcgtggaaatatccaagaagttgtttctcgcggagcaaatgctttgattattgtagaagaagggttggaacgtgaaggtgatgatattattgttaataaagttcacccattcttatcagccatttcaatggttattccgactcaattaattgcttactatgcttcattacaacgtggcttagatgttgataaaccacgtaatttggcaaaagctgtaactgttgaatagactcgttacactaaaatacgctaatattaactacaaaatattaaaaattgtaaaaaagcctatttttgaaggaaaataggccacgccaaacgcatgaagaaacttttgttttcagaaaactagattcataatgacaaaatcaatcaaagtagtacactatagatgaggtgactacgatgattgattttattatttctattgatgattgcgcagttgaattggatagtcgtcaatcttggaaaattcgctaccccttatcaaccattctatttcttgtctttgtttgtcagttagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaatcatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggctaagcagatcattgatttaaaaaggaatcttttcaaaattgatgtccgggcacaaaaggatgaagagaaagttttcatgcgtacggcgtggaaaataggctttttcctattgtcaagaagcctataatcagttagaatgttacttgctgactattttattaattaatttaaggagagaaaaatgtcattaccaaattgccctaagtgtaactctgaatatgtctatgaagacggtattttactggtttgtccagaatgtgcttacgagtggaatccagaagaaatcgaagaagaagtaggtttaattgtattggatagcaatggaacgcgcttatcagatggagatactgtgacagttattaaggatttaaaagtaaaaggagcgcctaaggatattaagcaaggcactcgtgttaaaaatattcgtttagttgatggcgatcataatatcgattgtaaaattgatggttttggagctatgaaactaaaatctgagtttgtaaaaaaatagctttcaggcaattggcaacggtcaattgctttttgaatatgacttgatttcatgcatttttattaaaaaagctctatgacattggtttgaattttgatataatgagaacatctattttttatttaggggggaccatgtcttatattttagaaatcttacctagcttattagtaggtgcgcaagtgacattgcaagttttctttattgttatttgtttatcaattccacttggtattgttgtagccttcctaatgaaagttcattttaagccgcttcaatggctactgacaacttatatttggattatgcgaggcacgcctctgttattacagcttatctttttttattactttttaccaagtgtagggatttcttttgatcgtatgccagctgcgattattgcttttacgatgaattatgcagcttattttgcagagatttttcgaggaggtattgagtctattcctaaagggcaatatgaagctgcaaaggtattaaagttttctaagtttcaaacggtttggtacatagtattacctcaagtcttcaaaatagtcttaccgagtgttttcaatgaaacgattactttagtgaaagattcctcattggtttacatacttggtgtgggcgacttacttctagaaagtaagacagccgcaaatagggatgcaacacttgcaccaatgtttatagcaggtggtatttacctattattaattggtcttttaactattttatctaaacaagttgaaaagcgttttaactactataaataaggagggacgatgttagaattaaaaaatatttctaaatgctatgggcaaaaagaaatctttaaagatttcaatctgactgtagaagaaggtaaaattctctctttagtaggaccttctggaggtggaaaaacaacactattacgtatgttagctggattggaaaagattgattcagggactattgttcacgatggtaaagaagtatctgttgatcatttggaaacactaaatcttttaggattcgtcttccaagactttcaattattcccacatttaacagtattagataatttgatcctctctcctgttaaaacgatgggattatcaaaagaacttgctaaagaaaaagccttagtattacttgaacgcttgggacttaaagaccatgctttagtctatccattttcattatctggggggcaaaagcaacgtgtcgcactagctcgtgcgatgatgattgatccacagattattggttatgatgagccaactagcgctcttgatccagagttgcgtcaagaagtagaaaaactaattttacaaaatagagaaacaggtatgacacaaattgtagtaacacatgatcttcaatttgctgaaagtatatctgatacgattctcaaaattaatcctaagtagacttgggggtagattgttgactcacaaaaatatattattaaccattatatttggattatttatgattatattatcagcatgtggtatgtctaataaggaaatggctggtattgataattgggaacattatcaaaaggaaaagaaaattactattggatttgataatacttttgttcctatgggatttgaaagtcgttctggtgactataccggctttgatattgatttagctaatgctgtttttaaagaatacggtatttcagtgaaatggcagcctattaactgggatatgaaagaaactgaacttaataatggtaatatagaccttatttggaatggttattcaaaaacggcagaacgtgctaaaaaagtcgcttttacaaacccatatatgaataatcatcaagtaattgttactaaaacttcatcacatattaatagtattaaggatatgaaggggaaaaaactaggagcccagtcgggttcatctggttttgatgcttttaacgctaaacctgatattttaaaaaagtttgtaaaaggaaaagaagcagttcaatacgatactttcactcaggctttgattgatttaaaaaataaccgtattgatggtcttttgattgatgaagtttatgctaactattatttaaagcaagaaggaaatataaaagcttattattttgttaaaactgcttatcaaggagaaaattttgtagtaggagctcgtaaagttgatcgtagactaattgaaaagattaacaaagctttcaaacagcttcataataaggggagatttcaaaaaatctcttacaaatggtttggtgaagatgtttatagtaaagaataaaagactaggaatttctcctagtcttttattctacgaaaaaattaaataaaaaacatcgatatatccgatgttttctaggttaattaaccaagtttagttgcaagacgtgctttatcgcggcttgctttgtttgtgtgaattaaacctttagaagcagctttgtcgatgcttgaagaagcagcgcggtaaagttcttctgaagggttagcttcaaatgctttaatagcagtacgcatagctgatttttgtgctgagtttttttcgttttgtttaacgttaagttcagcgcgtttgatagctgatttaatatttgccaatgttttcacctccatattaatctaactatataagtatatctaattaagtgatttttggcaaccctttatcactttttgagataaatttcatcaattttatgatgtttccctttatgaataataaaatcagccctatttctggttggttctatatatttttcaaggttgactaaattaatagttttccaaatatctttagctagttccatagctttatgtggcggtatttgtgtgaatttatgatagtaattactagggtctgcttcggctaattgtagaagactgttaaatcgttgtaaataccattcttcaatttgtttattttcagcatcaatgtatattgaaaaatcaaaataatcattcatgtaaagtcgatggttttgttggttttgaaagacatttattccttctaaaattaaaaaatctggtgtttcaatagtttgcaattgatttggaacgatatcgtagatttcatgagaataaattgggattttcgcggttataccgttctttatagtatctaagaaatttagaagtgactccatatcataggattccgggaaacctttacggtttaaaattccattttgtatgagtttctcgttaggatataaaaagccatcagtagtgactaattcgacgtgactatctttaaaagttcgtgaaattagtaattgtagtaagcgactggtagttgattttccaacagcaactgaccctgatatgccgataataaaaggacgttgataattttcctttttaagaaatattgctttagaaaaagataaattttcttgactacgtttatagatttgaataaggttaattaaaggaaggtagatgtcaataacatcttgaatattaatattatcgtttaagcttttgatagattcaagctctttttcagttagtaaagcttgggattgctgatgtaagtccttccaattttctctggaaatacggtcgaaattaataaattcattattcatgtcaaactcctatatgaaagctattataacattttattgagtgattgaaaaccgtttcaaaatatggtaaaataatatggcgaaattggagggttagaattatttatggctaatatgtattatacagagaatcctaatgttgaacatgatattcatgagctaaatgtcaaattattaggagaatcattcagttttttaactgatgcaggagttttctctaaaagaatgatagattatggtagtcaagtccttctaaatagtttacattttgaaaaaaataaatccttgttagaccttgggtgtggatacggtccgctgggaatttctctagccaaagtgcaaggagttaaagcaactatggttgacattaatacgagagcattggaattagctaagaaaaatgcaacacgcaatggagtagtagttgaagtctttcagtcaaacatttatgaaaatatttctaaaactttcgactatattataagcaacccacctattcgtgctggaaagcaagttgttcattctattatcgaagaaagtatctgttaccttaatacaggcggtagccttaccattgtcattcaaaagaaacaaggcgctccaagtgcaaaagctaaaatgctagatacttttggtaattgcgatattttaaaaaaagataagggatattatatattgagaagtgaaaaagtctaaatgatatccctaaagcgtaaaaataataaatagttcggataataactatcgtattattttttggaaaggttttctctaaaaatgttttctttaaattccgtataagataaaaagaattctgctttttattctgaaaattataaaaaactacttacattatctaaaaaaaatggtaaaatagattcagctaaaataccaagactaatgaaactacaagacttggttactcaataataaatacttctgtgtttgataagaagataataaacgtgttctaaaaattttgccagtaaacattatgaagcgaaaggtgcagctactaaaaatgggaaatatagagttgaaaaaattggctgtaaaagcgagtgaaaatgcatacgttccttactcgaaatttccagtaggcgcagcattgcgtacagcagaaggaaaaatatttacaggatgtaacgttgaaaatatcagttatggattagcaaactgtgctgagcgtactgcaatttttaaagctgtttcagaaggttataaagatttttcggaaattgctatttatggaaatactgaagaaccaatttctccttgcggtgcatgccgtcaagtgatggtggaattttttaataagaatgctaaagttacattgattgctaaaaatggtaagacggtcgagacgacggtcggtgagttgttaccatactcgtttgttgatttaaaataatttaaatcagttgctcttttaagcatttagcttaaatattaagttttttaggagggttcatttcatgaacaaaaaaattgccgggatcggcttggcttcgattgcagtacttagtttagctgcatgtggacatcgtggtgcttctaaatctggtggtaaatcagatagcttgaaggttgcaatggtaacagataccggtggtgttgatgataaatcatttaaccaatctggttgggaaggtatgcaagcttggggcaagaagaatggccttaaaaaaggagctggttttgactatttccaatcggcaagtgaatctgattatgcaactaacttagatacagctgtgtctagtggttataaattgattttcggtattggattttctcttcatgatgctattgataaagcagcagacaataacaaagatgttaattacgtcatcgttgatgatgttattaaagggaaagataatgttgcaagtgttgtctttgcggataatgaatcagcttacttagcaggtattgcagccgctaaaactaccaaaacaaaaacagttggctttgtaggtggtatggaatctgaggttattacccgttttgaaaaaggttttgaagcaggtgtcaaatcagttgataaatcaattaaaattaaagttgactatgctggttcattcggtgatgctgctaagggtaagacaattgcagccgcacaatatgcttctggcgcagatattgtttatcaagtagctggtggaactggtgcaggtgtattcagtgaagcaaaatcacgcaatgaatctttaaaagaagctgacaaagtttgggtattaggtgtagaccgtgaccaagcagcagaaggtaagtatacttctaaagatggtaaggcttctaactttgttttggcttcatcaattaaagaagttggaaaatcagttgaattgattgctactaaaacaagtaaaggtaaattcccaggtggtaatgtaacaacttatggtttgaaggatggtggagttgatatagcaactacaaacctttcagatgacgccgttaaagcgattaaagaggctaaagctaaaattatttcaggagatatcaaagttcctagcaaataatatctttaagaactttcaaaaaagcgattagaaatcgcttttttgaagctgagataaacttatatctcagtaaaatccatcagtcgttaacgattggtggattttactgaactataaatgaatttttctgaaagggagaaccacatgacacagaatgtcattgaaatgaaagaaatcactaagaaattcggtgattttgtggcaaatgatcatatcaatttgacggttgaaaaaggtgagatacatgctctgcttggcgaaaacggtgcagggaaatcaactttaatgaacatgttagcaggtttactagaaccaacagacggtcaaatttttattaatggtcagcctgtaactattgattcaccttccaaatcgtcacaattggggattggtatggtacatcagcatttcatgcttgttgaagcatttactgtagctgaaaatattgttctaggaaatgaaaccacccaaaatggtgttttagacattaagacagcagctaaagaaataaaggaactatcagagaaatatggtttgtcagtaaatccaaatgctaaaatatctgatatttctgtaggagcacagcagcgtgttgaaattttgaagacactttatcgcggtgcagatattttaatttttgatgagccgacggcggtgcttacaccatcagaaataaaagaattgatgacaattatgaagagccttgttaaagaaggcaaatccattatactaattacccataaattggatgaaattcgggcagttgctgataaagttactgtgattcgccgtggtaaaagtattgaaacagtccctgttgcaggcgcaagttctcaacaactggcggaaatgatggttggacgatctgtttccttcagaactgaaaaaaaggaagctaatccgactgacataatcctttctgtaaaggatttagttgtagaagaaaatagaggcggcgttctagctgttaaaaatctgtcgttagatgttcgagcaggtgaaattgtaggtatagctggtattgatggtaatggacaaagtgaattaattcaagctattacaggtttaagaaaggtaacttctggtcaaattgtaattaaaggtaaagatgtcacaaaattttcaagtcgacaaattacagaattaagtgtaggtcatgttccagaagatcgtcatagagatggtttggttctagatatgacgatggcagaaaatttagctttacaaacttattataaagagccattgagtcataaaggtatccttaattttgctaaaattaaagagtatgctcgtcaattaatgacagaatttgatgtgcgtggtgctggtgaacatgttttagcaagaggattttctggtggtaaccaacaaaaagcaattattgctcgtgaagtggatcgcgatccagacctactcattgttagccaaccgactcgtggtctagatgttggtgctatcgagtatattcataaacgtttgattgaagagcgcgataaagggaaagcggtcttagtagttagctttgagttagatgaaatcttaaacttatcagatcgtattgcagttattcatgatggtaaaattcaaggaattgttaaacccgaccaaaccaacaagcaagaattgggtattttgatggctggtggaaaaattgaaaaggaggagagagatgtctaagaaggcgcaaaaaattgcagttcctctgatttcagttgtactaggaatcattctaggagctattattatgctgatatttggttatgatccactttggggttatgagggattgttccaaacagcattcggtagtataaaaaatattggtgaaattttccgtgcaatgggaccattaattttaattgctctaggtttctcagttgccagtcgtgcaggtttctttaatattggacttccagggcaagccttatcaggatggattgccgcaggttggttcgctctttcacacccagatatgccacgtccagcaatgattctttgtactattattattggtatcgttgctgggggaatcactggagctattccaggtattctcagagcataccttggaacaagtgaagttattgtaactattatgatgaactatattgttctttattcaggaaatgctattgtacaacgtgttttcccaaaaagcattatgcgtacaagtgactcgagtgtatatgtttctgccaatgcatcataccagacagattggttatctagtttaacgaataattcacgtatcaatattggtatcttcattgctattattgcagttgtgttagtttggttcctattaaataaaacaacgcttggatttgaaattcgttcagttggtttaaatccaaatgctagtgagtacgctggtatgtctgcaaagcgtacaattattctatcaatgattatttctggagcttttgcaggacttggtggtgttgttgaaggactaggtacatttgagaatgtatttgtacagccatcctcgttagctattggctttgacggtatggcagtaagtctactcgcagcgaatagtccaataggtattttatttgcagcatttctatttggtgttctaagtgttggtgcgcctggtatgaacattgcaggtattccacctgagttaattaaagttgtaacagcttcaatcatcttcttcgtaggtgtccattacattattgagtatgttattaaacctaaaaaacaaatgaaaggtggtaagtaaattgagtttaacaacgatttttgcattgctattttcatcaatgctaatttacgcaacacctcttatctttacaagtattgggggaaccttctctgaacgtggtggtatcgtcaacgttggtttagaaggaattatggtaattggagctttctcaggcgttgtatttaatttagagtttgcttctgtttttggtgatgcgactccatggatttctgtactagttggtggtttagttggtttaattttttctgttatccatgcagttgcgacagttaattttcgtgcagatcatattatcagcggaaccgttcttaatttaatggcaccttcattagctgttttcttgattaaggttctttataataaaggtcaaactgataatattcaagaatcatttggaaaatttaatttccctatactatcagatattccttttgttggtgatatcttctttaaaggaacaagcttagtcggttatattgctattcttttctcattccttgcttggtttattctatataaaactcgctttggattaagattacgctcagttggagaacatcctcaagcagcagacaccttaggtattaatgtttatcttatgcgttactctggtgtcttgatttcaggtttccttggtggaataggaggagctgtatatgctcaatctatttctgttaactttgcagcgacaactatattaggaccgggctttatctccttagcggcgatgatttttggtaagtggaatccaattggtgcaatgcttgctagtctattctttggtttatcgcaaagtttagcagttatcggtagccatttaccacttttgagcaatattccaacagtttatctacaaattgctccatatgtcctcactatcattgtattagcagctttctttggacaagcagtagctcctaaggcggatggtattaattatattaaaacgaaataaataaaaagaaactagtataagctagtttctttttattgtttgtgaatttgtgaaaaaatactttgtgaaaatttcacataaattataatacaataacaataaaatataaaaaaatagaaaattgagtcattattctagtaagagtttgtgaataatgttataatgtgttttgttattaattatttataaaggagaactcttaatatgagtaaaatcgttgtcgtagggacaaaccacgctggtacagcagcaattaaaacaatgcttagtaattatggtgaagccaatgaaattgtaacatttgatcaaaattccaatatctctttcttaggatgtggtatggctctttggattggtgaacagattgatggtccagaaggattgttctactctgataaagagcagttggaaagtatgggagctaaggtttacatgaactctccagtacttaatattgactacgataaaaaagaagttacagctttagtagatggaaaagaacatgttgaaagttatgaaaaacttattttagcaactggttcacaacctatcattccaccaattaaaggtgttgaaattcaagaaggatctcgtgaatttaaagctactcttgaaaaccttcaatttgtgaaactttatcaaaattcagaagaagttattgaaaagttagctaaacctggtatcaatcgtgttgctgttgttggggctgggtatattggtgtagaattagcagaagctttccaacgtattggaaaagaagtaacacttgttgatgttgctgatacttgtatgggtggttactatgatcgtgactttactgatatgatgagtaaaaaccttgaagaccatggtattcgtcttgctttcggacaagctgttcaagcagttgaaggtgatggtaaagtagaacgtcttgttactgataaagaaacatttgatgttgatatggtgatcttagctgttggattccgtccaaatacagaactcggtgcaggtaaattagatacattccgtaatggcgcttgggtagttgataagaagcaagaaacaagcgtgaaagatgtttatgctataggtgattgtgcgacaatttgggataattctcgtgatgatatcaattatattgctcttgcttcaaacgccgttcgtactggtattgtagcagctcacaatgcatgtggtacagagcttgaaggtgctggtgtccaagggtcaaatggtatctcaatctatggccttaacatggtgtcaactggtttgactttagaaaaagcaaaacaagctgggtacaatgcagttgaaacaggctttaatgaccttcaaaaaccagaatttatcaaacacaataatcatgaagtagctattaagattgtctatgataaagatagccgagttatccttggttgccaaatggtctcacacgaagatgtatctatgggaattcatatgttctcacttgctattcaagaaaaagttactattgaaaagcttgctttgaccgatatcttcttcttaccacattttaataagccatataactatattacaatggctgcattaggcgctaaagattaatttaaaattaaaaaggttaagcgaaatgcttagccttttatttcatcctttaacaaggtcaaaaatgtaacggcaaagaaaaagctaagatattcctatcctagctttttttcaactatgttagttttttgatgcttcttggaattctgggtttttccaagcttcgtcaataatatcttttaattgttcagctgaggcttgcattttttgaagttcagcatcatttaatgggatattaactggacgaacgataccatgtgcacctacgattgcaggctgaccgataaagacatctttaacatcaccgtattggccttcttgatatacagataatggaagaactgcattttcatcatcaaggatagctttagtaatacgagcaagtgcgacagcaataccgtaatatgtagcaccttttttgttgatgattgagtatgcagcgtcacgaactgaaataaacaaatcaacaagtccttgttcatcaatatcgcgattttcttgtaaccattgttcaagttggacaccagcaacgttagcatgtgaccaaacggcaaattctgagtcaccgtgttcacccatgatgtatgcgtgaactgaacgagcatcaacaccaattttatctgctaaagcttgacggaaacgtgcagagtcaagtgaagtacctgaaccaataacgcgttccttagggaaacctgagaatttccaagttgaatatgtaagtacatctacagggttagccgctactaagaagataccgttgaaacctgattcaacaacttgagttacgattgatttgttaattgctaagtttttaccaacaaggtcaagtcgagtttcacctggtttttgaggtgcgccagcagtaatgacaacaaggtcagcatctgcgcagtctgcataagtagctgcgtagatttttttaggtgatgtaaatgcaagggcatgtgaaagatcttcagcatcaccaacagctttatcaaataaagctgggatttcaatgatacctaactcttgcgcaataccttggttaacaagtgcaaaagcgtaagaagaacctacggcaccatcaccaacgagaataacttttttatgttgtttagttgcagtcatttctaaacatctccttaaatatttttgggaagtttcccatacacctatattctatcattttcaatgaaagaagtcactaataaaatgtgaaaaaatttgcaaacaaattgaaatatcatagaaaactattgaaaacgctgagtgtcttgatatttttgataccgatttatcatcgcaattttacctaaattatggtacaatgtaagagacttacagtgaagaaaaggggcattttttaatgcaagataaaaatttagtagatgttaatctaactagtgaaatgaaaacgagttttatcgattacgccatgagtgtcattgttgctcgtgcacttccagatgttagagatggtttaaaacctgttcatcgtcgtattttatatggtatgaatgaactaggtgtgacacctgataaacctcataagaaatcagcacgtattactggtgatgttatgggtaaataccatccacatggtgattcatctatttacgaagcaatggtgcgtatggcacaatggtggtcatatcgtcatatgctcgttgatggtcatggaaactttggttcaatggatggggatggtgctgccgcacagcgttatacagaagcacgtatgagtaaaattgctcttgagatgcttcgtgatatcaataaaaatacagttgattttcaagataactatgatggcagtgaacgtgaacctcttgttttaccagcgcgtttccctaatttattagtcaatggtgcaactggtattgctgtaggtatggcaacaaatattccaccacataatctaggtgagtctatagatgctgtcaaattggttatggataaccctgatgttactacacgggagttaatggaagttattcctggtccagattttcctactggtgccttggtgatgggacgttcaggtattcaccgtgcctatgaaactgggaagggatcaattgtcttacgttcacggactgaaattgaaacaacttcaaatgggaaagagcgtattgttgtcacagagtttccatatggcgttaataaaacaaaagtacacgagcatattgtacgtttagcacaagaaaagcgcattgaaggtattactgctgttcgtgatgaatcaagtcgtgaaggcgttcgttttgttattgaagttcgtcgtgctgcttcagcaaatgtgattttaaataatcttttcaaattaactagcttgcagacaaattttagcttcaatatgcttgctattgaaaaaggtgttccaaaaattttgtcattacgacaaatcattgataactatattgaacaccaaaaggaagttattgttcgtcgtactcagtttgacaaagctaaagcaggagcccgtgctcatatcttagaaggtttacttgtggcgcttgatcacttggatgaagttatcacaattattcgtaatagtgagacagacaccattgctcaagcagagttgatgtcacgttttgaattatcggagcgtcagagtcaagctattttagatatgcgtcttcgtcgtttaactggattagaacgcgataaaatccaatcagaatacaatgacttactagctttaattgctgatttagcagatatcttagctaagcctgaacgtgttgttaccattataaaagaagagatggatgaggttaagcgtaagtatgctgatgcccgtcgtacagaattaatgattggtgaagttttatcacttgaagatgaagaccttattgaggaagaagatgttcttattactctctcaaacaagggatatatcaagcgtctcgctcaagatgagtttagagcacaaaaacgtggaggacgcggtattcaagggactggagttaataacgatgattttgttcgtgaattggtttcaacaagtactcacgatactgtgcttttctttacaaatttagggcgtgtgtatcgtttgaaagcatatgaaattccagaatatggacgtacagctaaaggcctccctatcgttaaccttttaaaacttgacgaaggtgagacaattcaaacaattattaacgctagaaaagaagatgtcgctaataaatatttctttttcacaactcagcaaggtatagtgaaacgtacaagtgtttctgaatttagtaacattcgtcaaaatggacttcgtgctattaatttgaaagagaatgacgagttgattaacgtcctcttgattgacgaaaatgaagatgttattatcgggacacgtacaggctactctgttcgcttcaaagtgaacgctgtacgtaatatgggacgcacagcgactggggtacgaggcgttaatcttcgtgaaggtgataaagttgtgggagcttctcgtatcgttaatggacaagaagtactaatcatcactgaaaaaggttatggcaagagaacagaagcttcggaatatcctacaaaaggccgtggtggtaaaggaataaaaaccgctaatattactgctaaaaatgggccattagcacgcttagtgacgattaatggaaatgaggacatcatggtcattacagatacaggtgttattattcgaaccaatgttgctaatatttctcaaactggtcgttctaccatgggtgttaaagtgatgagacttgatcaagaagctaaaatcgtcactgttgcgctagtggaacaagaaattgaagataagtctaatatagaggatacaaaagaataggaagttatgcgtaataaaaaaaaatcacatggtttctttaactttgttagatggttattggttgtattgctaattattgttgggttggctttggtgttcaataaaccaattcgcaatgctttcatagctcatcaatcaaatcattatcaaatttcacgagttagtaaaaaaacaattgaaaaaaataagaaatctaaaacaagttatgacttttcatcagtcaaatctattagtacagaatcgattttatctgctcaaacgaaatcacataatttgcctgtaataggagggattgctataccagatgtcgaaatcaatctcccaattttcaaaggactgggcaatacagagttgagttatggtgcaggaacgatgaaagaaaaccagattatgggaggcccaaataactatgccttagctagtcaccatgtctttggtttgacaggttcttctaagatgctcttttcacctttagaacatgctaagaaaggtatgaaagtttacctcactgataaaagcaaagtatacacttacactattactgaaatttcaaaggtaacaccagaacatgttgaggttattgatgatacacctggcaagagccaactcactttagtgacctgtacggatccagaagccacagaacgtattattgtgcatgctgaattagaaaaaacaggtgaattttcaacagcagatgagtcgatattaaaagcattttcgaaaaaatataatcaaattaatctctagaaggtagttagaattatgaaattaaaggctgttcatcatattgcgataattgtttctgactatgaaaagtcaaaagacttctatgttaataagctaggatttgaaattattcgtgaaaaccatcgtccggagcgtcatgattataaattagatttacggtgcggtgatattgagcttgaaatatttggaaatcgtcttgatgatccagaatatgaaactcctcctcagagaataggtaggccgaattggccacgtgaagcatgtggtttacgacaccttgccttttacgttccagatgtggaagcgtacaaggtagaactggagaatttaggaatttttgtagagcctattcgttacgatgactatactggcaaaaagatgacctttttctttgatccagatggtttacctttagaattacatgaataataaacaaagttgcgtggatacgcaactttgtttaatttactgaataattttatattcaagaagttttttaaagaaataagtaagttaatcatggtataatgtaaggtatgaaaagaattgaaaaggaattattttgaaatgaggatactaaaatgagtattaaaaagctattgtttgcaggccttgcttttattttatttaccctagcgagtccagcatatgctgcatcagatgttcagaaagttattgatgaaacttatgttcaacctgattatgtcttaggttattcgctaaatcaagaacagcgtgcacagacattacaacttctgaattatgatgaatctagagacacgaaagttaaaacgctaaatactagctcatatgctaaaataatgaatatagctgatgatgcaagcatccaattatattcatctgttaaaataaaaaaattagggtctaacgataccttagcagtaaacattgttacacctgagaatattactaaagttacagaagatatgtatcgcaatgctgcagttacattaggtattgagcatgcaacgatatcagtggctgctccaataaaagtaactggggagagtgctcttgcaggtatctattattcattagagaaaaatggagcaagtgtatcatcagaaaataaacaactagcacaagaagagttaagtactttatctggtattaatgctgagaataagggtaaggaaggttatgacgccgacaagcttaatgtagctttaacggatattaagtcagccgtagctaaaggaggatctgatctttcaaaagatgatattcgaaaaattgttgaggaaacattgaaaaattatcatcttgataacgctgtaacggaaaatcaaataaatttaattgttaattttgcagttaatctttcacaaagtaatgtcatcaaaaatagtgatttcacgaacaccttgaataatttgaaagacaacattgtttcgaaagcaggatctaaatttaaaaatatcaatgtcaattttaatgctaataaagctgttgaatcaggtaagggatttttagctaatatttggcaacaaattgttaattttttccagcagtttggtagttaataaaaaagtctagcttataagctagactttttttaccctaaataaatgtttgtgtttttttactaatctttaaatgaatatttaagaataaatggcgcaataatagttgatagtataacaacaataacaagctcggaataagtagtgcttgaaataattttagcagctaatccaacttgaactataatgagagccatctcgccacgactgaccattccaccaccaattgttaaagattctaattttgaaaaattaaagcctcgaccgacaaagtaccctggaattaattttgataaaacagccaaagcagtaaagattaatatcgtgtgaaggtgagacatcattccatcgaatttaagaggtagtgcaattgaagcgaagaaaattgggataaagaaggtgtaactaagaagtgaaattttatgttctaccttatcaacaaaagaagtttgtccaatagctaatcctgcaaaaaacgaaccaatgatagaactcattccaactttatcggctaaaattgatagagaaaaacagataaggatagcaagaatagtatatttctcaaagaaatgaaccttttcgattaatttgaaaagagcaggtacaaggtatttcatacaaataaataagaaaacaaagaataacaattgaatgataatttgtaatccgatattagaagagcttccatttgttgcaataaagacactcagaagcaaaacagctaagacatcatcagcaacagcagcacctaaaataatagcaccagtatctgtttttacacgattgtattcttgtaaaacttcaactgtgatagaaatactagttgcagcaaatacgagcccgtaaaagatagcagtattgatttggaacccaaacaagcgtgtcaagaagtagaagagagccataggaacaataacaccagtaattgcgaccagtagactgggcttaagatacttctttaaaagatcaaaattagcttcaagacccgctaaaaacatgagtaagataacaccaatttctgacaagacatgtaatacctgattttgatgaacaagtcctagcattgcaggtccgatgatgatacctacaagtagttgtccaacaacagccggtattccaattctttttgaaataagagttgcaagaacgcttgccaacaaaatgattgtaatttgaatgataatatgcattttttcctcctaatattaataaaatgatatcaatcatattgtactgaatatttagaataccattttttaagcctaaaatctaggaatatttcttttctgtctttttcatattattatcaagaaaatggaaaaatatactgaaaaatattcaatttaagaataatgaacttgtaactatcgaactacataaaaatgatattttaagtgtaagtatctcttattagacttcctgcgaaacaaaatatggtacaatagttctatgaattatgaagcaagcaaacaattaactgatgtacgatttaagcgccttgttggtgttcagcgcactacttttgaagagatgttagctgtgttaaaaacagcttatcaacgtaaacacgcaaaaggtggccgaacccctaagttaagcttagaagatctcctcatggctactcttcaatacatgcgagaataccgcacttatgaacaaattgcggctgattttggcattcacgaaagcaacttaatccgtcgaagtcaatgggttgaatcaactcttattcaaagtggttttacgatttcaaaaactcatcttagtgctgaggatacggtgattgtggatgcaacagaggtaaaaatcaatcgtcctaaaaaaatcaactagcgaattattctggtaaaaagaaatgtcatgctatgaaggctcaggcgattgtcacaagccaagggagaattgtttctttggatattgcagtgaactattgccacgatatgaagttgttcaaaatgagtcgcagaaacatcggacaagctgctaaaatcttggcagacagtggttatcaagggatcatgaagatgtattcacaagcgcaaactccgaggaaatcaagcaaacttaagccactaactcttgaagataaaacctataaccatacgctatccaaagagagaatcaaggttgagaatatttttgccaaagtaaaaacgtttaaaatattttcaacaacctatcgaaatcgacgcaaacggtttggattacgaatgaatttgattgctggaatgatcaaccgtgaactaggattttagtttcgcaggaagtctattcaagaaataagagtaaaaaaacttagctacttaaagtagctaagtttttattcccactcaacagttgcaggtggtttacttgtaatatcataaacaatacggttaacgtgatcaacttcgttaacaatacgtgtcgaaattttcttaagtacatcccaaggaagttgcgcaaagtcagctgtcatgccatcaattgaagtaattgcacggatagcaattgtatagtcataagtacgaccatctcccataacaccgacagaacgtacgccagtattaactgtgaaatactgccatacgtcacgatctagaccagctttagcgatttcttcacgaagaatagcatctgattcgcggactgtttcaagtttttcttcggtaatttcacccataacgcgaatagcaagaccaggcccagggaatggttgacgccatacaacttcatcaggcattccaagtgcagtaccaagagcgcgaacctcatctttgaataatgtgttaagtggctcaatcaattcaaattgcatatcttctggcaatccaccaacattatggtgtgacttgattgtttgggctgtttctgtcccagattcaataatatctgtgtagagggtaccttgagcaaggaaatcaacgcctttaagtttacttgcctcatcatcaaaaacgtacacgaactcatttccgatgatttttcgttttctctcgggatcttcaacaccagaaagaagatctaggaagcgttttgaagcatcaacacggataatattaagtccaaatttaccaccaagcatatccataacttggtcaccttcatttttacgtaataaaccatgatctacaaaaatacatgttaattgatcaccgatagcacgttgtaggagtactccgacaacagatgaatcaacaccgccagatagtccaagaagtactttacgatcgcctacagtttcacgtatttttgcaatttccatatcaatgaagttatccattgaccaatcaccacgtgcgccacagatattaacagcaaaatttttaaggatatcattgccatatactgagtgacgaacttcggggtggaattggataccataaaattgtttttcagtattttccattgcagcaaatggacagtcaacagagtcaccaacgagatggaaaccctcaggaatttcagtgacagcatcaccatggctcatcaaaacaagttgttcttgaggagtgccagcaaagagtgctgattctgagcgtaggcgaagtgctgattgaccatactcacgatgaccagcttctcccgcaggaagaaccttaccaccgagtttatgggtaatcagttgcatgccataacaaattcctaagattggaattcctaattcaaaaatttcttcatcgattccaaaagcgccatcagcgtatacggaatttggaccacctgaaagtacgataccaataggattaatatcgcgaatttcatcagccgtaattttatgtgattttaactcagaaaatacaccaaattcacggatacgacgtgcgataagctggttatattgactaccgtaatctagaacgataattttttggatatcattcaatatagaaatatcagtcattgtttccctttctttgtagctaattttaaaaacagctgtacctataccattttagcatattttatataaattaacatcattaaaataattgattaaacgctttcttatcaagaaatattgcttatgatttttctgaattatttcacgattttagagttagaaatatatagaagtatggtaaaatgaagtgtagattctaggaggagagaatattgttaccagcatatattaaaattcacgacgctattaaaaaggaaatcgataaagggacttggaagattgggcagcggttacctagcgaaagagatttagcggatgattatagtgtaagtcgtatgacacttcgccaatcaattacattgttagttgaagaaggtattttggagagacgagttggtagtggcacctatgttgctagtcatcgtgttcaagaaaaaatgcggggaacaactagttttacagaaattgtcaattctcaagggcgtaagccatccagtaaactaatctcatttcaaagaaaactagcaaatgaaaccgaaattcaaaaattaaatttatcacagtcagattatgtggttcgtatggaaagggtacgttatgctgataaggtaccgttggtttatgaggtagcctctataccagagaatttaattaaaggttttgaacaatcagaggttacagaacatttctttaaaaccttaacagagaatggctacgaaattgggaaaagccaacaaactatatatgctagaaatgctagtgaacgtgttgcttcgcatttagaagttaacgcaggccatgctattttggcattgacacaagtttcatactttactgatggtaagccttttgaatatgttcatgggcaatatgttggagatcgttttgagttttatttagagaataactagtagtttaatgaataacgttttttgaagaagtagctatgtatgttataatggaaaaataaattatatagaaagatttgaggaagtagttgactactttcaagaggtattagttcatgtctcaatcttacattaatgttatcggcgctggtttggctggttctgaagcagcttatcaaattgctaaacgtggaataccagttaagctttatgaaatgcgtggggttaaatcaacccctcaacataaaacagataattttgcagaattagtatgttccaattcattccgcggtgattctctaacaaatgcagttggtcttttaaaagaagaaatgcgtcgtttggattctatcattatgagaaatggggaggcacatcgagttccagcaggtggagccatggccgttgatagagaaggttattctgaagctgttactgaggaaatccataaacatccattaatcgaagtaattcgtgatgaaatcacagatatccctggagatgctattacagttatcgctacaggaccattaacaagtgatagtctggcagctaaaatccatgaacttaatggtggtgatggtttttatttttacgatgccgccgctccaattgtcgataaaaatacgattgacataaataaagtttaccttaagtctaggtatgacaaaggtgaagcagcttatctaaattgtccaatgaccaaagaagaatttatggcttttcatgaagctttaactacagctgaggaagcaccactaaattcttttgagaaagaaaaatacttcgaaggttgtatgcctatcgaagtgatggctaagcgtggtattaaaacgatgctttatggtccaatgaaaccagttggtttggagtatcctgaggactacaaaggaccgcgagatggtgaatttaaaacaccatatgctgttgttcaattacgtcaagataatgctgcaggctctctttataacatagttggtttccaaactcatcttaagtggggagaacaaaaacgtgtatttcaaatgattcctggtcttgaaaatgctgaatttgtccggtatggtgttatgcatcgcaattcttatatggattcaccaaatcttttaaaccaaacctttgctacacgtaagaacccaaatcttttctttgctggacaaatgaccggtgttgaaggttatgtagaatcggcagcaagtggtcttgtagcgggaatcaatgctgtccgtcgcttcaatggggagagtgaagtagttttcccacaaactactgctattggtgcactgccacattatattacacatacagacagcaaacatttccaaccaatgaatgttaactttggtatcatcaaagaattagaaggtccacgaattcgtgataagaaagagcgttatgaagctattgctacacgagctttgaaagatttagaaaaatttctcaactattgatatattcatttgactttgccaacaagcaaggtcaaattttctatattgatttttaaaaatgtatgaatggagtaaatatgcactataaagaattacttgagtcatccgaaaaagcttatttggaaactaatcggtataaacattttaagaatataatcatttcagagcgttatttttcaaactatattagctacaaaataatgcctacagtaagtgagtttttacaggatatgatctatttagcagatgaacaaaaagattatcagtctgattttgcttttgtattttttgaggaaaatgctgaattgagcagtgaattacagagaactttatcacaacaaggctttgaatcagagaaacatatcatatttacaaattcattaaatcatcttaaactttttgaaaaagaatttgatgacatcacatttactaaacttaatgaaaattacctagaaaaatacctaaagttcaaatataaacaaagtatagtttacggagaaatttacgctaagcaaatgtataatgataatcgtgttaatcttttaaataataatgctaaagtttacctagctattaaagataatcaaattattggagatgtaacagcttgggactatggtgaatacgtggaaatagatgatttttatgtccaagagtcctacagaggacaaggaattggtacgcgcctacaatttgatgcaagtagggggtttaagaaagttatcttaatttcagaagaagaaaacagaaaaatgtatgagcaccaaggttatgaggaagtcgcctattattggaccgctttacggagccctcgaaagtaaaattataaaagaaatgatatagttaaaagctatatctcttgattgataataagtattttttaatccattagctttttgttacactagtatcagttgattaatcatacaaccatatcaaaggagaaataaattatgaaaatcaaaaagctattagggttaacgacaacagtagtaatttcagcacttattttaggagcctgtggtcagtctaaaaatgaagacgccaaagtcgttagagttggaacaatggtaaagagtaaaactgaaaaagctcgttgggataaaatcgaagaattagttaagaaaaaaggcgttaagctaaaatttacggaattcacagattatacacaacctaataaagctttagaaagtgatgagattgatattaatgctttccagcattataattacttaaacaattggaataaagcaaataagaccaatcttgtttccgttgctgagacatactttacttcctttagattatactctggtactaagaacggtaaaggtaaataccaaacagtttctgaaattccaaataaagcaactattactatcccaaacgatgcagttaacgaaagtcgctctctctacttgttacaatcagcaggcttgctaaaattgaaagtatcaggtgatgcattagcaacaatgtcagatgttgtttccaatcctaaatctttagatttaaaagaagtagatgcagcacagaccgcacgttctttggattccacagatgcagcagttattaataatgattttgtgacagaagcaggaataaatcctaaatcagctatttttattgaaccaaaaagtaaaaatgcaaaacaatggtacaaccttttagttgctcaaaaaggttggcaagacaaatcaaaagctaaagccattaaagaagttgtgaaagcttaccatacagatgcggttaaaaaagttatcgaaaaaacatctcaaggtttagatcaacctgtttggtaaaaataaataagcatggtcaattcgatcatgcttatttatttcgattttttttgagtaattgactaggggtactcaatacttctgttaaccgttgttgtcgtgctttacttttttcggatttagataaaagtagtgtcttactttcttcaaggatatcctctgtaatatagtacaacttcactaatgaaccgattctgaccctaccagctttaggcgacatattcacaacttgattaggatgtagggttgcccactttgaatttggttcagcaacaatccttgatacattaaaatggcgttgctctaagtaaacttgcgcatcattgatatcaaggtgtactacattatcaagctgagtataagtctgtttttttttcatgacgacggtcaagttctttttcaataattggacgagaattatcaattgcttttccaataagttcagttgtgtcagggattattgaaattaatttaccaataggccctaaagattttgtcaattttttacttgtcttggccatatgttttcaccgtactttccatttgttatgtaagatattatatcaaaattatagtttataaagcttttaaaactttcaaatttgtaagaaataggtcttaagatgtaaggttatagtaaaccattttgccatataatagacttaaagagaaagggggagcaagagatgcggcgaaaaatagttttactttttgtagttccaatgcttatagttttaggaattttaggagtggtagttcattattatggttcagcattaaatatttatctattacctcctagtagcgaacgttatggacgtgttattttagatcgtgttgaacagcgtggtttgtattcgcaaggtcgtcaatggcaaattataagacaacgatcagaaaaaaagttgaaaacgtcaaaatcttaccaagagagtcgcaacattgtacaggaagcagtacggtatggaggcggtaaacatagtcaaatattatccaaagagactgtacgaagagataccctagatagtcgatatccagaatatcgaagattaaacgaagacattctcttaattactattccttctataagtaagttagataaacgatctattagccattatagtggtaaattacaaaatatattgatggaaaaaagttataagggactcattttagacttatcgaataatactggcggcaatatgatccctatgattgggggggtagcctctattttaccaaatgataccctatttcattatactgataagtatggaaataagaaaacaatcacgatgaaaaatataccgctagaagcattaaaaatatctaggaaaacaatcaatactaagcatgttccaatcgctattataactaatcataaaactgctagttcggcagaaatgacttttttatcatttaaaggattacctaatgttaaaagctttggtcaagctacagcaggatatacgactgttaatgaaactttcatgctttacgacggtgctagattagctttaactacaggaatagttagtgatcgacaaggatataaatacgagaacacccctatcttaccagatcaagtaaccagccttcctttacaagagtcacagtcttggttaaagagtagaatcaatcaaaattagggtataataaataaaggagaattatatgttattagaaatcaatcacttagaaaaagtttttcgtacacgtttttcaaaagaagagacaagggctctacaagacgtcgattttaaagttgaacaaggggaattcattgctattatgggagagtctggttcgggaaaaacaactctgctaaatattttagctactttagaaaaaccgacaaatggacaagtgattttaaatggggaagatattacgaaaattaaagaggcaaaattagcgagttttcgtttgaaaaatcttggtttcgtctttcaggacttcaaccttttggatactctctctgtaagagataatatctatcttcctttagttcttgatcgtaaacgttacaaagaaatggatcatcgtttgtcagaattatcttctcatctgagaattgatgacttattagataagagacctttcgagctctctggtgggcaaaagcaacgtgtagcgattgctcgtagtttgataaccaaccctcaaattttattagcagatgaaccaacagcagcgttagattaccgtaattcagaagacttgctgaatttatttgaaactattaacttggatggacaaactattttgatggtaacccattcagcaaatgctgctagtcatgccaaacgcgttttatttatcaaagatggacgtatttttcaccaactttatcgtggtaataagaataatagcgaattcaataaagatatttctttaacaatgtctgccatattagggggtgaataatatgttttatctcaaaatagcctggcataatttaaaacattctatagaccagtacataccattcctcttagccagtttattactttattcattgacttgttctacgctactaatcttaatgagtgctgttggaagagatatggggacagcggcaacggttctttttcttggagtgattgttttgtcaatctttgcggtagtcatggaacattatagctacaatatcttgatgaaacagcgtagtagtgaatttggactgtataacattttggggatgaataaacgtcaagttgcgcgtgtagctagtctagagctgtttattatttatatatttcttatttctataggaagtctgtttagtgctttttttgctaaatttatttatttaatttttgtcaacattattaactatcatgcactaaatcttagtttaagtttatggccatttattatttgtatcgttatatttacaggtatttttctgactttagaagttccagttattcgacatgttcatttatcatccccattaagtctttttagaaagaaacaacagggagaaaaagaaccaaaaggtaatcttatacttgcaattttagcgttagtagctatcgccatcgcttatacaatggctcttacttcaggtaaagcacctgcattagctgttatctatcgtttcttctttgcagtacttttagttattgctggtacttatcttttttatattagttttatgacatggtacttaaaaaggttgcgtcaaaacaagcattattattataaatctgagcattttgtatcaacttcgcaaatgatttttcgaatgaagcaaaatgcagtagggttagcaagtatcactttattagctgttatggctctagttactattgctacaacagtctcactttattcaaatacacaaaatgttgttaccggactatttccaaaatcagtaagtttatcaatagataattcaaaaggtgacgcgaaaaatatatttgaagaaaagattttgaagaaactaggtaagtcatctaaggaagctatcacttataatcagacaatgatttcgatgccagttagtcaatcaagtgaacttaatatcacatctaaaaacgtcaaacatgttgatatcacaaaaacgggttttatgtacctaattactcagaatgatttccgtcgtttaggtcaccaattaccaaaattaaaagataaccaagtggcttactttgttcaaaaaggtgatagccgtttgaaaaaaataaatctattgggaaataaatttgacgttgtaaaaaatttaaaagaggcttatgtcccagagactacaaatacttacaacccgggtttgattatatttgcaaacaacaaacaaattgacaatattagaaaagcatatttaccttatactaagaacatcaatacttttccaaaaacctttaaggcatatttggatttgaatagtcaagagataaattcaatttctaaaaacgacataatagaggtagatggtaagtatgttggaaatattagcactaaacagagttttctaaaagaaggttatcaaatgtttggtgggttattatttactggatttctgttaggtataagctttttgctaggtatagctctaattgtttactataagcaatactcagaaggtcatgaagataagagatcttatcgtatcttacaagaagtaggtatgagcaaaaaattagttaaacggactattaattctcaaattatgattttcttcttccaacctttagtggtagcagttattcactttggagttgctattccaatgctaaaacagatgcttttggtatttggggtgcttaactcaacaatcgtatatgtagtaagtggtttgacagtacttgcgatttctataatttactttatcatttaccgtataactagtcgaacttattatcatattattgaacgctaaaaaggattggttattttaccaatccttttgcattaatagaaaccgatagactaaaaaatttgttatactaaatgaaagaaagagatttcgtactattttaggaggggatatgtcacaagagcaaggaaaaatttatattgtagaagatgatatgacgattgtgtcacttttaaaagatcatttatcagctagctatcatgtctctagtgtcagcaattttcgtgatgtgaaacaagaaattatcgcatttcaacccgatttgatactaatggatattacgttaccctattttaatggtttttactggactgcagaattgcgtaagtttttaacaattcctattattttcatttcatctagtaatgatgaaatggatatggttatggcattaaatatggggggtgatgactttatttcaaaaccattctctctagctgtattagatgctaagctaactgctattttaaggagaagtcaacaatttatccaacaggaattaacttttgggggatttacgttgacaagagaagggttattgtctagccaagataaagaggttattttatcgccaacagaaaataaaatcctatctatcttgctcatgcatcctaaacaagtagtctcaaaagagtctctattagagaaactttgggaaaatgatagttttattgatcaaaatacacttaatgttaatatgacacgcttacgtaaaaaaattgtcccaataggttttgattacattcatacagtgagaggagttgggtatttactacaatgatacgccagtttttaagagaacacttgatttggtatattttatatatcatgatgtttgtcctattttttattagtttctatctatatcatttaccaatgccctatttgtttaattccttaggtttaaatgttattgttttactaggaattagtatttggcaatacagtcgttacaggaaaaaaatgttacatctcaaatattttaatagtagtcaggacccctctttcgaacttcaaccgagtgattacgcttattttaatattattacacaattagaagctagagaagcgcaaaaagtttctgaaacaattgaacaaaccaatcatgttgcacttatgataaagatgtggtcgcaccaaatgaaagttccattggcagctatttcattaatggcccagacaaatcatctcgatcctaaggaagttgaacaacaattattgaaattgcaacattatcttgaaacgttgttagcatttttgaaatttagacaatatcgtgacgattttcgttttgaagctgttagccttagagaagtagtagtagaaattataaaatcgtataaggttatttgtctatccaaaagcttatctatcataattgaaggcgataatatctggaaaacagacaaaaagtggttaacttttgctctttcacaggtgctagataatgccataaaatattctaatcctgagtcaaagataataataagcataggagaagagagtattagaatacaagactacggtatcggcatactcgaagaagatatccctagactttttgaagatggctttacgggttacaacggtcatgagcaccaaaaggcaacaggcatggggttatatatgacaaaagaagtcttatctagtctgaatttgtccatttcggtggatagcaaaattaattatgggactgctgtttctatacataaataaagttatgtaaaataaaatatttacataactttatttatgttactatagtttatctaaagcgttcttttgttcatcgttaacaatatgggtatataggtcagtaacttgagtggaagcatgacctagttggtggctaactaatacttgagattttgtagcatcatatagcctagtagcaagagtatgccttagtttatgaggtgttacacgaaccttaaaatcctgggaatacttagcaaccattttctctacacttgaagcatcaatacgatttggcaccccacggtattctgataaaaatagagcaatgtcctgattttctgctttgtatctatttttacggatgtctaaataattagcaaggtagggcttcgcaaagctagcgacattgacagagtcccttttccccccttttcgtgtgacatcaataaccattacattaaggttaatatcctttaaatctaagtttactgcctcagatagacgcactcctgaagctagtagcaaagcaataatagctaaatctctctctttatttttgttgaaaaaagctaaagcacgtttggaaagtttgttttgatattcacaatctatatactctaagaattctatcgtttcattgcccaaaaataacttttgtttaatattttctgcccgagaagctaaagtttcctttttctttttggttgagacttttttcatgacattgcgataaaagtaaggctccccgtcagcattctcaacctcttcagtaaggtatttgaaaagactagataaggcagatagagttctgttaatggtggtttgagacaccccattttgccttgtgttagcatttaataaagggcgttctcgtaaatatagtataaaagcttccatatcttttttagtaaggttttctaaaactgaaagctcaatttctgcaatgtgatgacaattagcaacaccagaatccaataaccattcaagaaaacgtctatattcttttaaatattcgtagagtgttgtgaaactataaggaacagaaagctttgattgataatattctagaacataccaaggcataatttcttttagttcatcgattttttcgagtagtaattcacgtttcataataaaatctccattatatctataaatagaagtatatcatactctatcataactttcaagaaaattatagtttttcggaaagtttaaaagttaaaaacaggaattcattcggtaagtatatcaaatatccattctttatgatgatcagtattacttattatcgtttaacatgtttgttatagtaaagacagagtattttgagaaaactgattcataatttcattgattttatcggtatctgaaaaggtaataaagtgtactcaattatttttaattatatttgcaagttaataaccaaagttaaattctactttaaaatatactagttttctcaatattagatctactatgtcttataaaaatcagaagatttgaaatatttctttctttcttgaaattttatgatataatatgtcctatatctttatagaaggtttaggaggactggtattatgtctagttttaatagaaaaaaacttaagtttttgggtatatctttggcgactctaacagccaccacagttaccctggttgcctgtggtaatgagtcaaagaactctggagataataaagttattaattggtatattcctactgaaatcagtacattggacatttcaaagaatacagatgcttattcaaacttagctataggtaattcaggcagcaatttacttagaattgataaagagggcaaaccaaaacccgatttagctaaaaaagtatccgtttcttctgatggtcttacttatactgctacacttcgtgataatttaaaatggtcagatggaagcaaactaagcgctgaagattttgtttacacatggcggagaatagttgatcctaaaactgcatctgaatatgcttacttggcgacagaatcgcaccttttaaatgctgataagattaattctggagatattaaagatttaaataaacttggtgtaacagctaaaggcaatcaagtgacctttaaattgacaagtccatgccctcaatttaaatattatttagccttctctaattttatgcctcaaaaacaatcgtatgttgaaaaagttggtaaagattatggtacaacatcaaaaaatcaaatttactcaggtccttaccttgttaaggattggaatggttcaaatggtaaatttaaattagtcaaaaataaatattattgggattctaaacatgttaaaacaaatagtgtcatagttcaaactatcaaaaaaccagatactgcagttcaaatgtacaagcaaggtcagattgattttgctgaaatatcaggaacttctgctatttatcaagctaataaaaataataaagatgtagtagatgcgtctgatgcacgtactacatatattatttataaccaaactggttcggttaaagcattgacaaatcagaaaattaggcaagctttgaatttagcgactgatcgtaaaggtgttgttaaagcggcagttgatacaggttcaactcctgctgaatctctggtccctaaaaaattagccaaattacctaatggtgaggatctttccaagtatactgccccaggttatacgtataatacaagtaaagctcaaaaactttttaaagaaggtcttgctgaggttggtcagtcatctctcaagttaacaatcacagctgattcggactctccagcagctaaaaatgctgttgactatgtgaaatctacatgggagagtgctttgcctggtctaactgttgaagaaaaatttgttactttcaagcaacgccttgaagatgcaaaaaatgaaaattttgatgtcgtgctcttctcatggggaggagattatccagaaggatcaactttctatgggttattcacgactaattctgcgtataattatggtaaattttcttctaaagagtatgacaatgcctatcaaaaggcaattactactgacgccttgaaaccaggagatgccgctaatgattacaaaactgctgaaaaagctttatttgatcaatcatattataacccagtttattacctagggaaaaaaggactccaaaattctaaattaaaggggttggtaagaaattcaactggtttgaatgttgattttacttatgcttataagacagaataaaagaaaagcgttaggatatttctagcgcttttctataccaaaagtaaccaatgagttatcaaaacacttataattgagaacaatgatccaattaaataatattcggcaaaaacctgacttttagaaattttatcgtaacgtgcaatggattttgcagtaaaaacaagacctatagcagcatactgtcctgagattagtaatatagccataattagacgctctaaattaccaatcatagctcctgctccttcaattgtttcttcatgatcttcagatttttctttcattatttttgttttttcttgtgttaataatgatgataattctttagcttgaaatttattaaagaaaattttaaacacaatattaatgggtttggtgataatgataaaaaccagagctatgacaataaagtgcttgataggcaaaagccaatgattaggcggtaaatatgtaggaagcgcatggtaaaaaacgataatgcaagtatagtgggctagttggtctataataaaagctgctttttggaaatgcccttcctctacccaagggtaactcaatttctttatactatcaataacaatatgacttccccatatgcttaaatttaacaaagtagtttctggtatcaatatcattaaagctgctagggggaggaaaacaatcaagagatgtctccagagtcccctccaactatgtgatttactatctgctaaggattgactttgccactgaaagtcagctaaaaaatgtgcacaaaataataaagttaggattggattatcccttaaaaaatcagaaatcatagcttccccctttagtttgagtgcaacttttaactaatagatcggctgcctgtgttctcgttcttaagtaaatcttcagaccgcttgctttaaggcgtttagtcagcgcactaggttcaatattttccagttgggctaacttttgatgttgaaattgttcttgataattatcttgaagtattaagtgctcaagcatttgaaaatggtttgtagtccattttgacttgataaaatcaccagctgaaatgagactatttagtgttaattcaaggttttggtcttcatcatcaaggcaaatagctacttgaactgttccataatcatttttatcatgtatatgattaatagctgagcgagcatgccagtaggcaggaccatcagcaccgatactttcatttgaattgatggatgttataatgtttcctgtaccgaggccgaaccttacattaacaggttttagagctagttgaatatggtcaataatttgaaataccttttttgatggtttcaataaagcttgaaattcatcaccagctgtaatagtgaatggagaaatcagctcttcaccatatacatcagatagttcggtcattagttgctgaaaagactgttggaaagtttcacgttcaagtatctgttttgaattaatgatatcaccgattaatgctaaatacataaatatcaccacctttttgtctattatagcagacaaaaataaaaatgtctatttaaatagacatttttatttgcgtttcttcttagctttcttcattttattagccatacgtttcattgattgtttagctgcaaaggctcctacttttccttttaagccaccaccaaacatttggctgaagtccatatcgccacctaaactagataagtcaggcatgccattttgccccatcataccttctaaattagacatatccattccgtccattccaggcatatctttagggaggttattaggatcaattcccatttttttcatcattttattcatatcaccggacatcacgccttgcatcatttgttttgcctggttaaaatctttaatgaatttattaacatcaacgaaagtattacctgatccagcagcaatacgacgtctacgacttggattgaggagatctggattttctctctcttctggagtcattgatgacacaatggctcttttgcgagcaatttcgttttcatccactttgaagtttttcattgctggattgttagccattcctggaagcattttaaggagatcttccattggccccatattttgaacttgatctaattgatcaataaaatcgttgaagtcaaaggtgttttcacgcattttctccgctaattccattgaacgtttttcgtcgtattcttgactagcgcgctcaataagtgttagcaggtctcccatccccaatatacggcttgccatacgatcgggatggaaagtttcaatatcagtgattttttcccctgtccctgtaaatttaattggttttccagtaatttcgcgtactgaaagggcagcaccaccgcgtgtatcaccgtcaatctttgtcagaacaacaccactaatgctgagctgacggttaaattcttcagcgacatttgcagcttcctgtccaatcatgctgtcaacgacaaggagtatttcattaggttgagctatggctttgacatcatgcaattcctgcataagggttgcatcaatttgtaggcgtccggctgtatcaataagaacatagtcattacgattttcacgagcctgttctaaacctttagtgacaatctcaactgctgaatggttagttcccatatcaaagacaggaacattaatctggctaccaagggtttttaactgatcaatagcagctggtcgataaatatcagctgctatcatcataggacgagcattgtcttctttgattagtttgtttgctaacttaccggcaaaagttgttttaccagcaccttgtagaccaaccatcataatgatggttggaattttaggggatttttcaatttcagaggtctcagcccctaataaatctgttagctcttcattgacaatcttaacaatttgttgcgtaggatctagtgtatcaatgatttcatgtccaacagcacgttcacgaacatgtttaataaaggttttaacaactggaagagcaacgtcagcttctaaaagagctagacgaatctccttggtgacttcttgcacatctttttcagataactttttcttaccacgaatatttttaaaaactccttgcaggcgctctgttaaactttcgaaagccataaattatttctcctcatttaatctctattatcaatgctacttagaatggaaattttttcttgtaaaaaggcatcatcggtatatttttctagaatgtcatcaaaaatctgactacggacaatataatctgaatacatatgtagtttcatttcgtacgcctcaagaattttttcagttcgtttgatattatcatagacagcttgtcggctaacaccggattcttcagctatttcagcaaggctgtagtcatcggcgtagtataactcgatataattcatttgtttatctgttaataatgccgcataaaactcaaaaagggcattcatacgatttgttttttcaatttccatagcttttattataccaaatttcctatcagcttgctatatcaagtatgcaagaccactttaaaatttaaaaggttaggactaacatggcctaaccttttacttttggtagttttatcttaaaaatactgcctctaggtttattatcaattactgtaatattacctcgcagtgagttaacgatttgttgagctaaagaaaggccgaggccaaaccctccttgttgtcgtgttcttgctttgtcaacacggtaaaaacgatcaaaaattctgactttatcctcctctgaaattcctggtccattatcagcgatttctaaaaagagatacttatcagtttcagatatggtaaagtcaatgctaccatcattgtcagtatattttatagcattatcaaataaaatagtcatgagttgttttagcagtgtcttatctgttttgaaactatcttggatcatattatgtccagtaaaatttttaccattctcttgggtgattagatcataattctcaaagatactatcaaaaagtgtaggcttaataacagctaattctggtttgattccatcatcacgtcttgctaagtttaaaagattagtggttaaaatacgcatatttcgtacttcatctagacttgaagcgatattttcactattttctaaaatggtggcattcggttttctgaatagcgtttctaggcgattttgtaagacagctaggggagtacgcagctcgtggctagcattttcgacaaaagccttctgtctttcgtagttttctataatcggtttttgtgcccatttagctaagtagatacttgctccaattgaaataatccaaaaagtagtcatgacaaatataataattttttcatagcgttctttagcatttactaattgatcaatattaacaatagctgtcatgtaagtcacattaggataagcagggttattaacttttacggtgacagcatgatatgtctcatcttgaccaaagatgttggttaaagttaattcactaatgccacctagattttttttattaggttttaaaaactgatagtttgaaaatgcgtcaaaatagttaatgacttcttcttctgatgtaaaaagaataatatcagtattagctactgtctgaccgccgggttttaacttgacacttgcgatattggagttatctaggtaggcagcagtacgtgacataaccatattgatgtaatttttaggatgggtactgatatactttaaactactatcaacagaagaataaacaccatagcgcatgacttggaggatgataacagtcataaccagaaaaataccactaaaaactgtgaaaaaatggataaaatgactatctgagacattttttttgaatttacttatcttaatcggtttcgacatgctttaaaatatatcctacactacgcaaagtttgaaggttttctgaaaaaagtgttccttttaattttttccgaaccttagagacatagacttctacaactgaaatcgttgtatcactatcaaatccccaaatacgatcaaagatttgagatttcggtaagataacattttgattttgaaggaaatagactaaaagatcaaactctttacctaagagctcaacttctgtttgattaacaaaggttgagttagtagacatgtctacgcgaatatcaccataaattaggctgttatcattaaattttccagaacgctttaaaagagcctgaattcgcatttttagttcttctaggtaaaaaggttttgttagataatcatcagcacctaagtcgaaaccttgtcccttatcatcaatgctttctttagcggtcattattaatacaggggttgtaatacctttttcacgtagctctttcaacacttggaagccgtttttttcaggtaacatgagatctagaagaatcagatcatagactccactttcggcttcgtaaagaccctcttctccatcaaaaatttgcatgacatcggcaaagtcatcaaggaaatcaaaaacggaattggaaagactcaagtcatcttcaattaataaaatttttatcatagtatatcctttcgatgtacatattttatctgaactattaatattagaataccaaactttgcttaataaatcctaaataaagtatgttttatgtcaactaatttcatgacacagacaaagaaatagagattgaataatccatcaatctctatttgagtttattagatatattttttgatagtattgataacttcttctttttgcttcgtgattaaaaggacacgagcagaaatttctttaattcccattgaaatattacggctaatcgccatatcgcttaattgaggctcgaaaaagtttttatattgttcaaggcgttcttctgttttgaaactacttgagggataaatcacaaatttatcaaaactcatatcaccacctagagttgctttgatccattcccagttttcttgggcccactcccagacactttcttgtgtaaaagaatttttaaggaaagtagcataccaactcatagctaagtcttgtggtttcacaatatctttatttttccaatctgacaataatttcttgagtgtcttgctatctgtagtatgagataaagcactcgctagttgtcgtttgaaattcccatcggtagtagtactataagtctctaataacaagtggctaagttctttggattcgaaatgcttcatttcattggtaagaactaacaggcgaattgcagctggtatagcagcgatattattttcgtgggctttaaaaatatggtgagcttcttcaatagcatgttcattatctgagtagagagcaaggcttagggatagatgacggaccatttcgctatcatctccttctccttctcttttttcaaagccaagtctattaaaattaaatgctgataatttattaacaaattctttaaagtcgaattcatcttggctatcttcctggacgaataaggataaaccatcaataacactcttaatagcagagttaacaagatatgatgtctcttggctcaaaagagagactaaaggtattaaactactatatgaaatcataccactttcagcaagtaaatgacgttcttgtacaatttgtagtttagaaatgttatccataagaggaagatcagaaatgatatgctctaagagttgaccttgatagttagtaatgtaatgtgcagtattttcagtattgaaacgcagtgcaccattttctttgttcttttcagctaactgactaaaattggggattactaccgtttcctcggttaatatctctgggattccttcccaattactattaagaggaatttgccacaagcgagacttatcttcgtgttcaccaataaagaattgtttttgagttaaaatgagctcatcttcttctattttggctgccatcacagggtatcctggttgctctaaccaagaatccatgaaagctgcaacatcttttcctgaggtttgagaaagtgcattccaaaggtcacgaccaatagtattttgatattgatgtttttcaaaataaatttttagtcctgcggcaaaatctgtatcgcctaaccagcgacgtaacatgtgcatgaggcggctaccttttgcataaacgatagctggatcaaaaagtgtgttaatttcatcaggatgattgacctcaacgtgaacagattggacgccatctgtggcatcacgcttaagagctaatggtagaccacctgtttgaaagtcttcaaatatattaagttttggttcaatataatcaattgatacatattccatcatattagcaaatgattcatttaaccataaatcatcccaccatttcatagtaacgaggttaccaaaccactggtgagctatttcatgtgctacaactaatgctacttgctgacggctggaaacactagagttctcatctactaaaagatagacttcacgatatgttactaatccccaattttccatagctccagcagaaaaatcaggtagagcaacgtggagtgactgaggaataggataacgtacaccaaagtagtcctcataaaactcaataacacgcacaacgatatctaaagaaaaatctaattcatttaactgatgggcttttgtggcatatgagccaacaagagtgccgtttttggtatgtgttgttttaccatgcaattcccccaaggcaaaagctaataaatatgaggacattttaggtgtggtgtcaaatgtccataaacctgtttcttgacgttgttcagcattgatttccggcatatttgaaagagcaatctctccttctttttgatcgaattttaggctcaaatcaaaggttgcttttgcttctggttcgtcaatacttgggaatacttcacgagcaaaatgactttcaaattgtgtggagataacctcttttttgatgccattaactgtatagtaagatggatacatacctgtcatattatcggtaatgtgaccgctgaattcaaagactaataccatgctaccagtttcatgcaattgaatatgcatagcttcattgtcttcatctagttggaaatctaatggttgattatctaataagacagatttaatggttaaccctttttggtgaaaagagatattgttatctaaggcttcgccagacacagcaacgttacctgaaaaggttttagtttgacgattaatatccaagaaaaggttatagttttcagggacaaatttggtaacaaaatgttctacagttttcatataactcctaactaattcagaaacatttgaaacattactagtcctgtatgggctagaaaagatagaaaagctgtaacaagatagttacagcttttctatcgcacgaactatacttacaattaccactctacaagcaataattatatcataactcgataatttttccagtttttaaataaacaatccattcacagatatttttgccataatctccaattcgctccaagtgcatcaatacttggaagtattctttggcggcaaatgctacgtcaggatgcttttgaattgtttcaactaccattttttggatatcacggaagtaatcatcaactatttcatccattgctgctacttcgtaagctttttcatcatcaccattgatataagctgttaaggcttcttcaagcatgtttttaactgcttttcccatattattgatttctaattctactgctgggattctttcctcgcccttcatacggatggttgcttttgcaactgctgctgcatggtctcccatacgctcaacatcactagtagcttttaaaacggtaataacggtgcgtaagtcttgtgatacaggctgctggagtgcaataatttccaatgattttttctctaacttcgtttcaaagttgttaagcgttacatcatcttctatcacttctttagctaactctcgatcatgactgacaaaagcacgaactgtttttttgatttgtccgatagcttcaattcccattgcatagaattggttatgcagtttatctaattcttcatcaaattttgatcttaacatattgtattctctttctgatcttattatatggtattaaccgaatttacctgtaatgtaatcttcagtttctttatgtttaggattcataaacatttcttttgtattgccatattcaattaagttaccgtctaagaagaaacctgtacgatcagaaatacgtgaggcttgctgcatagaacgtgtaacaagtaacatggtatattgatcttttagaccatgtaaagtctcttcaattttaccagcagaaattgggtcaagtgcagaggttggctcatctagaaggataattttaggcttggtagcaagggttctggcaatacaaacacgttgttgttgaccaccagataaaccaagagcagagtcgtgtaatctatctttgacctcgtcccagatagacgcgcccttcaatgaagtctctacggcttcatctaacgtagctttgtcttttattcctttgagtctaagaccataaacaacattttcaaatactgacataggaaatggattaggctgctgaaaaaccatcccaatttctttacgaagttctacggtatcagtgcgcgggctataaacattatgtccgttatacatcactgctcctgttagagtgacttcaggatttaagtctcccatacggttaatagctcgtaagagtgttgactttccagaaccagacggaccaattaaggctgtaatttcattaggatagaagtccattgagacttcttttaaagcttttttcttattatagtaaacagacaaatcactgacttgtaaaataggttgtgtcatcttttacctcactatccaaatcgaccagaaacataatcgctagtagattgacatttagcattttggaaaatgttattcgttttatcgtattcgattaagtctccaagatagaaaaatgcagtataatcactagcacgtgctgcttgttgcatattatgtgttacgataattatagtgtaatttttcttgagttcaaacattgtctcttctagttgcatagttgcaatcggatcgagtgctgaagcaggttcatccattaagagaatttctggtttaactgcgatagcacgtgcaatacataatcgctgctgttgaccgccagataaagtgaatgctgatttatgaaggtcatcttttacttgatcccatagagcagcttgttttagtgaggtttcgacaacttcatctaagaattttttatcttttacaccagcacgctcatatgcaaaggtaatgtttttataaattgattttgcaaacgggtttggacgttggaaaaccattccgatatgttttcgcatctcgtaaacattgatatcttgagcgttaacatcaattccttcatacatgatttgtccagtcacgcgtgcaatatcaatcgtatcattcatacgatttaagctacgaagatatgttgattttccacatccagatgggccgattaaggctgtaattttatttttttcaaattgcatatcaattcccttgatagcttctttctcaccgtagtaaacgtgtaaatcttttgtggtgagagctgaattttcttcagggaaggtaatgatatggcgttcgtcccaattatattctgccattactactccttttaattagacgaggttaatttcgaatgaagtttcttaccgatcgagcgagctgaaaggttgaaaataagaataacaaccaataagactgcggcgctaccggcagatacttgtgttgcatcagggattgtcccttcgctattaactttccaaatatgaacagctaaagtttctgcttgacggaaaattgagattggacttgtaacactaaggacgttccaatttgaccaatcaagtgctggagcagattgaccagctgtataaataagtgctgctgcctcaccgaaaatacgtcctgaagctagcacaacaccagttacaatacttggcagagcttcagggacaacgacgtaaatgaccgtttcccaacgagaaatacctagggccaatcctgcttcacgctgtgtgtggtgtacattttgaaggctatcttcaacactacgtgtcatttggggtaagttaaaaacagtaagtgctaaggcacctgagataattgagaagccatattgaaattgaacaacgaagattaggtaaccaaacagaccaactacaacagaaggaagagatgacaaaatttcgatacatgttctaacaaagtttgttaaacgtccttttttagcatattctgagaggtatattccagctcctaaagatagaggaatagaaataatcagagtaacaataagtaggaaaaaggaattgtataattgtattccaataccgcctcctgcttcatatgatgatgatttcccagttaaaaatgaccaagatacgtgtggcaatccgcgaacaagaataaaaattaaaagagaggcgaggattgtaacgatgatagctgcaatactatagagtattgtagttgctaatttgtcagcctttttagcgttcatagtttttctttccttcccttgtaattaacttaataactgtattaaatgctaaactcataattaaaagtactaaggctagcgaccagaggacattgttttgtacagttcccattacagtattaccaatacccattgttagaacagacgttaatgttgctgctggtgttgtcaatgacgttggtaaaattgcagagtttccgacaaccatctgaattgctagagcttcaccaaatgcacgtgccataccaaaaacaattgcagtgaaaattcctggacgtgcagcgtttaatataacacgccaaattgtttgccaacgagttgcccccatggctaaacttgcttctttatagtgacgtggcacagctctaaggctatctactgtcatgaaagtaacagttggtagaatcatgacgaagaggacacagaccccagataaaatgccaaaacctgttcccccaaaaatagagcgaacgaagggaacaataatctgtaaaccaataaaaccgtaaacaacagaaggaatcccaactagtaattcaactgcaggttgtaaaattttagaaccatatttaggtgagatttcagtcataaatacggcagcaccgatagcaaatggtgtagcaatgatagctgatagaatagtaacaataaatgatccagctatcattggaaaagcaccaaatgacttagcacttggttcccattttgtattaaataagaagtctgttaatttaacgccatcaacaaaaaatgtagatagtcctttttgagcaacaaaaatcaaaatcatcgcaacaatgaagacgattagggcaagcgaaagaaaagttattcctttaccaaatttttctaatcgagagttttttgaaggagatgttaattttttagctaattcttgatttttcataattcctcctaggatcaagatgctttatctagatgtgattaagttttattttggggttactttaccttcagcatctttaacaactttcatgtcgttaatagagatatatcccatatgttgtacgatactactttgaactttatcacttttcatgtagtctaagaattcttttgttagacctgtttcattaccttttgtatacatatgttcatatgaccaaagtttccagttgtcggtagtaacatttttagctgttggcgcaaaaccatttagttttaatgttccgacagatttatcaacgtatgcaaaagcgaggtatgaaatcgcaccaggtgtttgagaaacaattgatttcaccataccatttgaatcttgttcttggctttgaataggagcaacatttcccataatagtattatcgaaggttgcacgggatccagaacttgctgctcgattgatgatggaaatatctaaatcttgtcctcccacttctttccaattcttgatttttcctgcaaaaatatcacgaagttggtgggtggttagatttttaacattaacttttttattaacaataacagctaatccagctactgcgacttgatggtctttcaatttcttagcatcaataccatctttttcttctgcaaataagtcgctattaccaatttgaacagctccagactgtacttgtgataagcctgttcctgagcctcctccttggacattgatagtcttaccgaggtttgtcttaccaaactcatctgctgcagcttctacaagtggctgtaaggcggttgaaccaacgctggtgattgattgacctttatcaatccaattagcacaaccagacagcgtcaataagacggtggctagcaaggttaacaaaaaaatgttttttttcattttcattttcctattcttttgaataaattttgatatttagtagttgatatatattactaaaatcattgagtgtttaatgatttacaaatagtaaaaacacacatcactgtcccatagtaccataagtttctagggtttgaaaagtatttctttttccttttttattaaaagtattcaataacagttatgtctgaaatcgtagtcctttagggtaataatttttaagagtattatttgtcacttttgcaaaacctaatccattgccttttacaagaatttgataccaaccgtttggaacagtcttgtctagtttgactacatttccagatacgtacacctcaaactgttctatatcaatttcaatagactgtactaggtcatgttcgctaagtgccattcctaaagcaaacgatggctcaaaacgattcttcttgaaagtgcctagatggagaccattgcgtgctatttttaatttagacaaatcggggagaccattaggtagaagatagagttggtcgccgaaaacatctaaaacaccgttcaagtctatctttaaatggtcttgtgcaaattgttgccacaattgtaactgcattttatttattttctgtgcttttggcttaattttctgtgcttccttagatctagtatctctcagttttgcaacgaattgtccttcaccttgaaaatgatgagggtacatccttgcaacttgtggtacattaatcccttcaaccatcccatttagtttaggaatatcaacaagttctaagtaatcatactcttgaaggagccaattaaccacttcttcgttctcttctggtgaccatgtacaagtagagtatacaagtataccaccatgagctagcattttgattgcttcttttaaaatatctctttgtaactgtgcacattcagtggggtaatctttgtgccaatattgtattgcttgaggatctttgcggaacattccctcaccagaacacggaccgtcaaaaacaataagatcaaaaaaagaattaaaacatttggctagtcgttgggagctttcattagtcacgataacatttctagcaccaaaacgttcgacattttcgactaaaattttactacgtttatttgaaatttcattactaactaatagaccagtattgtttaaatatgatagaaggtgtgttgtttttccaccaggtgcagctgctaaatctagcactttcattccttcttgtggttcagcaatctgagccactatctgagcagcaggttcttgagaataaacaaggccagttgtgtgttctattgattttcctgatattttcccataatgcccccaaggggtacttgggatggcatttggaaaatcaagttgcttttctttgagaggattggtgcgatatgccgatatgggtttttgttcaaaactgtcaaaaaaagcttctgcttcatctttaagtatagtctgatatttttcaataaattcattcggtaatttcatgtttctattatactacataatcacgggcgtgcaaaaaaaccttctatttaattagaaggttttaagtttattttttggtaaggtaggattggataagatttaatttcgactttggtaggaacattactttttgtcttgttgaatagttgggttcttccccgtcaagcgttaataaggtaaatcctaatgtctcccccatgatttttgctgcagcataatcccaaggttgaatatacgaaaaataagctaataatttgccctgcatgacttttgccatgctaattccagcaccaccatagatacgaacacctaaggtttcagaagctaaatgggcaataccgcaatcattttctgcatacatagcagaatttactccaagtaagcaacgttctaaaggacactcttgaaaaggaacaatttttttatcgttagcatagacatcaaaatgtcctcccccgctgtaaagaatatcagccataacgtcgtagatgataccaaattgtccaacgccttcttcgtaataagctaacataacagcaaagttatctttttgaacaataaaattaacagttccatcaatagggtctaaaacccaaacattaccttgtgcaatgggtgagcgcacatcatcttcttcggcaagtatattatcatctgggtaatgttgaataatttcttgaattaataatttttgtgtttttttatcaagacttgtcactaaatcatcaaatcgagacttttcctcaacatcaaaagtattttgcatctcagatttaatgaattgaccagctttatacactaattgtttagcgaaatcaaatttagcgtccaagtgaaataaatcctttcgcttgttgttgtgctgctttaacagcttgataagtggaataaccgctagttctctggaattcacggtcaatttgtttttcctgcgccttggatttaacaacttttttaaattctttatagctatctagcaaatcatcaactttaatactattttcataggcgtgttcaacttgatttaaaaagcgaagtaccttagtaatatcttccgtattccatgaaggatcaagaggataactataattactactaatcatgttttccctcaatttcagcacgaatagtggcctgtttcagttcttgtttacgatagtcacgcggtaagaaggcacgaatttcatcctcattaaaaccaatctgcatacgttttttgtctaaaataattgggcgtcgtaaaagacttggattttctgaaattaattccattaatgaagacgttgataattcgtctacatcaatagcaagtttttgaaagacttttgaacgtgtggaaataatgtcttctgtaccattttctgtaaacgatagaatttgtaatagttcttctttattgagtggacttgtaataatgttatgctcttcaaaagcaacctcatgcttacttagccaagcacgcgcttttcgacaactagtacagctgggtgataaaaataaggtaatcatataaccgcctcttgtatttactagagactattatacaaaaaattaaagagtttgactatcttttttccaatttaaagcaatttctttatcttttttaagttgttttacaagatcgtcaataccattaaactttaccatttctctgattctttttaaccagaaaatttcaatagtttctccataaatgtcgccatcaaaatcaaagatattagcttctaaacgaagttctgtaccaccaaaagtgatattttttccaatgctcgtcattgctctataatattttccattaatcagaacattggaaatataaacaccgtctgcaggtaagtaagtgcgattaataggagctagattagcagttgggaaccctatagttcgtcctctagcatctccatgtactaccatgccacaggttgaaaactcataacccaaaagttggttagctttctcaacattaccctctgtaatcaattgacgaatacgtgtagaagagattttttcaccaccttcagaaatttcatcaataatatagactggtcccttgaaattacgcgctagataatcaccactggtacgattatgaccgaacttataatcaaaaccgacaacagcagcttttgctctgagaccataaatatatttcttaataaaaaggtcagaagatacttttgaaaaatgactggtaaaattcattaaatataactcatcgacgccatactcttgaaatttttcagaacgtttttctggagaggtaagatgtagcaataattcaggttggaagcgagcgaaggttagacgaggtgtctcattaaacgttaagacgacaattttcaaatttttttcggtcgcgatttttttagctttatcaaagagggctttatgtcccagatgtaagccatcaaaatagcccaaaactaagacgcaatcttctttagcttgaatatctttataatcattaatgtaatggattttcatgattgactttctttataacaatactttgtgtggtttaaattcattgccacgtttttctagtatagcgataactctattttcataaaaagctgctaaggtatctgcttcattttctaataagatacgacgtccgtatgagatttcaactttatcttcctcagttaggttaacttttgggagatctaaaacaccatattcaattggaagtaaaaatgaaaaatcttcttgcttatatttttcattaatttcttcaagcgttaatgattgtgtaatagataatcctgcagatgaggttctttttaggaaagacatatggctagcatatcctagttttattcctagatcaacagctaacgtcctaacataggtacctttactgcatgagacatagaaactaaaacggcagatgcctttttcgaagtacaatgggcttgtgcgtctaaattcagaaattgttatttgtcgtttaggtcgctctacttcttctcctgaacgagcatattcatagagttttttaccatttactttaactgctgaatacataggaggaacttgtgtaattggaccggtaaaacttttcatcgcatgatccacaacatcctcgctaagatcggattgagttagtggagttcttgaaatgacctctccactagaatcttctgtacttgtggcatatcctaaagtgatttctccttcataaattttgccactttctgtcatatattcaataacacgagtggcttttccaaccgcaattggtaaaaccccaacaacatctggatcaagagttccgccgtgtcctattttttttgtatgtaatatctttcgaagcttgaatacagcatcgtgtgatgtcattccagcttctttctttaaattaattattcctgtaatcatgttttatattatatcagtaaataagcggtaacacaaagaaaggagcgtaaaaacttacgctcttttggtatagtgctataaggatttatacctaatctaaatagtatgaaaagcctgtactaaccttcttgaaccctaggttttcataaaaatgataagcttcctgacgatattcttttaaactgctatttaaagccagtacttcacttccatctgttttagctagctgtttaacgtgattaataagttgactagcgatgcctttacgacggtgcttttcattaactactagtgctaaaatacgatagtaagtcccacttttttcaaaaaagtaaagtttatgatatccaacgaaggcgaggagtttgccattatcctcagctatcaaaaagccataatctgaatgagtaagaataacctttaaaatagattgaatctctgataatgatattgcgtatcctaattcttgatacaaagggactaatttttcactatcgtctagtgtagcagttctaatcttcataatcataacctcttagtcttttagagcatcgaattttgctttcattgttggattttttcttgttaatttcttgacagaaacatcgtctaatttattatttgcaagacgtagttgattttcagacgttgttaaagcagccttaacagcttccatacgtttaatagatttatctatttcatcgattgctttctggaaatttttgcttgcagaattataatttttagcaaatgcatttttgaaaatatctaaatcttcttcaaaatgtgtgatgtcaatattttgttctttcatcaaagcaagctcttgtttatattttaaggtattgagtgctgcatttcttagaataccaattaattggataaaaaattgtggacgtataacgtacattttagggtatttgtgactaacatcaacaattccagtattataatagtcattgtctgcttcaagcatagttactaaaactgcgtattcgcaagatttttcacgacgatctttatctaattctttgaaaaaatcttcatttttatgcttcttgatagtatcatcagactcatttttcatttcaaacatgatacttaaaaactcaaggtcattttcatccttttctcgatagataaagtccccctttgagccacgacttgataatgtattgtccttctcaaaataagcattaggaaaggccaaatgtcgcactttattaaattctgtttcagcataatgttctaaactttctcctactgctttagtagactgttgagctttgaagtttttatagaattctacttgttcattggctgcctttagttgtacttcataatcactttttactgaagctaaagctaaatctttttctttttcttgaatgtgcaactgattttgtattgcatctctttctcgttcgacttttgttagcgcctcttgcaagctattttcatgctctaaacgtagtctatcgatttggttttcaaggtcgcgaagcatcatgtctttttgatttaattgctcagcgagttggtactcattgtctttgagaagattgtctttttctataagaaattgtttgactttgtactgaagtttagctatctccttgtctttttctacaacaacttcctgtaattgattttttgcttgctcccctaatattagacgttctttttccaaccgttcacttacttctttgtcaaaagcatctccgcgaatttgttctagtaattgatggtattcagactcgttgatggcaaaagctgttccacaatgagggcatttgatttcgttcatgataactcttcctatgatgttttgtatttggttctagctaagttgttgtctgatgtcattttggatacgttcccactcctgctctgcacgtgctatcttacgtttgtaatcgttgagcccctgtttataacgttggataagataatcctgtctaaaaagcgggatacttggtattgcaatatttaacagttcctttgtgctaatattcatcacagcttttcctttgttagcattctcaagtgcctgttgaccttcttctgaatcaaaaaaaagctttaagtagtaccctctaatgtgttgtgtaggccttagtattgtaatattagcagaggcaacgacagggtaatcttgctcttcaaaaatagcaactttcttgacagttccttttgaagcgattaaaacatcgccttcctgaagtagatattttaaaagcgatcgttgttcatcttggaatgttcttaagttatggtagtcaattcctaaaggagacatatcactcaaattaataatacggatatcacctgcttctgcttttgaaggcacagctttacctttaaagcagtctaccaattcagataataaataagtttttttctctgggttacttgttggattttgtggcacaatagactcctttcgtctttaaaatattatatcacaaaacatagttttttaatactaaaataaaaaataagctttcagtaagagaagcttatttagattaaatctattagtcgtaaggaaaattcgatttttgataaagccaataacatgctacgataagaacaatactggtaatcatgcttccttccacaccaaattttccaccgctaatccagtcagcaccataggttttaacatggactagggagttagacaacattggctctccactaacttcgattccaaagacactcccttgtacacagttccaggcgccatgaataccacacgccccccagatgttaccttttaaaataacatagagcgatagaaatagtccaaagagacacagattgaaaatcgagataaggcttacatgattattagcgctatgcagaagaccgaaaaagattgaactgatactgacagaaactatcttactatactttgtggcactcaccggaagtaaccatccacgacacaatatttcaacagatgcgctttgtacctgccatccaacagcaaaaataagaaaccaaatcaatttatcagctgtaaaacgaacagtttcgataactccagagcctgaaattattgttaatattaagcaggctccaaagagaacgctcccgactaaccatcctctagataattctgttagggctccttctttaaatagccctagagaactaattggacgcttctctttaaatttcacccacataaataacattaccgtactaattgaagttgctagtaaaatgattaactggacgatatcgctatcccactctagtttccaaaaatcaagcgagataatcaattcaataataatataggtaaggaaatctgctgtaaatagtaatatcaaagccaataatatagttaaaaggacatgccttgatactttaccttttgcagtttcctcaaaaatagactctctcataaatatctcacttttatctaactttatactgttatattatacaattaagattacttgctgtcaatcgttatcgaaaagattagaaaagataatctttattataaactaatctactgatttcaaggcatctaacatattgagtttttttaattgatggttaactataaaacctagacttattagaatgatgactactacgcttattggtattataaatgtagttggtgatactttttcaccaaaaagtatttgatctgaaccaattagcaacatcatttgacggtgtaaataagtaccgctaatggtgcctagaatcacaccgatggttgataaaataatggtttcgcggtaaatgtataaagttacttcttcattataaaaacctaatacctttatagttgatagctcccgcttacgttctgctaaattaatattagtgagattatagagaattacaatggctaacaataaagatacgacaactaaaatagtcatagagccatctaaagaacgcacaacggcttctacactagccagctgaagagcattttgcgtaagagactcaactccattaatttctaaaagtttttctgctaagttatttgcgattttatgtttggttaacttaaccaaaaaagcgttatctttagcttctttcttaaaaatagttcgatagtattgttttgtcataaaaatatagtgaccaacattcgcattgacaactcctgttatttttaattttctagaaggaagtgtttgtgaatgagataaatggataaaatcaccggtattaacatgataaaattgagctaattttttagaaataataatccctttattattcaagtgcaatgacttattagttgttgcttcttgtaaataaataaaaggtagtaattgttttttgtctgttatgaatagggaaattgactgtttattaatttgtccaggaatggattcgtcaagattttcaaggtgtattggttggtatttgtctatttttgaatcttttgaaagtagttcaagtatttttgggggagaagcatttgtgttatatgttagcaatatatcatagggcataatacgaccgaaatgttcattgacggtttgctttaaggaggattgtattcctagacctgaaaataagagcgctactgatccagcaactccaaatatggtcataatcatcctttgtttgtaacgaaaaatatttctagcagttactttttgtgtgaaggacagttttttccaaatccaattgatatactctaaagctattttagatcctttagctggtggttttggtaataataaaaatgctgctttttctttcaactcacgtcgagtgataacaaaaactggaagaacaatgcttaataatgaaaaaacaaaggctagtaaactgtaatttaagaaaagatgatactgtgtgtttggaatagtcaggtctttggaaatgatatcagaaataatacgaggtaaaagataatgccctccaatgatacccaaagtagtccctaatgttcctgctataaaaccataaataataaatttaaagataacttggcggtcactatagcctagtgcttttaatatgcctgcgttggttctttcttcctcgacgaacctagtcattgttgttaaggttactaatgctgcgactaaatataaaataatggggaaaagattactgattttagaagtgctatttgtactggagtcaaaagtgttatatccttgtcctccaggaaaggtagtacggttgtagacaataatttgaggcgattccattatttgggtgttatgtctcaattttagaagctcttttgttcgtttcaaaagagatagtcggtcttgtttaattttcatttgaatagcttgtctttgagatagtggcatcgctaggctatcattatctaaccgattgatttgtttttgagcttttagtaggcttttttcctcctcatcgattttacgtaggctctctttttttgttttggtatatcttattttattgtgaatatttaattttcgcgataccttttcttggtatttcgctactttttctttgtaacttattgagaaagggttaatcaacctaagatctttaaaagttacccttgccattgtatatactggagagtgaaatgctgtcttatctaatacgccataactatctaagtcgccgtcccctgtttgagaactaccaaggtttgtcttagaccaaatctcggtagaattaacaaaacctacaatagttagaggacctgtatttgaaaacagtttgtttttatcttgtttaaaattaattttatcacctattgcatatttttttcgttcctgaaatgagagagcaatttctgatttatttaaagggagacgtcccttaacaagatcaaaggttgatatcgttttggtattggaatacaatcgataagatttactattctgttgaggggttgtatctacaaagtaagaaaattcaacttgtgatccttttaagctttctaaaacagtttgatcatgtttgtcaagtccccaagaattgaaaacggtaatatccataacatgatgatgagcaaggtaattttgtgctgttctttgcatattaggtgctgagaccttcagtcctataaaagcaaatgagcctaacatcataagtaagaggattgatgaaaatctaccttttgaagtcgtaattgatcgatagatatctttccaaaatgtctttcccatctgtataacctctaatattctatgttctgaatatcacttggattctcgtttattacaatatcactgatttttgaatcatgcatatggatcacgcgatttgcaattggcgctaaggcagtattatgagtaacaatgatcacagttgtttcttttgattgcgccatcttttgcaggatggctagtacttgttttccagtttggtaatctaaagcaccagtaggttcatcacaaagtaacagtttaggttttttggcaatagctcgtgctattgcaacgcgttgctgttcgccaccggaaagctgtgctggaaaatgattgatacggtgtcccaaacctacgttttctaatgcctgttgggcatctaatgcctttggaacaatttctgaagccaattctacattctctagtgctgttagattagggactaagttatagaattgaaaaacaaacccgacatcatatctacggtaacgagtcaattccctgatggtataattagcaatattcttaccatcaattaaaacttcaccttcactattactatccatccctcctagtatattgagaacagtagatttgccagcgccggatgcaccaagaataaccaccaactcacctctttcaatactgaaactaatatcattgttagcaacaatttcggtttcacctgtttgataacgcttataggaatgcttcatttcaatataggacataacggcacctcacactatgaatacacctatattatagcacttttttattaattctcccataaaaataaatacataaattaagttatgtaaaataataatttttttaaaaatctgagctaaacactcagattccactttatttaattttctcttcttggtagtcgcatttttcatttgagcaaacaacttgtttaccaccaccgcgtacttttttctccactaagaaatcatttgatttggggcaagttcgtccaataggtttgtcccaagatgtaaactcacattctgggtagcggtcacagccataaaagatacgattgcgttttgtttttcgctcaataacttgtcctttttgacagataggacaaataacacctatttccttagtgatagcttttgtgttatgacattcagggaaattgctacacgcataaaactttccataacgtcctagttttattaccattggtgatccacatagctcgcaatcaaatccagcaggttcatcctttatttgaattttctccatttcagtttctgcttttgcaagttctttttcaaatggtttataaaattcatcgataatcttttgccactgctctttaccaatctcaacttcgtctagtttcccttccatttcggcagtgaaggtaacatcaacaatatctgggaaaaattctacaataaggctattaacaatttcaccaagttcagttggttcgaagcgtttagctgcaagcttaacataataacgtttttgaatagtctcaagcgttggggcataagttgaaggacgacctacaccgttttcttcaagtgttttaatgagacttgcttctgaaaaccttgcaggaggttgagtgaagtgttgttcaggattcgtattaacctttttaacactttctccttcctccatatctggtaacattttatttttgtcagtatcgttataaacagccatgtaaccatcaaacttgacttggctaccattagcaataaaagtaacaccattttgcgttaaattaactttcattgtgtcaaagactgctgctgtcatttggcttgcaataaaacggttccagataagagtgtaaagttttagttgatctttgtctaaatacttagcaatactttcgggtgtatgattaacactagatgggcgaatagcttcgtgagcgtcttgtgctccagaagcatttttaactttattcccatgtttagaataatttgcaccaaaacggttagtaataaattctgttgcttcattttgtgctaacggactaatacgtgtagaatcagtacgcatataggtaatcagaccttgatgacctgctgtgcctaagctaagtccttcgtacagctgttgcgcaatcatcatggttttacgagttcgaaaattgattttattagctgcatcttgttgcaatgaagaagttgtatacggtaatggtgcattacgacgacgctcttttttttcaactttttcaactaagaattcatcagttttaatacgttttagaactgttttgacgtcttcattattcgataatttgaatttctttccgtctaaaccgtagaaagtggcattgaatttacgtgttccttttttaaaggaaccgtcaatagtccaatactcctccggttggaaagccttaatctcattttcacgatcaatgattagtttaagagcaactgattgtacacgtccagctgataggcctttttttacttttttccataaaataggtgagatagaataaccaacaatgcgatctaaaacacgtcgtgcttgctgagcatcaacgagatccatgttaatctgacgaggttccacaaaagcatttttaacagcatcttttgtgatttcattgaaaacaacacggtttctgtcttctttgtctaaatctaaaatatgcgctaaatgccaggaaatagcttctccttcacggtccgggtcactcgcgaggtaaacttttttagcctttttagcttctttttttaaatcattaatgagaggtcctttaccacgaatattaatatattgtggttcgtaattattctcaaaatcaatggacatacttgacttttttaaatcacggatatgacctactgaggctacaactttatagttacgtcctaagtatttttcgatagtctttgcttttgcaggagactccacaataactagattttttttagcagtagctgatttttttttacttgtttttttggtcgacgtttttgtcgtagttgccataggtatcactttctatatcgtaaacttatagcataataactcacttttcttaaactgtcaatagaaaacttctcctatagtagaaagcaaaacactactgatattcagaaaggatatcttttcctgaaataatgcatttagctccttcttggataagatggtggcatccatctgatttgccatcgataatatttccgggaatggcaaaaacttctcgtccctcttctaatgctctttcacaggtaattaaacttccagatctcatcttagcttcggcaaccacaataccttgacacagccctgcaataatacggttacgttcggggaaatgaaatttcaagggttgttctccggtaaaatattctgataatacgagatgattatatgacatatattcttgaagtttcttattctccgttggataataaacatctaaaccactcccgataacagctatactactgccgccattttttaaagcactaacatgtgctgctgtatcaatgccacgcgctaaaccacttacgataacaaattgattgttagtctccttgataatctttttaacagactgacaacctatctgagatgcctgtcttgcccccactacagctaatttaggtttagatagaagttcaatattaccctgataaaaaagtagaactggtggattatatatttcttttaactctaaaggatagttagaatccaaaatcgatagaactggaaattttttgaattcttgtcgaagttttttaaggtctagctgtttataattttctataaagaaagtaggatttttacattttgatactacggccatattgcgaacagatagagaagttaaactattctttttgagatagttgataatattgtggatattaagatttgttaatccagcttttttaagcttaaatagttcaaaatgattcataaggttacctccattgactatattcgaaaataatagacaaaataaagtgataagatcaatctatactctgaagcattgataatagctattttttcaaaaaaataagactaggatttttcctagcctttgacaaaaaattaacgattatcaacaaagttctgtacatctttaatcatacggagtgttactcggcttccgcctgaattgatataccaatcttttccatctacctcatgaacacgtttgtttttgacagcatcagttgctttaataacatcgttattaaaaagttcttttgatgaagctccttgtccaatagtcgctccacgatctaaaacaaagagatagttaggatttttttcagcgatgtattcataagatacgggagtaccatgtgaacttagtttttcattttcattgactgctttaaatccacctacagagaaaatccaaccaaaacgaccagaaggtgattgagttaaaagttcaccgctgtttgccattacaaatagagctgtaggtttaccttttttctcaatagttttctgcaatttaagaacagcttgtgcgatatctttattaaaggtttttgcctttttattttggtcgaagattttccctaacattgtgacacgctcagcaactcctttgtcaaatactttttttgagtcgactccagcatatactaatgctgctttaggtgcagcctcctttaatttttcaatattatcaacagaagccatacgtgctcctaggaaaaccacatcaggttgcatacgagcaatagcttcaaagtttggttcgaagagacttcctacgtcttggtatctcttagctttataaacagatttgacgttattgggcaataaacttagagcatttttagccttcgggataccaataacagatttttcagctcctaaagctgtgatagtatccaaagctcccatatcaaaaacaactacttttttgggttttaaaggaactttaagtgtctcgctgatttgctttttattatccggcttgtctcttttttcttttttaatatagaccgaatagttgttttttatggtaacagtttgtgatttttctttagctaaaacagcttgagaagtggttaagatagtgcatagtgctaatatagcaataataagtttttttgtcattaaataaaatctcctaaaatagataaaaactaaaaatgttatcctacataaatctctttatttacgttgtacaaaaaaggataattggtttaccatcaacagtttcgatacggataggcatatcaaataaatgagaaaggattttttcttgcataacatcttcgacagtcccacaagtcaccacttgtccttcttttaaagcgacaacattgtcagcgtagtgagttgcaaaattgatgtcgtgaataataatcactatagttttattaaactcatacgcatatcgtttgataagatccatcatttgaacagcatatttcatatctaaattgttgagtggctcatctaagcaaatatattgagtatcttgtgccattgtcattgcgataaaagctctttgaatttgacctccgctgaggttattaatgaactcgtcagctatatcgtttaaatccatataagatataactgattctatgacagctttatctttttgacttaaccgtcctttactataaggaaatctaccgaatcctatcaagtctctcacctttatcttgagtgttaagtgattagattgtcttaatatggctaatgttttggctaagtcatttgaactgtagtgggctaatggtactttatcaaggaaaatttcaccattatcataaggttcaagtcgactgatacaactcagcaatgtactctttccagatccatttggacctaaaatagctgttacttttcctttaggaatcgaaatattaatgtcttttaatatttccttttggccatagaacttatgtaaattgtttatttgaatcataagtttttccttcctttgattaaggtgaatataaaataacttcccccgataaggttgaggagaacacttagttgaacagtgaggtgtaatagattttgaacgagatgctgccctaagacaagtgtaaagatacagataacaatggctataggaactaatatttgatgtctaaaggtatgaaaactgtgataggtaatatgtgctacaagtaagcctaaaaaagtaatcggcccaactaatgctgttgctatagctaccatcaatgctaaccataaaaaaaatctagtagtaagcttttgatatgagatgccgagtgatatcgcattttctttacccaatagtaagacatccaattcctttataaaaggccaattaatgacaaagctaacgacaatgataatgaaagaaatccaaaggatcttggtgttaatagcattgaaactagcaaagagctgattttgtaaaatcataaaatcgttggggtccataatggcttgaataaaggatgagatagaagaaaataatgtattaaatatgagtccagctaatagaacaaaatacaaagactgttttttatttcgaaaaagtatcgtaaataataagtaagcaaatccaaccattaataataatgaaaggaggaagctactaaaagatgaaaattttatgacacgctgagctccgattaaatacattaatcctgtttggataaggatatataagctatctaaaccaataatggacggagttaaaagtcggttattggttagagtttgaaaaataagactagaactaccaatgcagataccaaccaaaattaatgcaatcagtttttgataacgtgtttttaggatatagataatcaaaaattcatttgcgtcagttggaataccataaattaaaaacaaaataatagcagcaattagtagtatcagtaaaataagtaattttggtatctctaaatccttaatcatgattttccctcatttcttataattgaaatcaggaaaaaggcactacctaatactcctagcgtaactcctattgagacttcataaggaaaaataactaagcgaccaaaaagatcacatatcatgacgatacaagcccctaaaagcgatgtctctaagatagttgaggacatatgatctcctttagttatgctaattagattaggtacgattaaacctaagaaaggtaaagctcctacgataataatgactagggatgtcataattgaaaccaaaactaaaccaaagtaaatcatcttttcataagcaacccctaaattcttagcgaagctttctccaagcccaacaatggtaaactgatgagcaaaaaaatatactaaaaacaaacatggcaatgctaagtaaagaatttcgtagcgatggctagtcatgatggaaaaattaccttgaagccaactgttgacagattgtagtacttgaaaatgtgttcctaaaaatactgttgctgctgctacaatttgtccaagcatcagtccgataagaggtataaaaatattatccttaaaagtaatcatttttaaaatggttacaaaaagaagcgatcctaaaatggcaaaacctgaagctatacatagttgaataaaaatagaggtatttttaaagaaaatcagcgtaacaactactcctaatttcgcccaatccatagtccctgaagttgtcggtgaaacgaacttgttttgggttagttgttgcatcagcaggccacagactgacaaacttgcaccagatattaggatactaatggttcttggtaagcgactcgttaaaaaaatatctacctgtgattgatcaaggtgtgttatttgctccagtgggatagatttcacaccaacaaatagggacgttagagaaagtataaccaaagtacaacccattacaggagtggttaatagctttttcataaaactccttaaaatgaaagataaagtgttcaaaaatgagcacaaaactataataacataattttttggaaaaatatctactttttaaagaattttatacttaagaaaacattattatatcaaggtttttctatttaaaatcattataaataagatagattaaattagcagaatatttactttacctatttttgaaattagaaaaaaaccttcgttataattaaaggtttttctaattttaagctaattttttgattatcttagcagggtttcctgctataacaacgttattttcaaatgatttcgtaacgacacttccagcgccaacgacgacattatctcctaatacaacacctggtaaaatagtcactcctccacctagccagacattattcccgatttggattggggcaccgtattctaatcctgaatttctttctattggatctagaggatggagtggggtgaggagttgacagtttgggccaaacatacagttatcgccaatacgaatttcacaaacatctaagaaagtttggttaaaattggcgtagaagttttcaccaacataaatattacaaccataatcgcagacaaaacgttgttccatatggatactcttcccagtagcaccaaaccatttttgtaaaatgacgttacgtttgctactattatcttcattgttaaaggcttgcatattttttagtgcaacttctctatccttgcgtagttcaggtgctgatggacgataatattgtcctgctaacattttttctttttcggtcatcttttcctcttccgtattatttacaacattgattttataggttcaaaacttttacgatgtatcggagtaataccgtatttttgcaaaccttctaaatgctctttagtaccatagccagcatttttagaaaatgcatatccaggatatgtgctatcataatcagacattattttatctctggtcactttagctacgattgaagctgctgcaatagagagtgaattagcatcacctttgataattttagtttgtggaattgatagatctaaaaccatagcatcaattaaaagatgttcaggagccacagataaatgagaaactgcatcaatcatagcatgttttgtagcttcataaatgttgatatcatcaatacattggctgtcttgaataccaataccaactgctaacgcttgatctaaaatattttgatagatttcttgatgctttttctttggaatttttttggagtcattgagatgttttattttacagtttggtggaagaataacagcagcagctactactggtcccgctaaaggacctctacctacttcatcgattcctgcaataaggtttatatgttcaatgtaaagttttttttcgtagaccaacatttgttctaagcgcgcttcttcgtctaaatctgactgaatatttttttttcgttgaaggattgctttttgaacacctgcgcgtgaatctgtttgatattcttgccaacgtttgtcttttaaatcaacaatagtctctaaaattgctttgatttctttaattgttgccatcatgttctccgacgatatctaacgtatagcgtcctaatttaccatcgcgaacttctttgacaaataaattataaaagcgatcgtaatcgtcacgataacctaatttttgtgttaaggccatgatgatttcaggagcttcatcctctaaattaatgcttttaaaacgctctttgagacgatcaggataataggttttaaagtaattcaatccaaatattgttacctcatccataggcaataattgatctttgattgcccctgttaatgctagctttaatccaactaattcatcttcaaatttgggccacaagataccaggagtgtccaaaatttccagttccttattagatttgagccattgctgaccttttgtgacacctggtttattaccaaccactgcaatttttttacctgctaggcgattcattagagtcgatttacctgcattcggaattccaataatcatcgtacgaagtgtctctttttgaataccacgtccccgtagattagcaattttatcggacattaatattttagcgatgtcggttacttttttaactgttgattgttctttagaattaatagctaatgtctttaaaccttgagattcataaaaatctctccattctttagttcgaataggatctgctagatcagctttattgaggatcattagtttgggtttgtctccgacgattttggttagcattggattttgactagaaagaggtaaccttgcatccactaaaattgtaacaaaatcaacatgcttaatattttcttgaacttgacggcgagctttggacatgtgtcctgggaaccattgaatagtagccatgaaataaattctccttatgtatagactaccttaaaagtctacatctatttgttagaggtctaattttttagttttattctttttcaaccgcatataaaggtcgataaaatattcgattaacactattattctatcatttttttaatgatatcgaaatactttatacatttattccgctgataggtttcgtttactaattgagtttaagggatatacgaaaaagctctggaagtttactccgagcttttaataacatgatttttaccacattaagactatttgatggtaacagtcgttccttgaggaatattttcatagaaccattttgcatccgcccttgacatacgcacacagccatgtgaggcggcttttcctaattgctttgcttcttctggaatctcatttccttgttgatcagtcggaacgctatgaaagagataaataccatgttctttaaaggagacccaataataggctccttcttttgatgaggcgttatagaaaaaatctcctcgttccggttctatgacaaaagttccttttggggtagggctctcttttgctcctgttgaaacaatcgttttaaagatgaccttgtcattcgaggttattgtcattgtttgcctcgtagatgaaacatgaatttctagatttgaatatttatttagatttggataagtcttcttttgtaagacctctttttttgaagtttgacttgtttgagatgcttgttttatgacacttgctttttctttggctttatcaccacgaaaaatagaatatacgctaaagatactcatgaaaacaaataagacagctaatattggcaaaattgaacgttttctcatgtactatcctctctcttttgctctgttatggacaaatctattataagtttctgaaagaaggttgtcaaatatttttgtaacatttgtaatcaaacagaaatatttactggaatttttagtagaaaaataacctcgaatgatacttcattcgaggttattgtgataactgtaagtcttaataacatggcttcaaaataatattaagaatctaaactactgtaataattaattggtctatgatcgttaaacaggaatgcttcaggatgaacagtttttaattgtttttgaccagatttccagaaaagtccaacaagaatacctgttaacactaaagcaagtgaataagttaagatgcctaagcccatattaaatccaattggttgagataaaatataaacaactactgcatacaacatgaacatagctggtacaaatgttacccaataatttcgtctttttaggatgagatatcttgtagcaactaataaaccaataacagcagttacttgatttgcccagttaaagtaacgccataggagattaaaatcaacgtgtgtaaggacaaatgaaataacatataatgggatagttacagcaaagatttttggaagagtatcttgtttgacatggatataatcagcaacgatagtacgtaagctacggaaagctgataaaccagatgaaacagggagaacaataacaccaatgatagcgatagttccaattacactaccgagtaacattaacattacttgattgacaactgcagaaggtgtcccagcagcaatcatttcatagagattttgacctttgaacaagctcattgaagcacctgcccaaatcatcgcaattactccttctgcaatcatcatgccgtagaaagtgaaacgcccttctctctcattaacagttgttcttgagaccataggtgcttgggtagcatggaaaccagagatggctccacatgaaatggtaaagaataaagcagggaatatcccaagcccagctggatgcatatttttaaaggtttcaaaagttaagtttggcatatcaaagccaccagttaataaacggaagccaactgctgccgtactaaccattaagatgacgcagaatacaggataaactttaccaagtgctttatcaataggtaagactgtagaaataaggtaataaacgaaaataagaccgattatccaaggtaaagatagtgtcccagctggtaaaatacttaggataagattagctggagttaccacaaatacggttgcaactaaaataagtaatagcattgaaaaaatgttgatcacatgcttcattgactttccaagatagcgactagctaattcaggaagatatgcaccattatttctaagagaaatcattccaatcatataatcatgaacagcccctgcaaaaatacatcctaagactatccagatataagcaactggaccatagagtgctcctaaaatagggccaaagataggtccggttcctgcgatgttcaataactcaatcatcccattcttccattttggcataggaacaaaatcatatccatcccttaatgcttctgcaggtgtttggcgattttcatcaatttgaaaattcttttcaatgtatctaccgtacgtgaaataaccaacaattaaaagggctacccctcctaaaaatgttaccatatcactgcctcctaaaaatttttttgcttaattttattaagcgttttcatgactttagtatagcattgaaaaattgaaatttcctattttcaagatgaatggttgttttttagaaatgaatagtctaagttttatgatgaataacttttcattagttaggtagatatgcctaacatttgttttaggggttttacatttgctctgctaacaggaactgttattttattacaaaggtgtaactgaagtgtttggttaaaccaaggttcaatcgttttaatagcattaatgttcacaatgtaagagcgatgtacccgtacaaattgagatgatggtagtttatcttgccattgttgtagagagccatcaatttcataatttttatcaggtgtttgtataatcagttttccttgcatagcttcaatcaaaaggatatcatccgccgacaccagatagattcgatcttctactgtcaatggatactgttgcttgaagagaggaccggaagttacgctctctataattgtagatgtacttagcgctccttttactctatccatagcttgctttagcctatcaaaatcatagggttttaacaaataatcacgcgcatcatgctcaaaagcctgaatagcatattgatcataagcagtcgcaaatatcaataatggtggtttgggcattttattgatatactctgctaattgcaacccagaatcatctctgagatggatatctaacagtgctacatcaaaagtttctctaagtaaaatagctaatgcagtagccatatcatgcgcctctgctataacgaggttagaatcatacttattaagaaggtaaattaattcgttacgtgcaactggttcatcatcaactactaaaactttcatacaatacctttctaatttttaatggggatattaacaatagcacaagttcctgaatcatttgattcaaattttaaacttgcttgtccatcataaataatattcaagcgacgaacgagattctcaatagctgtaccagaaccttgttttgaaatttgagttttttttccaagcgttattaatttttcttttggaatcccaataccattgtcttggacaatgatatgaagcctatcattatttcttgcaatagtaacctttagctggttatttttattaacatgcttaaaagcgtgtttataagagttttcaatcaagacctgcaatgtaaagggaggaatcattaagttgtcatctgaatttgtttggttgtctaaattaaaggccaccatgttgggaaatcttgcttcttcaagggctaaataggcgttaacctgttccaattcatcatgaagaggaattaaattttgctttgcccgttgaagattagcacgaataaccttgctaaaatcttggacgagctttcttgctttttcgctatccatgcgaattaaaccataaatagtattaagtgcattaaaaagaaaatgcggattaacctgcgcttggagagacttcatttccgcatcctgtagtaaccttgttgcttcctcagcttgtcccaaagctaactgagtggaaaagatattgcctaatccttcagctaattgacggtcaacgtaagtcatatgttgtgcgtctgaaaaatataatttcaaagtacccactataacatcgtggatgtgtaatggaataacaattgctgaactaagtgggcaattcttatggtcgcattcgatttcacttttatcagttgcgacactaactttaccagtatctattgctcttttagcaagctttgttaatatttgagtattaggaagatgatggtcagctccatctcctacataggctaaaatggctgattgactagtcaggctaacagcactcacatccatatgtttatgaataatttcagctactggttgacaagattctgttgtcagtccctttctaaggtaaggaagggttaaatttgctaattcaagtacttgatgggtttgaaatgctttagcatgttcttctaatttttgagtagatgaaataatggatataaatatacctaaacctaaagtattacttaaaatcattggcatgctgataaaagatactaagcgaagcgcctgattaaagtcaacactaaaaatgaggatacagatcatttgtagaatttccataccgaaaccaacaaccattgcatctaaaacacgaattttattataatttttacgaagataattgcctgataatccagagcataaaccaattagtaaggaagaaatgacataaatatgaggggctaatcctccttgcaaatacctaacgaatacagataagagaccaactataataccgactatggggccaccgattagacctgatacaccaatggttaaaacacgtgtattggcaaccgatgattgatctgctatatgattaagagtttgtggaatgatagataaatctgactgaatttctacccctgtaaaattagaaataatagcaaataagctaaataagataagcagaatatactggtgtttttttaattcgggttgcttcaaagtttgttttataaaggggatatgcacaaaggcataggctaataatatgattaaccccgctcgctccatcataattaaaaagagtgtcattaaatctctccaaagtattaattagtccgttataacataggtataaaatgattcatttcattactcatttaaaatgtctctctatcaagtattctcaagacaattaaggggatatccatcaacaactattatgaaaacaactacttaaggataatagatactttcactaaaaaattttgattaatcaaatatattattattatagcatatcaaatattattttttacatatttattaattaatatgtaacacccattatctgaagtgtgtaggtgaggtctaagtaaagaatttaagcgttttgataataaaaaagtgagaacaatagattctcactcacaattagcctggtaatttctcacacgatttggtactgctttttaaaattgggcgatggtgttatttttaatatgagtagctgcactcgaatccgattgctcaaaagcacttgccgctccattgagatagctattcagatcagaaataactggttgaatgttttggctgacttctttgataacttttgatccagcttctaagtattttcaatgttcttgaacccattggtgattttttttactaagtcacatgctgttaaaatcatcattaagcttatccctcccataataataatcaattttttaaatcctttaaacatcacttttcctcttatcttattgattttttcaattttattgctgtcttgacgttgctatcgcaaacaaccaactcaatgcaatatagttatggtatacatatcaatgtaagaatcaagatttttaaattcatattatttgtatgatattcaggattagctatttttgatttcacaaaaaaacttcttctactttttctagactgattctttcttcccactccttcgtatcaatagttaaacaaagtactttaaatcctacagagggtcattccatcaattaatggtatcatcgcgcttgaagcatggcataggttttggtattagaaactgaatatgaattctattatctgttaaaaaaatcaatatcaccagagtatttataaaacataacgataaaaaatcaaaaaatatttttactatttcccttaatttcatgagatttaatttccctttttgtgtattatttctattctacactagtcttacccttagaaatatttttccaattttcaatgacacgagctactctttcttgctcttcgtcatggtacctccaaaaattacttcatcaatatcttcctcattgaaataatatacttgttctaaattgagctctctggaaaaatcctgccagataatcaaaatatcatcttgatcaataatatttgctcatgaaatggctccacaaaatttcttacatctttaacattttcatagagtgcttttactccacaatggccaaagtacctataacaactgctactactggtacaaattggagctgttatgattactacaaaaacactctcagcaagcgtagagactattctacctacttcattttttctagatatttattgctcctaccttaaattaattaatttatcactcatattcgggatgcttatgaatataatatgctgcataaagggaatcgacaatcagagctggaaaagttgccgtaaataatacacctccaatcaaaccaaaaatattttcaatactacctacaagaaagactggagaaagcatcactaaaccaaaaataattccataattaatttttaattgttccttttttcctttttgtaatttccactgattaaatttccattttttcccctgattttttggtaaataatagaaataatatattccagaaaatacaataaaaataattaacattatcataatatacatttttgccatctcagtataataaattgattgaacatgtccaaaatttctattatttaaaaacattgccaagcctataaaatcaaaacctataataagtgttaggaatactaatgataataaaatataagaaattttttttaaaaaattagatatttttttaaaaaaaagcgaaataattattgagaccaaattaacaaaaatgcatacagaaaatatgaattttataaaacctaaaggatcaccaaaattacttgcatataaccctatgcaagatataaatagtccaatccatggaaaaattttaatatatgaatattctatttcaaactcaattaacggtccatgatatctatggttgctctgtttcaaaaattttaccctccaaataaatcttttaatccttttttagcaaaacctgtaattgattcattacccaactccttaactttaaaattcaaagcaaaatcaaatgccagccctgcactgctccaacaacggttcccacaggtcctcctaccaaagttcctattgctgcaccggacaatgcatctacacctgaatctatagcaaagtttttgattttttgatctagtgtagaagtcttatcatcaaaaaagtcttttttggcattagtttctatattgactattttcccagtccaacctaatactttaccagctttagcaattcttcctaattttccccatcctttaaaagcatttttgggatttaattcaaggacttcatttttaagggattttattgctgcattattcaaagtaactccttttgacgcaatttttctgagcttatttgaatcttctaaagcttttttctcaactgtttagcatcttcttctcgttttttcatacctgtttgaattgtttttgtccattctaatcccttacctgaggtatcaaatgtaccatttaaatttccaaaaccttctgagaatagttaaggcctgccgaaacgacatcctgaacttctgttagtccacaaaagactgttgaggattccgcattgaattccatgagatattttttaaatcataggttacctttaatgccagaaaactcctaagagatttcatgaactagctgtcactttataagtgatcacaagctaataacaaaagtgaaatgaatcattaacttttctaaagttaataaagaatggaattagctcaattgccactctagaagcgagaaagtcaccataagaatgacctgttgtgacagtaatattatcgccattactttgaacacgatcataaaagctagtagctttgtctcctaatcgttttaaataagcagagttattagcaccgatatttgcatctgaaataaagtcggttgccccatcagcatccttattagtacccgcataagctatataagtctcaccagtatttttatcttttacagcaatagctgcaataccagtctctttgtcatacataccgtcactataagttaaatcagttctatcaattagttgatttaactcttttttagtactttcacttgcttcttttatgtcatcaccattatttaaagcatctgtataagccctctcatatttgtatacataatctgataaatctgctgatgttttaacccgatgttctagttttatagttacattatcatttcccataacttctccgtttattttctaaaactataggtctcacccaaatagtatctcttgtttttagtttttatccttagtgtatagtcaaaattattttttccactttttgtaaaagtaatatctgcttccttaatatcagatattttaaatttatctctcattttttaataagcttcgactgtgtcggcaattcatatgttatatctttcaactcagtttccggatgttttaataaataactttttacttttaatttttttaattcttttaattctttagtatccattgctccgataataaagtcatcaaatgtaatattcggttttccttttggataaactatattatttttaaaatattcaaatgggacctctttattttctaactcattatagccacccggcttttctatttgactttttcttgtttcaaacttccctaaatccttatttttttttaaatcttgaatactatagaaatattctaaatctaatgcatcacctgaatccgatactaatagtaagtatttttgtattttgctcaaatctttatctttttgtgctaaaaactcaaaaaacggtttaaaattttgttcagcttggtactcttcctttgtgcggttttctgggatttttgaatccttacatgctgtcatcattatcattattaataagcctccaataagcagtaatagtttttgttttttcatatgctcaatgctccatttctatttcttgagtgattttaagcattctttcttgtcttctatcatgaatataaatcatatctggtttcaaataaggttcttttgaattatatgatttcggtaatactgactgatccataactctcattcctaagagaacatactgtgcctgtgttctaatagcttttggaacatctgagatattagtcataaggtatgatgctaaaccaccaaataagaaataaatatgatatttgtgagccgagtcaagtaagaataaaatctgttctctatccatatttgtttctgccacaaaactattcatatcaggaatagtaacaaaccatgattctattttaccagattcttctattaaatagatttctgaaacaatagcttctaaatgccctgctatttcacttcgattattgatatattcaatttgttgttctgtcaaatcatcataatcagaagcagtgtctaaaagataaacttactatctttaatcaatgaaacagatttaactaagaagcgcatcaagttagacaaattatctggattgtcagaagtaaaaagtaactgtttgaatttcgaaagtggaatgctacaattatcaacttcttttaagctaataccaagtgaaatctgattagtctcacttgcttttttaacatcctcatatgctttaaactcctcaaaggtaagtgtttctggaacaattggaatggctattggtctcggtccagtccatttggtgataaaaatctgttgattttaaagttcttatgaaagataaaagggtcttagattttgacaagctaagaaccttttgtttttcaaagaataattatctacttctccccaactacataagtcaattgtgctgcttctgctgcactgaaggtgcggtaggagatggtgccaagtcctaggacatttgattcggagatcgggatagatccgtcttccttaacgtcttcgacgatggccacgtggccgtaagttctatcagcaccagcttggccggggctaaatgagatggcgtagcctgtttttgcctcgtgtgtggtttgatagcccggcttatttttccaatcgccaccattacccataaatggtccaaactggtagccaagttctttggccccaagggtaagtgcctgccacatagttgcccgcttgattagctcttgaaacagagtaactcgttgggactgccatcatagcgacggacgacgtgttgagcagttcctttgaaatctcagaaattccgccatgcgcgtcaatccacttgtcaatgctctccataatggccgcacgacgtttaccagaaccgctagcatccgtgaagtaaaccccacctcgagccgctacattcaagttgccagttgacaagaattgtgctttttggtcttgaatggcaaagctggtgttttggttttggatgatggtttcctgcgtcattttaatgacagccttgtcatcactaaagttttgagcgttagttgtattgttgtcaactgccccaaaaccaaacatattagcacctggtgctgtggcaacgccttgtgtaccaagcgaactttctgcgatagcaatggcaatgattgcacgcgcatccagaccagatgatttctctcggtctaagattttttgaccgtcgatgcgactgctatcgtatgtgatacctgtcgactgtaagaatccatcaagctgtgcggcagtaatgccgtaacggtgagacaatagattgtgtgtataagcatcattgcctatccagtgtttgacataagctgcgctagccattgccgtaggtatggcaacatctggcaaatcaatgccactcgtaatggctggtgtcacaacttcagatttctgaggtgttgctgtcacttgaggttggcttggcaccactggtgttacagactgactaggagctggagtttcgggtttgcttgtatctgtttgcgtcccagcctgtgtttctcctttggaatcacttgttgaaggaactgtttatctggactagtcgtcggattagtttctgtttgtccctcaattacagtctcagtaggagctgttttgctatctgctggttgggcatggagatcagttgaaggcagacttgcctcaggtaccactgtcgtcgcttctgatgaaactgactcagaagcgcttgtcgcctcagctgatgaattttctccagctttttcaattgtttgatcagttacagtcgtagcttgcgtcaaaatagtttgtgcatcctgagcaaaaaccgtaacagccgataagtttgacgtggcaattgcacacaacaaacacaatgcaatatatttatcttttttcaaaacgtttttccttaatagtttatagagtgtttaaagaatttaatattaaaaattacttttcttttattcttcagatgactattttaaaacgtctactgaaaagtgagggtatttgatatcttttatttatttcaaaaatattttttgcatctcctcttcattttcatcatagtaaccttcaaacaagactttatctatatcttccaaattgaaaaaataagtttcatttccaactatactaattgggaaaatacatccagaataatcaaaatatcccaattgaccttcattgtcatataacggaaatcttgatgtaatcatgactttctgactatcattttttaattcaatgacacttcctagagtatgtattttatccattttttcttctatttttacaattaaaaattatattgcttttttatttcatttattgcattttttctttcaaaaaaatcaatattttctaataacaatcttgataatattagtaacataagtgctataggaaaaaatatcaatactgagtatttaaaatataacattattaggagtagggatataaataatgaaattactaataaaaataacagtttattcgacaattcttcagcagaaacaattatatttgctattttttctttgtcaaattccattttctcgtaactaatattatcgatatttctcttttgtttcgaaactatattgtttaatttgttaactactactagtgcaattacgataaacattattgcaagaattaaattcaactttaaattagctattgttctataccaattattaataggaatgagtatgagaacaagaaacgtaataatactagaatattttttaatattttctaaattttctttttgataattaggcgtttcaaaacttttaatgtaaaaaatttttgtatcaaaattataataataaccttgatttccgtcatgatatatttctgcatatgatttctctctatgtatcaaaataaattccttctcaatttatactacctgttgaatcatacattaattcaaaaaaatcactaacattgttaattgtatccttcgatgctctttttataatatgatttatttcatctttattatcataaacataatcgaacaccatcgatccacctacacctattactgctgtagcaccaaagtccacagcagaaccaacaacaggagcaggcggtgcaagtacacctgttgaaattaatagtccagctgttgcggtacccgcagccgttcctacaacttttgcagcactaccaattattacgggtgctcctgtcttcatagttgcatcttctacatcttctccaccttttacttgagctgctccaaagtcaattgcagccccaagtacaggcgctccatattttacaaattggctcgagcctctaatgaagttagcgtaagaaggatttacatcaatagccgagctgtgtcagtcaattttgatttagctacctctttaagtaaggcagccgatgcattacttaaaccactgataattgattcataggtatcttttttaatttctcctaatttatacgcttcattagccgcttttattaatttctttttatcaactgaaacattactttttttagtagtattttcaatttttgaagctttcttactttcttcagcctttttacttttcagttcttcagctttggcgtcttctcgctctttccaattcttcttaactgtctttgtccattccatctgtccggatgttggttttccaaaagctccggttttactattatatccagaaaatcctgttgaaacagccgctagtgcttggttaacagttgactgtgcattagaaatgtccgcaaatactgttgctgaatgggcgttaaattcattaaggttgtctaatttcttttgattagattttatacgtttttttaattttttaatattactttttgtagaacttatggcagatttggaaggttctggatcatcgttaagatgctctaaaagtgcttcagcaatctttaatgatgccctatcacttgctaattttgattctaaaacgacagagtctaaatcctcatcaccacaaattgagacatataaggtttgtaattctgtacatttctcactcaatgtttcagagaaaagaatcattccttgaagcatcggagttaacgttccagtagcatagctttttgcatttgaataagcagtcccttgaagagttgcagcctctgcaaaagatgatagttttgttattgcatcatttaaagccgatacacgactaaacatagaaatagctactgttgatgcttgagttcctacagaacttacactaacttttaccatttttaacctccttttctttcattacttttttgcatcaaactctgtttttcataatacaacttatctaatgcattttcataatccataatctctttagaaactaagtttatcctattgtcataggattcttctaaacttagtgtttcactatttaccgttagaataaagtcattattctcttctaattcttctgattctgttaaataggcatcaccgagttttaatgattctagtaactctatttgtaactccatgacgtcgtttttcaatttttgtaagagccttttactattctcagcattatcaagctttatttggaataactttaagtcaagttcaatatcttcgaatgttcgttcagtcataacatcacctattaaaacaaaccatatttaggcttaaaatccggatttgatataacagagctgtcattactaggcattgtatatttagtatttgccgcaatctcttagctaattttttggtcaatagcttcaaactcattcaccgtagaatgaatgagagctatgaactcatttattttttcagcaatttggctactactacttgcctctccatcgatgtaagttgaagcatcgctattaccactataatcactgtttgaatccttagttggagctcctactgctgtgattccactggctcctgattgtattgcagttgcacaggtggatgcgacggaggcatcactttgtatttttgccatttggtctcctttcttagtctatggtgagttttaatttttgataggtttttctatcgtgaatgtaggcttcgtctttgtttggacggatttccttactattatacactttttcaaggaaggtttgatccatgagcctcatgccagccagcacatactgggtcgttgtgcgaacgtatttaggcacagcatcgatcttagtcccaacatagttatagcttgatccaagaatcagatgtaaaccatagcgtggtccattgtcaagcaatgcctgaacctgttcaagcttcatattgctcttagccacaaagctttcaaaatctggaatcatgataaaccattcagctatctcagattggctttcacgttgctgcaactcatagatcaactgatccgccatatcttcaatcatatcagaacccacataagtacgtacctgaccttgatagctttcatattcgccaagcgaatcgatgatcatgttatggtaatttgggacgttaagcaagaccttgatgatatgggaaccaactgcttcgagtgactcgtcagaatcagacatgtaaagcatatgcttaaagcgattaagtgctaaactataactttcaacgtcaaccatttcaagcccaagtggtaaacgattagctgataggtcagcttgaacactatctgtagccataaagtcgtcaaaggttaattcttcgggaacaattggtattgcttttggtcttggtccagtccatttgctgttcatggcgtcagattcgttttggatgttattgatgatgtcaaaggtttcagtgccttctgttgagagagccacttgtaacacttcaatgtcatcacgtttgattaatccacgtcctggaatatcttccatgatgtgttggtgacgaccgacaagtgtccgtgattcagagtcatctgttaatttaagagcgatacgttctttaaggtttgccattaaggacgacctcaaagctgccgtacgaccagctgagataactaaggaaatgccaagtgacgacccatcacgcgaaatattttggaaacaagcttctaagttagtcggtgtttgagcttcccgtagcccttcataactgtcaataacaatcaggatttgaggcatggtttccccagatacctgacggtaaagttttgctgtcgcgacattgtagcgactgagggcttttttacgatcagacatttcaactttgatacgggcaataaacttggctattttttcgtcatcatcaatggtaaagaaatctgctacatgtggcaaacgtcttagaggtaagaggccattggtaccaaaatcaaagaggtaaaggtttaaaaattctggactattatgacgtgctaagtccattgttacagtttgaagggctgtggatttccccatacttggtcctgcaaaaattgacaaatgcccatcgtcttcaaaatcgtggtaagccacttcttgtgcttgttggcttggtatatccataaagccaagaacagctttgtaagatggggccttgctccagaggtctactgatccctccttacggagatcggttactgcaatctgattgcttagaggcggtagccacggttgaggtaagtctgagatgcccatttctttggttaaagcttgaatgttttcaacgatagcatctaattccgtaggtacttctttaatattttcggcttggtctaagcctgaaagatcatcatttaggatttcgtattggccaaggtcgttgatggaataaatggtatggtcttcaatcccttggtcgtctttttcaggttggtaatctgctcctgaccatgctgattggaagagttcatagacttcattattaccaacttggaggtaggcacgtcctgcttgtgtaatctcggcggcatctggagtatggagcatttccatggagtcgccgcggtctgctactttaagagctagtttgaagcgtgagtttgaccagatttggtcatctaccacaccagatggtttttgggtcgctaggattaagtgaatccctagggaacgcccaattcgcgctgttgagacaagctctttcataaactcaggttggttggatttcaattcggcaaactcatcggagattaagaagagatgaggcattggttctgaaacttctccaagtttgtatttcttctgatactggttaatatgattaacatcagctttagcaaataaacgttgacgacgtttcaattcagcattaatagaaaccaaagcacgcatcgattgggcaccatctaagttggtgatggtgccaagtaagtgtggcaggtccttaaagaggtttgccatccccccacctttgtagtctatgagaaggaaagctacatcgtgtggatggaaattaacagctaaagaaaggatataggactgtataatttctgacttccctgatcccgttgttcctgcaactaatccatgaggaccatgagctttttcatgtaggtttagataaacaatatcatcctgaccacgtaagccaagtggaacagctgagcttttatacggagcatggcttatccaacgctcttgaacatgcaaatcttcaaattcttctgcttgatacatttccataaaagtaactgcttctggtattgaagatttaagattttgtaggtgatttaacggagctaggcgacgtgaaatattttccttgtcataatcctctaagaaatgatctaattcaaaatctgtttctttaagctctccttcttctataactaactgaccagtattacggtctttaatattaataatggttttgatattttctgaaagtgaactcataacatcttgaacaaagatgagagaacatcccaattctgtaggatcttccgtaaagaattccatgatgacgtgatctaaaattaacttttcatcagttacaataacgacataatgcggagaaaataaagtcccttctttggcagatttatcttcgcgttgtgtgcgacgtaattttaaaatttggttaagactgttgagcacttgatcacggcttctttgattataaacaaagccacgaacattgacatcttgtaaggtttcatgtggcaaccaacgcatccaagaccacttatccatctcttcctctggaacaatagtaataaattgaacatcatggtaagaatggaaaaaagctaattgattaaccatcaattggagttgctccaatactaaacctcgtggtcctatatagccaactggtccatgtgataaattcgcaacaatcggcatatttttaatataacgattgttaaagtagaggttatagccttcgttctctaaaggatcttttttcccagaacgttctggttgagaataatgaatattatagctcgttggtacttctcccaaacctaggcgataatacaagaagtcaaaatgaagtggtgtcttttcataaatacgatggtgataagtatcagccatttcctgtaaaccttcaatcgttgggtaatgatagtgttgcccacgcttttgctctttagctaacttctgaagttcaattgacttatcagataaatagtcatgataggaatcaatgcgttcttgtaagtcctgcttatactgtttacgatttttaaagtaaccagtgatagagaaaatcatcgtcactagagccattgacattgttgcaatgatatagataccacgaggacgaaaaatagaaataagaatgctgactccaatcatcactagaggaggaacaattaattttaacagttcatctttagacttattaggttcattaccaggcgcattaactgtaattttatcttcactggaacgataaataatacgaggtgagcggtgaaaatcaggatagccttcgtaaaattgataagctgacataactttcttagttaatgatgtttcataatcagcccccccagatttgaatttcatctgggaaaagcttaacaattgttccttggaagctaatctcatcacctaaacttaaaggtaactgctgcactactttttgaagatgattattcagataaatatcaccttcaaataaattaagctgccaattactttctatttttttcagtaataaattaggggctccttctttaaaacggacacgatacccttctttatcaccgattaatatatcttcgtaatctaagggagtataaatttctttttgattattcgctaaatagaagacaattcctgaaatctctacaccattagttaactctttttctttttagtcaataatatataccaattgaccttgtatattttttagcgtgatgtcattttctaaatctgatactggtattggcgacttgccgtttgatgatattagaaaggatttctcctcttcaatattaaattcgtagcggagtgattgataataacaaataactaacatatccacctacctacttttagttttagaagatgtacttgctgtagtacttgatgattcagatgactctttgttggaatttgtcgaatgattattgctatttttcgatttggattcctcatctgttaaggctgtcttacggtctttccaatatttatcatagtctgtttgtagctcagaaagtttttgttcacgatctttaccagataaactattgtcttttctaacctgatccattttctgaacaatagcataaataacaaggtcagaatcgtctaaacgtttggcagcatcaatagcatcatcatctaaaccacggccaatattaatccaataatcaagatagagctcatcagtcttgagcgtaacattgtttaaaataacttcacgctgttcttcagaaaatgacattccattaatataggaataggccaactcgtacttctgtgtataaggtaacttacttacttttacatgttctagtcgattaatcacttgattataatcaactttaataaatgaagtatccgctgccaacattttttctttgaatggattgtgaataaaaaccagatatactagcggaatcaagagtattgtagataaagctcctagccaaacacttatgtatttataaagcttatattttgcccttgatacttttgctaacgtatgagtttctacttctacttgctgctcataatcaatagtaatgatgtctctaacagcctgaatagtttctgcatgataaatgctttttaggaaatctgatacttcaataacagaaatagcaccattatacaactctatatagtcatgttgcgtcaataatgcaaagacaaaacatttgaattgatataaaaactcttctggaccaaatttctcaggtctcataatcccaggaaggctacgataagctattttagcagttgcattttttgttaaaaatagattagagggatgcaaaatgaaatttactgacaaagacaaagccttatctaaatccaagacattcaaggctaatcgtaatttttcagataaagtttcttttttaaagctttcaaaaaatagagcgtgcgcttctgtctggaattgaaattgaatggtatctgcatcaattgcagttgtcataggcatcaacaaagaatggtgaatttctaacaattgcagttgttgcagattttgagttcctacttttgaacgcttaagagataactgccaaaaatctggtcctttttcaaattgaaagtcttgttcttcaaatacaaacgaatctgtttccattaataaaactcctctatccttatacgatcaccagttgttactggatggtgagctaatatatcgttctctcccaataaaatacctttatttataactcttagttgatatttggtacgcctttcagtacggctaaaaatactatctaattccattactaattgcttaacgctaattttcaaagggatacgtaaatcttttgaggtttcccccatatctagagtaatgttaatatgtgtattcatcctttttgtcctttattttaaaagtcattatagaagctaatattagtaccaaactaatgagaaccaggtatataattatatgaccaatatcagccgaaacagtcggttcttctgttcttgtaacaaatttaaattgattactttcttcagaaaataattgtttgatacgttttttcctatcagattgtcctttatttgaatattgaaacagttgcttagactgctttttctggagtgagactttagattgacggtttttatccaattttttaaggtcttcttttttaaataaatctttagttaattcagtttgaaaaccagaatttttttgtgaatctgattctaaacgttttgtatcaaaatgaatatcattattctttaacccatcagaaaatactgatgtttgactcatacaggataatattagtagacaggctaaaaatcgtttcaacttcatcaacaacctcactcttttactttagcttcaaaatttaaggtgataaaaatattcatgataataaaagcaacatccacaagaagtactaagataaggaaaataaatccagttgtcacattatcaaaataagatgataattgattttcaaggatagatagtggattaatagcttttagtaattttggaagtccactaacagtcgctactgtgcctacggcatttgatagatacacaaaactaataatcataaacaaagctaaacccataccaactgctttaaaatttttaataaagaaatactgactatgaattaataaaaaactaaacagagtcataactaggaaccaagatggtacatattcaggcatgacatgaagacttctgcttgagataactcccagtgctaaaccaataacaagagagaggcctgaaatgacaatgacatttaaaaagtctgtttgaagccagcggttgacattatacctatctgtcaatttcttaataaggttttgagtcgcaaagatatatgctgtaaataggctaacaacttctaataatagtatccaagtgaatgggcgataagtattttcagttgccctaactgcagacgctgattcagcgacaggtcgtgataagaaattaaggagaatatcatttggcactccatttttataagcagtattaaaaactttagagaaagaagctacgaaatcaccattattggccaattctttttggaagttagccattaaatcggttgcatccgtcgaaagtttgttgcccgaatttttagcatcttgaacatctttattgaatgatgtgaatatttgattaacttggtccgcctcttgactattagatttggacatatcttttacgcccgctgcagaggtcattagcccatctagctggttcttcaaatcagataattgttgatcagttgttttctgtgagtcgtttactttagattgatcctgtgtgatgttttggaccttcatgttaattgattgaagggtttcaagctgttttttgattgcatctgttagtcgtacatttgtctcagttacttttgccatttgatccgccaattcatcttgactattttcaacttcctccatgacatctttaactttctgttgcgcatcagcagtgttttcatccatcaaatacttagttataccatttttgaccagatcaaccatcgtatcgttaacactttgatttaaaaattgatcaaataaattttgcggttcttcgccatcagaaataatgtagtatttagctactaatccgtgagtggtgttatatgcatcatttacttcttgtagagttcgttgatacgttgcctctgcctcaaagtaagaccgttggattttaccgtcatcattttgtacaatttgtttctgattcccgatagtgattgtatagcttggtttcgtaatactagagttagatgattccctttgataactgctattgataataatattattgttttggctggggtccaaggttcttgtttgcttaccattaaccgtccaggtatctaccctgtaatctggattatttgattcaacagaaactatctgctcaccagttcgagtagaactagatgacaattttaattgattaactttatttttagcttcatctctatttttcctagcttcaaaaagacgattcaataaattagtatttaaatacagagttctttcgttgcttacttttttaatgatttccgaatcagaagatgtaaactgaatggctttttcttcttcttgggttaagtgcaactccgaaaggtttagtgaaggaatgcttgaaatgagagaatttgtgaaatctgctaccttagctttaaaatctttcaaagtcttctcattagtagaatgactcttcaataattctaataaagtaatattatctttattattcttagcaaagtaacttgctagtccctctctaacaattttatctagttgttcactttgatctttagcaatgttatcttgtgacttgagtgcttcagatagttcttggattttttgccttgcaacatttagataagctgatgagttttctttatgattatgattgttatcatcacccataatactattgagttgtgatgataatgtttcttggtctttttgtgcttgtgtgataatatcagataattgcttctctaataactcgttattcatttctagtaatgaggtcgaaaacgcttcatacgaaatgctatcttgatggcgctgttctattaagcttgataaatcttttccagtatttgtctgggttgtcaccaaatcattaaacatgttatcagaagcttctaaagattttttcagtgattcgttagcagtaatggaactactagactggttaacgagggctggaaagatattttggaaattagttgcagaatctaaaagatttttttggtaatttgagatattacctgactgaacatttaccatggcctgtacattttcttgagctgtatataagttacttaaaatacttgccatgtacatatttactaagtggctatttaactctgaaacaatatctttctctttttcagttgcctttttctctaatgctaaattccccttggcattaaccttataagagatagttgtttgctctgcatttgctttattgacatcaagaagtttttgagaaaagttattagggatgataaccattaattgataatcacctttgtctaatccattttgagcagtacctcgactaacaactgaccaattttgactattatcacgttcgatagacttaatataactagctcctaaattataactttctttaccattagatacattttgatcttcgttgactaatgctatatttagtttagtgttagtagctgactgtgttgttttattctcttttgcatgatcgccttgaagcttaagattaaggccagcaatagctactaaaaagagagcaacagctataatataccaaagtattctaaagttatttcttttcataattcttcctaaaatatattttattttcaacaaaataggaaggctttgccttcctattcacttatagactatgatacgatactatccactaatttgagaagcaatatctgcatccgtctgctcaatgatatctgcaacttttaataattgctggttaatatcttcgagtaattgagcaaattctgtaatttttggagataattcattgaattgtgcttcaaaagaatcaaaagtagatccatcccaattttcgtcaataactgcttgctcttgagtaagcaaattaagaacttctgttacttgttgagaaccagctgtgtacttttgtgctgatgagcgaagttcttctggtgttaatttaatttgtgccataaattttctcctttttctataaacacttttgcaacaactgcataattattacaacatattttttaaaatatattcaaatttactgcattatttaaaattatttttaatgttattgtttaatcctgtttattttcatctatatcaacaatctgtccttgttgatttaatcgaaatcgtgtcaattcgtgaaagaaaatctttttataaaaaccatgttgcttcttagcattgactcttttagaaatacctaatttatcatctgaactattaataccaaaattaccaatgtaatctttattaatacggtaactatgatacttctctggatgtgaaattacataggatgtggctgcttcagacatattgttaatgggactaggggaattaaaaacacgcgctgataatctcatttctgaagccacaatcatggccaaataaccacctagagaatggcctgttaaccagagggttgcatcaggatagttcatcttaattttttgtgcaaatagtttagatgttgtaatttgacttggatttttacaaggcagagaaatgccatcctctctcagggtaatacttgaaggacaagttagcaatttattgttcttccccaatacaactgaatcgatatctgttaagatatctttcttattaaaagcgttcgttcctgaatatgctataacaatatgattactttcatccaaagactgacatgccatagcctgcataccattattgatatcatcattaacctctaataccataaaagagcgtttttgatggaaatcaataatttgactaccttctataatttgaaggtgtccattactttctgctttggatttttcaatattatatgccatatctgatagcactttaaaactactatctggaatcattcattttcctctctattcaaagaccaggtgatatctaactcatcaatagactgaataggttcctttttttctctaggtctgagatgaaaacttttaggatgacaaataatacctgaaatactattactgtcactaatatcatcaacaatgtaattgataatattaacgccatttattgttataatagaagaccatgaaccagtttctaaagaatgcctccactttgaaaaaacaagttgttgaatacctagatatctgtgtactaaatcaagggcgatttttgtttctaattcattaatatgtgttcgtgtttttaacataattaactccttaagtttgttccctattttatcacaattaggctttttttataaaaacagaacaagctatatttaatctagtccgattctgttttgctggaagttaattttaccttgatcgtttgattaatctagtacttttaatgtaaatgctctgctttcaagaactttgaacattgcatgtgcagtatctaaagatgtaaatagaggaactccttgttcaattgcagaacgtctgatgatgagagcatcatggttatcaatgttattttgtccaactgtgttgataactgcttgaatcttaccatttttaattaaatcaggaatatgatttcgatcgttctctcctaacttacctactaaaactgtctctaaaccattagcatcaaaataaattgcagtcccttgggtagcataaatacgataaccaatactttgatagacttttgcaagttctaaagcttcttctttatctgtatcatctactgtaaaaacaatgttaccatagtctggcatatggagatatgctgcttcaaaggctttatacaaggctttctgaagattaatatctgatcccatcacttcgcctgttgatttcatttcaggacctaataaactatctactttagcaagtttggtaaaactaaagacaggggctttaatgtggaccatatctgaagctggatagagatcataaccatatgtaaaattgcagagtttatctcctaagataacttttgttgctacttgggccataggaatgtgagttacttttgataagaatggaagtgttctactagcacgaggattaacttcaataacatatactttctgatccttgattacaaactgaatattcatcataccgatacagtttaatccaattgctaagcgttttgtataatctacaatagtttcgataatggtctcagacaatgtttgaggaggatatacagccatggaatctcctgaatgaacaccagatcgctctatatgttccattattccaggaatcagtatattctgaccatcggatatagcatcaacctcacactctttacctataaggtatgcatctataagcactggatgatctgggcttgcctttaccgcggttgtcatataatgacgtaaatcttcttcgttttcaactatcttcatagctcgtccaccaagaacatatgatggtctaaccaacacgggataaccaatcttttgcgctgcattaactgcctcttcctccgtagtggcggtaaaacctggtggttgagggatatttagagcttgtaaagtggcttcaaattgttttctattttcagcacgatccaaatcttctaattgtgtgcctagtattttaacccctgccttgtttaaatcttttgctagattaatagcagtctgaccaccgaattgtaagatgaccccttcaggtttttctaagtcaataacattcataacatcttcaaaagtcaaaggttcaaagtaaagcttatctgaaatagagaaatccgttgagaccgtctctggattagagttcatgataatcgcttcaaaaccagactctctgatggctttaacagaatgaaccgttgcataatcaaattcaactccctgtccaattcggattgggcccgatcctaaaaccaaaatagaggctttatctgatatcaatgactcgttttctacggcataagtcgaataaaagtagggcgttgctgaatcaaactcagacgcacatgtatcaaccatcttataaactggaagaattcctgcttcttttcgcatgttacgaacttgatcttcgtttatttgccataaactcgctatagctttatctgaaaaacctttatttttaacctttttgagaatattgatatccagtctgtttttagataatagatcttctaactctacaatcactcttaacttatcaaggaagaaagaatcaatgctagtcaaacttgctaatttttcaatactataatgtctacgtaaagcttctgctagataaaataagcgatcatcttctgcctttcttattttttctaataaaacatcatctgatacattatctaaatctgctattttaatgtgatcgacacctatttctagtgaacgacaagctttcaacaaagattcttctatattccgtcctattgccatgacttcgcctgtagctttcatctgtgttcccaattttctatcgccactttcaaatttatcaaaaggaaatctcggcatttttgcgactacgtaatctaaagcaggttcaaacatagcgtaagtcgtttttgtaataggattaattacctcatctagtgtcaaaccaacagctatcttagctgctaatttagcaattggatatccagtagcttttgaagctaaagcagaagatcttgatactcttggattaacttcaatgacatagtatttaaaactattcggatcaagggctagttgaacattgcatcctccttcaattttcaaagctcttataatatctaaactcgcatctcgtaataactgattttccacatcagataacgtttgtgcgggtgcaaaaactatagagtcccctgtatggataccaacaggatcaaaattctccatattacaaacaacaagagcgttatctgctgcatcacgcataacttcgtattcaatctctttaaagccagcaattgaacgttcaataaggcactgtgtcacaggcgataactttaaccccttcgtcgtgatgtcaaccaattgttcttgattatcgcacatgcctccacctgtacctcctaaagtaaaggcaggacgaacaattaatggatacccgatttgctctgcaaattgaatagcttcttctaccgaattaacaatctcagattctggaataggttgattgagttcttccatcaactgtttaaataaatcacgatcttcagctttatcaatggctgataatttggtccctaatagttcaacattcaattcttctaggataccattttttgatagagccatagccatattcaatccagtttgacctccaagagttggaaggagagcatcaggtctttccttcctgagaattcttgtgacaaactccaaggtaataggttcaatataaactttatcagcaatatctttatctgtcatgatagtagctggattcgaattgaccaaaacaacttggtatccctcctcttttaaagagagacaggcttgtgtaccagaatagtcaaactctgctgcttgtccaatcacaatcgggccagaaccgataaccataattttacgtatgtctgtgcgctttggcatatcaaactcctctaattctatattttaaagctagcttttttgctggaaatcatcaatcatattaataaattcatcaaaaagataagatgtatcatgcggccctggtgctgcatctgggtgaaactgcactgaaaaggcaggatagtatttatgtcgaacaccttcgacagttttatcattaatctcttcatgtgtaatgaagagagcctcagggaaatcttctctcgagacagcataaccatgattttgacttgtaaaatcaacctgtcctgtttgcaaatgacgaacagcatgattaaaacctcgatgaccaaaagtcattttataagtctttgcaccattagctttagcaaatagttgatgtcccatacaaataccaaaaattggaattttaccttgaatttcttggatcatttgtaaagcattcggtaattgttctgggttcccagggccgttagataagagtactccatctggattgagatttaagatttcttgcgctgtcgtagtatgaggaacgactgtaatatgacattgacgttgtgacagttctcttagaatagaatgttttaaaccaaagtcaactaatacaatatttttgccaactccaggcgaagcataagctaatttggttgatacttgttcaatttgatcatttaaaagaacacttttttgaaggttttctagtgcttcatgaatagaatttccctcgtttattaaacaagctttcattgttccatgttttcgaataatttttgttaatgctcgagtatctatacctgaaattccaggtattccttttaattttaaaaattcatcaagtgtcatctgttgacgccagttacttggatactctgcccattcataaataactactcccttacatgttggtctaatagattcgtaatcgtctcgatttatcccataatttccaataagaggataagtaaaagtaataatttgaccgttgtaagattgatctgttatagattcttgataccctgtcattcctgtactaaaaacgatttcaccacttgtttctacatccgctccgaaagcctcaccctcaaacacactaccatcttccagtaataatagacgcttcattttatctcctttattatctgctattgagcactgcttctaagatagctatccttgcatagacgccattactcatctgtttcactattcgagccttatctgcttctaccaaatcgctagcaatctctacatccctattgacgggtgctgggtgcataataattgctgtatcccttaaatgtttatagcgttcttttgtaagaccaaattgttgatgatagctttcttttgaaaacacccctttaccatcatgacgttcgtgttgaacacgtaaaagcataaggacatcaatttgatcaactaactgatctattggtaaatattgcccatattcatcgaattgactactataccattctttgggtccagaaaagaaaatttcagctcctaatcgttttagcacttgcatgttagatttagctacccgtgagtgagttaaatctcctacaatcgcaatttttagccctttgaagtatccaaattcttcgtaaatagttaccaaatccaaaagtgattggcttggatgttggcctgagccatcacccccattgacaatagctgaatgaatgttcggactagcaatcaattctttataatagtcaatatcaggatgcctaatgacacaaacgtccaatcctagagcactcattgttaagatagtgtcataaagggtttctcctttattaacagaacttgtatcagcattaaattcaattgtttttaatcctaatttgagttctgccatttcaaatgacttatgtgttcttgttgaattctcaaaaaagagatttgacacatagtaatctttatcaaaaccaatgttgctaggattttctttaacttcgatacttctctttatcaaagacataacttcttgatttgataattcttctaaactgacaaaatgttctaatgaaagtgtttgtgtttgatgattcatgataatttctttctataaattttagctagaaaaaagcctcctaaaacaaggaggctctgcaaaatagtaagctagatagggaactaacttactatttgttaacgcaattccttgtttgcctctctggacaataccttaaaggatattaataagaaatgttttacctataccaatgtcgctgcgtggctatctttttgatagactatttcaccattgcaaattgtgtagtgaataactcccttcaatttatcaccgataaaaggagagttgctggatttggaggcaaattctgcctttattattctctcttcagcttgatcaaaaataacgatatctgcaggtccaccttctctgagataacctgcatcaaatccatataactgtgcaggattacatgtcatttttgccaaaaagtcaatcattgagagttctttagtagatactaaataagtaatccctaaggctaatgatgtctctaagccagtcataccagagggcgcttgactaatattatctgctgctttctccataatatgatggggagcgtggtcacttgcaataattgaaataacaccacttttaagtccatcaatgagggcttgtctatccttttcaagtcgcagtggtgggtttaattttgcattagcacccttagttaaaagtaagttctctgtctttgaaaaatgttggggggttacttctgctgttaagttagcaccaagcttctgcgcaaaatcaactacttctactgattctgaacttgacaaatgctggatatggactttcgcctgtgtttggtaagcaatcatagcatctcgcgcaatcattgaatattcagcaagaccactagctccacagacatgataaattttctgagcaatatgttcgttgataccaaggacaccatttaacgatggatcttcttcatgtaacgataggacaacatcatgttttctagctaagttcatagcttcttgcaaaaccttagtatctgtcaaaggaataccatcgtctgagaatccagcaactccagcctctaatagttcttcgaaattaactaaatctttaccattcagagatttagtaattgtagcaactgtttcaatcttaattgcttcttttgctgcactctccttaacttgttttacaatttctgggctagaaatcgttgggttagtattggccatcataagaactgtcgtaaaaccacctactgcagctgatagggcccctgtatggatattttctttatgtgtctgtccaggctcacgaaaatgtacatgaatatcgactaatcctggagctacaattttattgcttgcatcaatgattggaatgcctttaatatcaatttctttcgatatttgtttaatttttccttgatcaatcagcatgtctgatacttgattaaaaccactttgagggtcgataatcaatccgtttttaatgatatacatatctgtcctctctaactttgccaattcatttgatcttctttaaattttttcagtaataccagttggtcagctgtaatatatccattaactttagcaactttaattaattgattgtaatccgtcaaagtcaccaaaggaatatcagcttcacgaaatgcttgttcagccttagctaattgatatgtaaatatcgctactacccctaaaacctcaataccttgactctgcgcagccgtaacagcctctaaaacagatcctcctgttgaaatcaaatcttcaatgataaccattttttggcctgagtaaacacgtccctcgatttgattccccacaccatgatcctttgccttcgatcgtatataggcaaagggcaagttcatcttatcagctataatagcgccatgtggtatgcctgcagtcgctgtccctgctatgatatcaacgtttgggaaatgtttctgtatttgtttaacaaaaccattttcaatcagtgtccttgtctcaggatacgataaggttacacgattatcagtgtaaattggcgatttgacccccgaagcccaagtaaagggttgttggggtcttaagtaaacagcttgaatatctaatagttccatggcaatctgtcttgctaaatccatctcagtactcctttatttaatacgattccattcttcttttatctctagatatgcttgatatggattttctgctttcgttataggtcttcccacaacgatataatcagccccaactatacgtgcttgctcaggagtcatcgttcttttttgatcatctaactgattggtttgtggaggtctgataccaggcgttaagcaaatgaaatgttcgttagtctgtttcttgatttgcattccctcttgagccgatgcgactactccatctaagcctgcttcttgagctttttgagcataatggcaaaccgaatcaactacacttaagttaatatgttgatccacctgcatttgttcttgtgaagtcgaggttaattgtgtcactgctaatagtattggacccttccccaaaccttctctagctgctttcatcatttcgactcctcctgcagcatgcacattagtcatatcaatgcctaatttggctaagacagacatagatgatcgaactgtattagggatatcatgtaattttaaatccaaaaaaatgcgatgtcctaaggatttaatatatctaataattgagggaccttcggaataataaagctccattcctattttgacaaaaagcaattcttcttttggaaaatgttctaaaaaagttgttacagaagccaaatcagaaaaatctaaggcaatgatagggcatttttctaacatataattcctctctatagaaataataattgttggaaatgtaccagtatgacacaaaaaaccttgcctgagggcaaggtttcataaaaagttagcgaaaaagcactcgctatttgacttatgatggtgaccttgttcgcctctctggactcacttaaagatacatttgtaggtattctacaagtttacaatcattttgtcaaataaatactaaattattttatcattttacgtctaataaagaacgatagaggaatctgctgtacaatactgattgctatagcaattgtaaaagctgttacaaaacaggatctaaaatattccattgctacggcatctgctcccgtcaataaaaagtaaacagctctatagaagctaagtcctggaataagaggaaacatacttgtcgctaaaaagacagtggcaggacacttacgtttagcagctaatagccgtgaaaaataagtgatgaaaagccctggaaaaaatacggctatagcatccatgtgaaattgttgccataagatcaggtagagcatccaagatattgctcctagtatacctaagtcaaggaaataacgttttggaacatggtagagaatagagaaggctatcgtccctaaaccggccattagtgttctgatgataatctcaaggatggtattaggaacaccagaaaaagaacctgtcatttgttctgcaaacggaataatttcaattgtaatagccacacctgctgatatagaaatacaaatgagtaaagcagacataatcaaagctaaacctgttgaaaaattattctgtgaaaattctctcaccgaattaacaaaggcagcccctggcaccataaccattagtgcccctaatataataatgctacgatgctcacctaatcctgaaaaatataataaattagcacttaaagccactacagaactacctagaatggtcaaaagaaatcctgtatgtatacgactttccatcaaattcagaaaatatcctaaaattaagcctgttacagcagcggaaaatgaatctaataaggaactacctaaggctaaagaaaaactacccgctccacaaaaataagaaattaaagtaacaagtaaactataatctttttgatgttcaattaagtctaactgctttacaatttcttctggagatactaagtcttgtttagcaatttgcctagaaaggttattaacagcttcaagtctacctaaatttgctgttacaccatctgtattgcatactttagcttcttgtttaccatagcggttaatcccggaagcgataatactgctactaaccacataagcttcaaaattttctatctgaagagccttagcaaaatgcttcattgtgtcttcgacacgatagacttctgctccgctttcaatcagtaatttacctgctctaagaacaacgctcatatcattttgcatcttatttggccctgccttctactttattaccttagccacttaactaagttggttaaagtcccaaacatcatccatccatccttcataaaagtccggttcatgacataccatcaagattgatcccttataagcttttaaagcacgttttaactcatctttagcatctacatctaaatgattggttggttcgtcaagtacaaggacattattttcgcgattcattaataagcaaaatctgacctttgattgctccccaccagataacacctgaatctgactttcaatatgctttgaagttaaaccacaacgagcaagagctgccctaacctctgcttggttcaaagcaggaaaagcatcccatactgcttcgagtggagtttggcgatttcctccgggtacttcttgttcaaaataacctaaatcaataaaatcacctcgttcaacattaccagaaataggggggataatacctagtaaactcttaagtaatgttgtttttcctatcccatttgctccaacaatagctattttttgattacgttcaaatgttaggtttagaggttttgttaaagcacgatcatatccaatttgaagatctttagcttggaaaataaaacgtcctggtgtgcgagattctttaaattcgaaacttggctttggtttctctgcttgtaactcaataatatccattttgtctagtttcttttgacgagacattgccatattacgtgttgcgacgcgtgctttattacgattaacaaaatcttgtaaatcagctatttccttttgttgacgttcataggctgcttctaattgagcctttttcattgcatagactgattcaaaattagtataatcaccggaatatcttactaaatcttgattttcaacatgatagacaatattgataacatcgttcaaaaatggaatatcgtgtgagattaaaacaaaagcattttcataattttgtaaatagcgttttaaccaatcaatgtgttcagcatcaaggtagtttgtaggctcatcaagcaggaggatgtctggcttttctaataacagttttgctaaaagaacctttgtcctttgaccaccagataattcagtaacatcagaatccataccaaaatccataactcctaatgcccgtgcaacttcatcaattttagcatcaagtgtataaaaatcacgtgattctaaacgatcttgtagttctccaacttcttccataaggctatctacatctgcgccatcatctgccatggatatatatatatcattgatacgtgcctctgttttaaaaagttcatcaaatgctgttcgcaaaacatcacgaactgtttgaccttcttctaatacagtatgttgatcaaggtaaccagcagttacatattttgaccattcaatttttccttcatcaggttgaagatgacctgtgacaattgacatgaatgttgattttccttcaccattagcaccaataagtcctatatgttcaccttttaaaaggcgaaaagaaacattctcaaaaatagcacgatcaccaaaaccgtgacttaagttttttacttctaaaatactcatttaaaatcctttgattgataatagaggttattaaaaaactcatagagacactctacaagtttttaaattagtacattacatagtaagttccatatacaagtatagagagtttaaacttaaaagtcaaaccttacttaattttttcaaagtgtaaatgaacagtgatttgatcatcatagccatttcgctctaaatcacgttgcaaacggtatgaaatatagtgttcagcagtatgaatgtatcctgcatccaataaacgattttcaaccaaagactgaatcatattgatcgttggtcgttcaacctgagcatcctctaaatctaagattacttttttagtcacttgagcaaggtcttgacgaagtgactcatcaagcacataaactgtttgagcagctttcaagatagcttggtagattttttcaggatcaaattcaacaatctgtccatcacgtttgatgatttgcataagagcccctccttaatgtggaaacaatgttaaaacgatttgcaatcattttcatttgttaatttcattatgcaaatgttttcataatttgtcaagtgttttacctgatattgacgaaaaatcaatatcactagcagtcagcataagtattaagcaatgtcatattcttctatattaattcaaattttaactcttttgctggtttaaccagcccattcttatgcaatgtttctgcaatttgaacagaattccaagctgcccccttcagtagattatctgaaactacccacatatgaacaccattttcttgatcaaggtcttttcgaatacgaccaacaaaggtctccctatggcctacagcattaatcgcttgagggtaaatttgctgagatggaaggtcttgtaggacggcaccaggaaaatttgcaatagcctttttaatttcagagattgaggctaattctttcgtctcaatataaatggactcagaatgccccgataaaacgggaatacggacgcaggtagctgaaaccttaatagtagcatcttccataattttctttgtctccaaagtcattttcatttcttcgtacgtataatcattatcagtaaaaatatcaatttgaggtaatgcattgaatgcgataggataatgtttttgatcgctagaacatggcaagactgttgcaattaattgatcaggtgaaaggttatcatttaaaacttgtctcaactgttccttagtttcttcaacagcacgtgcacctgaacccgaaacagcttgataggtggaaactataacacgctctatcccccatttttgacgaatgggctctaaagcaatcatcatttgaatagtagaacaattggggcaagctatgataccattatgaccaatcatggcatgagcatttacttcaggaacaactagtggaacatcaggattctgacgaaaatatgacgtgttatctactacaactgctccagactttactgcataaggagcgaactttgctgaaatagatccaccagctgaaaacaaggcaatatcaacatcgtaaaatgattcttttgttgtctcttcaacacgtatagcctcatctttaaaatgtaaaattttacctgctgagcgacttgatgataaaagtttcacttgttctattggtaaattcgattgttctaattgacgaatcatttgtgttcctacggcacctgtagcacctacgatagcaacggtatatcccatataatgacctctatttggttgatgttgttcatcaatattttcaaaacattttaatgtgactattatactacatttttataaactttcaagaatagccaaatgaaaaaagtcaccctaaccaacctaattataaaaaggaatctcgtatccgattcctttttattgattgcatatatcattatatatagttactaaatgattgattatacttaattttcattgcgtctcaaaccgcagcgacttgttaacaaaattaaaccaaaacctacaagtttaaaaatgacattttgatcatcacctgttttaggtaatttatttatcactgaaattgttctagaattattagttaacatcggtctattagctacattagtaacctgagatacttttttagagaatgactgtttgttagagtcaccttgactagagtgattattttctctagatataattgactttgaaagaagtggatttttccctataagttgacctacttggctcttgttctcaacatcgcgttgacgacgctctaaaacattgccctgactttgatttccaagttctaaaacctattttattgaacaattaattttctccttactttttttaaattttaaaagtcattttattattacttttatttagattatatattaaaacattttataagttatgtcaagataatttattatttagttgcaatttattattaatttgtatgtttaaaattaaatagttgatatctaaaacatgatatttttaaattttcctttaatattataaagcatgatagatagtcatactaacattaagatttacaatgaggtaatagtatatttttaatacttcatctaaaccatcagaaactagattatttaaaaattttacaaagaatgtgatggtagcatattcaattaaagttaagtaaagacataattttaagaaggaaattgtgacttatttatgcaaaaaagaaagaaccaaactggttctttcttttttgcttttcagctacttaccacaatttgtaagaaattacaagtagtagtaagctaagggcaccttttcaagtgtgacaagaaggttcacacaacttatcaagatccgctcctgcgtttataatctccctgcgcaatagtggtaaaaccacatatcgactcatcgcataacagtagtttaacataatttagttaaaatgcaacctttactttttaaatataactagattcttcagtttacttttaatattaaattaaaaataaattatttctaaagcaggggagcaatagtttttgtcactatgccaattactttttggaattttggaatattatttatatctttcaagctaactaaccttgatttatttaatgtatccatataatctcgataaatgtcttggattgcatctaccttataaagataaacagcacattcaaaatggtgatacaggctacggtaatcaagatttatcgtacctacaacagcctttgtattatcactaaggaatatttttgaatgaacaaatccaagggtgtattcatatattttaacacctgattttgttaaagcttgatagtaagttttagcaagagcataagggattggcttatctgggatacccggcataataatacgtacatctacaccacgttccgcagcaaactgaatggcatgttccaattcactgtctaatattaaataaggtgtcatgatgtaaacatattctctagcatgattaagaatatctatataaacattttcccctactttatcagtgtctaaaggagaatctccataaggaataacatagccttcattttcaactaaatcatcgtgtacaccgaggtaaggcgctactaacattttttcctcagtaatggaccacatctgtaagaaaagtaggaggaaactatccactgctttcccctttaacataatacctgaatctttccaatgcccaaataactcaatgtgattaatatactcatcggctaagtttacaccaccagtcatgcctactactccatcaataacaacaatttttcgatggtcacgatagttataataagttgaaataaaaggagaaatcggagaaaatgcttttgcttttattcctattttctcaagtcgtttcgtataatcaaaggataattttgtaatttctatcataccatcatataagatacggacttcaacaccttcttccaccttttgttctaaaatactaagtatttctccccacattattccttcgtcaatgataaagaattctaaaaagatatactttttagcttttagtagttcttctttcattttttcaaagaatgcttctcccgttggtagaaatgtcacatcagtatttcgataaactgggaaatttccatgtgctttttcaaaatattgaaccaaatgatatgttgtggatgtacttgacttaagctgattcaaagtttcaggatcatcctctagataaatctgactctcatcaatcaatgtctccaatctttgtttcaaaccacgataaccccagtcaaatttggtgtacattaggaacatcgcccctagtaaaggggcaatcattaccaatattaaccaagttactcgggacaaagcatccatttcactattaactaaatataagaccgctccaattgttaagatatgctcaacggttgctaaccaaacacgatactgctctagccatgagtaagaggctagtaaaaacaataattgtaaaatcaataaaatagcgataacggttgttcgactaaatataccccttagtaaacttttcttactcttattaagtaaacgaacaattttgactttattactgataagtttttcccccctccaaatcaatcattttattatagcatactgtcacttgaatagcattctattattctaaattatctctagttaaaatctaatccccaataaaaagaggctagcatcacaagccctacctctttattatttaaaataatccaatggctgtaccgtcttctaaaacatccatattgagagctgcaggttttttaggtaaaccaggcattgtcaatacgtctccagtaagagcaactataaaaccagctcctgtttttggaacaaattcacgaacagttatatcaaagtcagttggagcaccaagtaaatttggattatcagaaaagctatattgtgtctttgccatacaaataggcatcttgtcccagccattgtcactaaactcttttaattgtatttgtgccttaggtccaaaatgaactttattaccaccatatattttagtaacaatttttttaattttttcttcaatagtgtcttcatcattatataagcgtttgtaattggatgattgtgtttcaatcacattagcaacagtctgtgcaagttcaagaccaccgtctgctccatcttcccacacacttgctaattcaactgccacatcaatattactacataaggttttaagagttgcaatttcactttctgtatctgcagtaaactgattgatagctacaactaccggaacaccatattgacgcatattgttaacgtgacgctcgagatttgtaaaacctcttttaactgcttcgacgttctcttgtgagagatcttcttttgaaacacctccatgcattttcaatgcacgcaatgtagcaacaataacaatcgcatcgggagaagtcggaaggtttggcgtttttatatcaagaaacttttcagcgcccaagtctgctccaaaacccgcttcagtaacaacgtaatctgctaagcgtagagctgttgaagtcgctaagacagaattacatccatgtgcaatattagcaaatggtcccccatggacaagagccggtgtcccataaatggtttgaaccaaattaggtttgatagtatcttttaggataagtgtgagagctccttcaatcttcaaatctttaacatagattggtttacggttccttgagtaagccacaacaatatttgacaggcgtttctttaaatctgataggtcagtagctaaacatagaatagccattatttcagaagcaacagtaatatcaaagccatcttcacgtggtatcccattgacagggcttcctaagccaacgatcacctgacgaagagcacgatcattaagatcaactacacgcttccaaatcactcgacgttggtcaatatctaattcattgccttgatgaatatgattatcaagtagagctgataaagcattattagcagttgtgattgcgtgcatatcaccagtaaaatgcaaattaatatcttccattggtagtacttgtgcgtatccacctccagcagctcctcctttaatacccattacaggacctaaagaaggttcgcgaagagcaatcatcgtttttttaccaattttatttaaagcatcagctaatccaatgctcatagtggattttccctcacctgctggtgtcggattaatagcagttactaaaattaactttcctactttttgagattttacagcttcaatcttatcaaaagataattttgctttgtatttaccatacaattctatatcatcaaaaccaattcctacttgctcaacaatctcagcaataggctttagggcgacgctttgcgctatttcaatatctgttttcatgatattctccttctaaataataaaaatagtatagcaatattccctataaaaacatatttttttgcaaaaaaaatttaaaatgttcgttttatgaaaataaaactgcttttatttcttctggactagtctgaccaaaataatcttctaatgataaagtacttaatttttccaagactaattcttctttcataggacaaccaatgagaaggttttcaatatctgaaatatctttagaactgaaaaagtcaccataaatacggcaattcgtaataatacctttctcaatttctaagtgaaaatcgtaagttcctgacggaaaacgagcatctctgtgatacgaatactgtggtgagttaccataattccaatcccaattcttatatttttcatcagctagagcgtcaatcgcagcccaatctttttcggttagatgatagcgttttgcctgatcaatatgatcaatatgtaataattgacaaaccattaaatctttaaattgatcggttgtgatatgacgataatcttctgacaagtggctacgaatatctcctactcgacttcggacagattttatccctttagattcaatttttttccgattaggatttaacactttttccatagcatcaaaatcaacatctaataaaagagagtaaccaccgtaaatacgaccgtttactatcgtcattgctgcacctgatacttttttaccatcaataactaagtcatttcgttccctcatttcaacactagaggcacctaaagtttttagggccttaatagctggctcataagctcgtttgaaatcaccaaattgtccatgatctttcatgagatagcaaatatttacagcacctgagtcaacgtaaacagcccctccaccagtatctcgacgaacaacaggaatatcatgttctttcaaatattcttgatttgtctctataactgcattctgaaattttccgatttcaactttgggatcacaatagtatggaaataaaatatcatcatctaaaaaaacattttgtaaaatataaacttgcatggcaagtgcaatcgcaccgtctgtgatacgcttaccatttctaattggttcaataagatacatttaggtctccttttatagcaatttagttatccaataatttcttttttcgcttcagcaattaattcagcgatatgctgtgtcagttgcacactccttgagcgaatcttttgaggaatgcgataatgcttgtgattaagagtaacaaataaagagttttcatttaaagagacgaatcgccaaaacggatgcttaataaattgtggcgtggtatgtccaactccaatctctagataaagaactttgtcattttgatgttgtgataagaaattttcataacgttgtcgttgagcatgaaagtcagcatcttccaccatacctttttcttcgttacgtttattaatttcaaacggttgatcacactttgggcatttggggattaagttactaggaatcttcatatccttttgttgtgcaatcatttgacgaattgcctgatcatttcgataagtttgttgatgacaatgttgactacactgccataagccatattcaccttgaatatgaaaaactttttctaaattataatcagccacagcgaaggcattatcagcattagttgtaataatatgatattcttttttcgctaaaatatcctttaaatcaagataagcttgtcctaccggttgatctaaataattaagtgccacaaaacgactttggaaggcccaatattcttcccaatcttcaaagtcataaagacttgcttgcaacatatctaatagttgatatttagcaataaaatccggaaaagcttcttcaaatctggggccaatataggtgaatccatccgctgcagacatgcctgcaccaataccaactacaatagcatctgattcttctattaactgacttagtatttctgattgagaatgattagttttttctagagtcttccacactgtcatctatttcctcttttaataataatttttgataaatatcttggtctttaggtgtgaatgtattgaaaataatatagagtttgtgctgattttcgcgttgccactctaatatcgcttgaactgccaattcagcggctctttgattaggaaaaccaaattctcccgttgatatacaagggaagacaattgttttaagattagctcgaactgccaattgtaagcaagatttataagaagactttaataaatcctctcttatacgagatggcttttgatcaacttttacataaggtccgactgtatgaataacatacttacaaggaagatgataggattcggtaagtttagcttgtcctacagcttccattcgtccttgttgtgtcatcaattgatgacatgctaaacgtaatcgtgaacctgcaaacgtatgaatctgattgtcaatacaatggtggttaggaataaaacaacctaacaatttactatttgctgcattaacaatagcatccacttgtaataagcaaatatccccatggtaggtaaatacatttgaatataccgtttgatgacagacgtctatcgtttttactttttgagtattccaccaatgtgacaaatacctatcttctaaagacaggtactcttgactaatgttttgaggatcttgttgattaactagaccacgccaaaccgtttgcaaatcggtggtcctcaagtcatcaacgtctgttaatttttctgactgaagatactcaatcatggctagcaatagttgtttttgattaggcattttctaaagcttcaaaagcagcataatcaacttctgttaacacaaccaaccaattttcgtcagctttttcagaatttaacaaagttggttcttgacttgcagctgtattaactttaacaactttacctgtaagaggagataaaattgccataaccgtctttgaagcttcaatatttaaaataacatcatcaacttctaaatttgcatcatctgtgaattccacatatccaacagttcccaagtcatcttgaagttcgggagttaagctgatagtataaagttcttcatttttttcaattaataagtagttcgcaatttttttcatgagtattttcctttctgagaaaacgtgattaatataactgtgataataattttaaggatttgattcgttggtcaagtcctggaacaagaggaatcaaaagtagttcttctgcttgactagcattaactaaagcgtcaagactttctttaacttgttttggatcacctacaatcatacggtcgcgatttgatttaatttttgctttttgttcaggagtcaattggtaatgattagcttcttcaatagtaggaaatgttgcaaattcattgaagtctttatttcctagcatccagatatctaaagtctttgctatgttttcagcttcttctgaagtatcagctataactacaaatgcagctaccatcaaattaggagacttattaggataatattcttcaaactgatgataataaagagatgaaagctttttagcttctgtcaatgggtctttgtccataaaaggaaaaacaccgaaggtaaagcctaagccaagtttagccgctaaataagctgatttttgaccactccccaacacatataagtctgggaagctagaaagagtcggttgaactaatggttccttactggatgattcatcaataagccatgacttcaattcctccagtacctcttcgtaatcatgtgctttatgtaagctacgaagtgcatttgaaactttaactgtccctagtgaatttcctaaaccaatacttactcgattcggatgacatgtctctaatgtcttgagagtctccgcgagtttaaaactactatagtgcagaggcattatacctccagagccaattttgatagatttagtctggttagccaaatgcattatcattaattctggattgctaatactgaatgccttaacaccgtgatgttcagccacccaaaattgatgatagcctagtcgctccgcctcttgtgataaaagaatcgtttcttgtattgcatcacttgcagtttttccataatcaataagcccataatcaaggacacttaatttcatctttcctccctataattgcttcgaagttctctaaaaacttctcgagcttcctttggtaaagattctccataatccatcaaaggaacaatatctttaaaggaggcttttggaatcgccaaaccttctaaatcactcactttaatccttaaattaatctgatcagaacacttagcttttattttttgtaaaaattccggatcaactactaagggcgtggaagctcctatcatatgagcatgttgtaaggcttcaaacacctttgaagcactattaatacctccagttgccataattggaactctatcaccaaaatgttcaaatataacttgattaaccagctgccctttgtaaactccctcagaacgtatagtatttctaaagacatcatgcccccagcttgcaatggcaagataatctacctgagcaatcgctaaaattttttcaagaaattccataaactcttcaatgctatatccaatttgtgaaccgcgagtttcttcaggcgtcgctctaaaaccaaggataaaatctgactccgcttcttctctgataactttttgtaccgctttaaaaacttctaagcctaaacgacagcgattagtcaaagtttgaggaccatattcatcttttctttgatttgagaaggttgagaaaaaagtttgaattagtaatcgttgtgcagaagatatttcaacaccatcaaatccagcttgtatagctcgtcttgtagcctggacatattcatcaataatccttagtatatctttgtgtgttagttctttaacctgatgtgggtatggcgattgcaattgcatagggctgggaccatatacatatccgtgtcttgccaaagtgtgacttgagaaacgtccagcatgcgtcagctgcaaaacagctttcgctcccttagacttcattgctttagccaatttagtcaaaccaggaatgtcctcatcctttgaaacgctaaaaccatattcaaataactgaccatattctgtgatatatgctgctccagtaatttgtaatggagcggatttagcacgacgaacagcatatgctatgtcgtcatcagttacaaaaccttctgatgtagaagaattagttaccataggtgatagaacaaaacgattttctaagctcaatccattgggaagtgttaatggacgaaataaattaccttggacattattcatctctgctcaccatccccttattagccatagacttagcctgaaatctattaaactctgcaactaaatcgggtctaatcatcagtaaacgatcattaaaacctacttgtttaaggctaatcaacatacgatcaataacatcttctactgtcataggacaatctaatagatcagatagattagccataatttcaggatctacatttggataagcaattggactacccgtatcacctagaccaatcttataaaaatctgaaatcatttgactccgccctttttgatcgccacaaacgctaaggtaaattgataccgcaataccattctttatacggcgctgagccaagccagcaaattttttgccatttatactaagatcaaacttaccaggacaataggaggtctctacttcaaagtgctcaataggttgataaaaatctgaaaatatacttctaataaaatcgaccattataagatacccatctgagatagacaattttctctcaaaaacatctggaataaccaatgaaaaatttaaaattccttcatcagctacaactgcgagaccaccaaaattccgaacaactggttcatagccacgactgatgatttcttttttagctaattctaaatgtggtaattctcgatctaacatccccagaatgactgtcttagtcatcggccaaatatgcaaaataatttcttgatttgagcgattaatctcccttaaaaatacttctgtccatataaaaggtttttccgcgtcttgagcatctgtaacatagtctttaaaaatagatacaggtaactgcgctagatcttgccattccaataaatctgacatcctttctctagaaaactctgcaagatttattttatcgcaatcgcttgaaattttccagtaagtttccctcaaattccattactatcaagaagaaatatatcttttatttacgaaaagcatttttttatgtacaatatggctatgaaaattttgattacatcaggtggaactaccgagaaaattgataccgttaggagtatcacgaatcacgcaacaggaactttaggaaaaataattgcagaaaaatatttacgagaaggacatcaggtgacactcgtgactactaaaaatgcagtcaaaccagaatctgctaccaacttatccacatttgagattgaggacgttgactcattaataaaaaccttgaagccattagtgaaagagcatgatattttaattcatagcatggcagtgtctgactatacccccgtctacatggctgatttcgaaaaggttaaatcaagcgatcatttagatacttttttgcgcaaagataaccacgaagggaaaatatcatctgaatcagaatatcaagtcctttttctcaaaaaaacaccaaaagttatcagccttgtgaaaaaatggaatcctcaaattactctagtaggttttaaactacttgtgaacgttactaaagaaaatctttttaaagttgctcgtcatagcttaatcaaaaataaagctacgtttattttagctaatgacctcattgatattacctcaaaacatcacatagcctacctacttgaccatgataatgtgtataaagctaccaccaaagaagatattgctcaattaatttacgaaaaggtaaaaaaatatgattaaacgtattacactagccgtcaccggttcaatttcggcctataaagcagcagaccttacaagtcaattaactaaaattggctatgatgttcatatcataatgacacaagctgccacagaatttattacaccgttaactctgcaagtattatcaaaaaatcctattcatttagatgttatggatgagcataacccaaaaatcatcaaccatatcgaattagcaaaacgcacagatttatttatcgttgcacctgcctctgctaatactattgctcatctagcatatggcttcgctgataacatcgtaacaagcgttgctcttgctatgcccgatgaaactccaaaacttatcgcaccagcaatgaatacaaagatgtatcataatacaatcacccaacgtaacattgatattttgaaaaaaataggttatcaggaaattgaacctcgtattagtttgcttgcctgtggtgataccggtcaaggagccctggctgatatctctactatacttaaatgtatacaagaagttgcaaattaggctgtaaatttgtatactatttctagtttaatttaaggagttataatgaaaaagaaaaacaaatcctctaacattgctataattgcaatcttttttgctattatgcttgtcattcattttttgtcatcatttatttttagtttttggttagtccctattaaacctactttgatgcatatcccagttattattgcatctatagcctatggacctcgtattggtgcaactctaggcgccttaatgggggggatcagcgtagctaacagcagcattgttctattaccaacgagttacctcttctcaccttttgttgaaaatggtaatttttattcgctaattattgcacttgtaccacgtattctaatcgggattattccttatttcgtttacaaattactacacaaccgctttggtttggctatctcaggtgctataggctctctaacaaacacagtatttgttttatctggaatttttatctttttttcaagtacttataatgggaatatcaagctaatgctcgctgggattatttcatctaattcattagctgagatggtcattgcagctatcattgtatatctaactgttcctcgtattctcaatattaaacattaaaaactggccaggaagaaatcttcctggcttttcttacttatattttatagtcatattgaaaaaaacatgttataatgaaagcgtttataaatattgaaggagtatttcaatgacttacacagaaaatcttcaaaaatggttagattttgagcagcttcctgactatcttcgtcaagaattactatcaatggatgaaaaaacaaaagaagatgctttttacacaaacttagaatttggtactgctggtatgcgtggttatattggtgctggtacaaatcgtattaatatttatgttgtccgtcaagcaaccgaaggattggcaaaattaatcgaaactaagggagaggaagctaaaaaacgtggtgtagccattgcctatgattcacgccacttctctccagaatttgcttttgagtctgcacaggtcttggcacagcatggaattaaatcttacgtatttgaagctcttcgtccaacaccagaactctcttttgctgttcgccatttaaatgcctatgctggtattatggttactgcaagccacaatccagcacctttcaatggttataaagtctatggacaagacggaggtcaactaccaccagctgatgctgatgcactaacagactttatccgtgctattgaaaatccatttgcagttgaacttgctgatttagatgaaagcaaatcatcgggccttattcaggttatcggtgaagatgttgatattgaatatcttagagaggttaaagatgttaatatcaatcaagatttaatcaataactttggaaaagacatgaaaattgtctatactcctctccacggaactggtgagatgttgacacgccgtgcccttgctcaagccggttttgaatctgttgttgtagtagaatcacaagctaaggcagatccagacttttctactgtcaaatctcctaaccctgaaagccaagctgcctttgctcttgctgaagaactcggacgagaagttgatgcagatgtcttagtagctactgatcctgatgcagaccgcctaggcgttgaaattcgccaaccagatggttcttataaaaacctttctggaaatcaaattggagcgattattgcgaaatacatcctggaagctcataaaacagcaggaacacttccagaaaatgctgctctcgctaaatcaatcgtatcaacagaattagtaacaaaaattgccgaaagttacggcgctacaatgtttaacgttttaactggatttaaattcatcgctgagaaaattcaagagtttgaagaaaaacataaccacacctatatgtttggttttgaagaaagcttcggatatcttattaaaccatttgtccgtgataaagacgctattcaagcagttcttttggttgctgagatcgcagcttattaccgttcgcgtggtttaacacttgcagatggtattgatgaaatttacaaagaatatggttattttgctgaaaaaacgatttcagtaacactttcaggtgtggatggagctgctgaaattaagaagattatggacaaattccgtgaaaatggtccaaaacaatttaacaatactgacattgtattattagaagatttccaaaaacaaaccgctactaaaaatgatggaacaatatctaacttaacaactcctccaagtaatgttttgaagtacacgttagctgatgattcatggattgcagttcgcccttcaggaactgaaccaaaaatcaagttctatattgccacggtcggtaatgatttagcagatgcagaaacaaaaatcgccaatattgaaaaagagattacaacatttgtaaattaataaaaaaagctaggaactgaactgcaccccaaaagttagacaaaaaatctaacgattggggtgcttttctgatgaaattaagttatgaagataaactagaaatatacgagttaagaaagatcgggatgtcctggtctcagattagtcaacgatatgatgttcgtatctcgaatcttaaatacatgataaaactcatggatcggtatggtgtagaaatcgtcgaaaaaggtagaaatgagtattatccacctgaattaaagcaggaaatgatagataaagtcttgattcatggttgttctcaactctctgtttctcttgattatgctctctctaattgttctatactcacaaattggctttcccaatttaagaaaaatggttatactattgttgagaaaacaagagggagaccgagtaaaatgggacgtaagcgtaagaaaacttgggaagaaatgacagagctcgagcgacttcaggaagaaaatgagcgcttgagaacggagaatgcctttctaaaaaagttgagggatttgcgcttgagggacgaagccttacagagcgaacggcagaaacaattagagaaatggtcacaggaggattccgactagacctcttacttgagataactaagatagctcgtgcaacttactattatcaactaaagaaactgaataaaccagataaagacaaagcaatcaaatctgacattcaatccatttatgatgaacatagaggaaactatggctatcgtcggatttatttagaactgcgaaatcgtggctttgtcatcaaccacaaaagggtgcaaggcttgatgaaaagtatgggcttgactgctcgtattcgtcgtaagcgcaagtatgcctcttacaaaggtgaggttggtaagaaggctgataacctgattcaacgccagtttgaggggtcgaagccctatgagaagtgctataccgatgtgacggagtttgctttacctgaagggaaactttatctatcgcctgttcttgatggctataacagtgagataattgattttaccctgtctcggtctcctgacttgaaacaggttcaaaccatgcttgagagggcttttcctgcggcttcatacagcgaaactattctccacagcgaccaaggctggcagtaccagcacaagtcctaccatcaatttctggaggacaaaggcattcgtccttctatgtcacggaaggggaacagtcctgacaacggtatgatggaatctttctttgggattctaaagtctgagatgttctatggcttggagaagtcttataaatcacttgatgaccttgagcaagctatcacagattacattttttactacaacaacaagcgaatcaaagcaaaactaaaaggacttagtcctgtgcaatacagaactaaatccttcacttaaaataaattgtccaacttttgggggtcagtacaaacttactcctagctttttttatatctatctaacgatattctattattttcaatcatgaaatataactgcaattaacttcacgatcaaataatagagcagacttacaattaaccacgttatcccaataactgcaactaaacctattaaaacagataataccgtattcttagttgctagttggttactgataaaccatgaaactgcagaaataaatatcagtaataatagttgaagcctttttttcatataattcctcttactacttttgtgcattttgcatttgataataaatacctttttgagccattaattcagagtggttacccacttctacaatttcaccagataccataactaaaataatatctgccgtttgaatggtagataagcgatgtgcaataataaagcttgttctccccttcatcaacatttggaatgcttcttgaacaagaacttcagtacgagtatctatagacgatgtcgcctcatctaatatcaatattctaggtaatttaagaaaaatacgagcaattgtcaatagctgacattgcccctgtgataacgaatctccagcatcttctaaatacgtatcatatccattcggtaattgtttgataaagaaatctgcattagctgcttttgcagcctctatcacttcttcacggctagctttaggattggcatatgcaatgttatcgtgaatcgtagcactttttaaccacgtttcttgtaataccattccaatttcttgccttaattgtgatggctcataatcagtaataggcttacaatctaaaaggatatttcccccgtcaacttcatagaaacgcattattaaattgattaaagtagacttcccagcacctgttggtcctacaatagcgaccttagctcctgctggaatgtgtaaattaataccattcaatagtagttttgatttattataaccaaaaacaacgtttttaaaatcgatttgacctttgaccgttgatgaatcaagtttttctgtacctgttatatttggtgacgattcttctaaaatagagtaaaggcgttctgcacacgccagagcactttgcatctcagacaggacggaagagatgtcattaaatggcttagtatattgattgacataatttaagaaagtgattaattgaccaacactaaaagcccctgacataatgcgaagggcaccaatcccagctaagaagccataaatcaaactattgataaatcgggttgatggattgacagttgaagaataaaaaattgctgattgagaaaagttagcatactcttgattaatagtcctaaaatgatcactactttcttcttgcgcactgaatgcttgaataaggctttcttgactcaccatctcttcaatgaattgagtttgtcgtcctcgtgatgccgtttgattttgatataagtgataactctttttagcaataaagcgggctagaaagagtgataaaggcgtcagaaataataccaaaaaaagcattaataaatcaatctttgccatactaaaaatagtaactataatagttaataaaccaacaaagaactggttaaaaaccattaataaaccatttgataattgctccgtatcggtagtcacacgactaatcaagtcacctatgccacgtttatcaaggtaagctataggcaatagattcaacttttccattacagcctttcttaaagaagcaacataatgaaaaattaagcggttatagagcagaggattaatccattgaataatagtatttgctaaaatgactgcaatcatcttccacattataggtaacaataatatcatagaatgaggcgataatacaacgtctaccgcttgtccaattagaacaggcaaataaacagtgaggcaaacttgtacaaccgtccctaataatgccattcctactaagctttttttagaaagaagatcttgaacaagctttttttgtatctttttaggatgacttgctttcatttactcctcctccttaaaattttgtgaatggtaaatggacttataaactttgttatgagctaataaagattgatgattatcaaaaccaacttgtttgcccttatcaaggagtaagattctatctgcattttgtatactattaattctctgtgatacaataataagattagtttggttgaaatgtttagttatagctttaaataaacgagcttctgttaaataatccaatgcagatgttgcatcgtctaaaatcaaaaatggtatcttatcttgaactaaagctcttgcaatcgtcaacctttgcctttgaccaccagagaaattcctaccaaaactctctacaggggcgtcaagttgaccatctttttcttttacaaaatcactagcttgtgctatttctaaagcagtccaaagtttttcctcactaactttaccaagtcccaaagaaaggttagaacgaatagttcctttaaacaactgagcattttgaggaacaactcttaccagggtacgccaatttgaaattgtatctggactttttccctgatgatatatatcaatatccccttcttgcactttataaatatgaagcaataaattaatcaaggttgatttcccagagccagtcccaccaattatccctaaagtttctcctacattcatagaaaaagtaatatcagataaagctttttcagaggagtttggataagaaaatgccatttcttgcacttctaaagccttattcgaatattttggctcaagtttgtcatcaattatttcagacggtctttcaaaaacggctataattcgcttagcactgatataactttggttcagtgatgtcaccaacattgtcatttttaacaattcaacaagaatttgcaataagtaattaattaaagcaaccaacattccttgtgataaaagatgattagctatatttaaattaccacgccaaataatcacaaccaaagtgatattaacaactagaaatgttagaggcgttactaaactagaaagcctacctgcttttaattgtaaattcgtataatgataattgatatcattaaatgcttcactctctctatctacttgattaaaggcacggataactcgtacaccttgaagttgttgcctagtcaactttaccaaataatcggttgaagttctgattttaaggtaaataggatttaatagtcgagacattacaaaaacaatgataaataacgtgacaaccattaccaagaaccaaatagtcaatgaggggctaatggaaaaagccataattatggcaccaaaaacaataatcggagccctcaaaaataaacgtaaaaattgatttaaaccagtttggatttgaaatgtatcagcagtcaaacgagtaatcaaactagcagttcccaattcatctctgtcttttttacccagtgacatgactttttggtagagatcctctgtcaattgtctcgtataaccaactgcggcttttgaagaataatattgagcagttatcgctactacaacacccaccgcagccaaaaagaaaatcaatccaatttgcaacagtaaaccacttctatcccctcgtggaatggtctcgtcaatcatttttgcaataacgattggtaccaaaagttcaaaagaggcttctaataatttgaaaaggggtccaaagatagtttctttgatataccccttaaaataataagttagtcttttcatacttacccttcttaaaacaactccattatttttatcaaataaaggttgaattgaacttcacgtgagtagtaaatattaccaccatttttatagagcttccctcctgaaattaaggcgagaggatgatagtaaaagtaagtgtccccgttataatttcctaggctgggagctacaacatttttagagtaatttttggccaactcaatggaattttcacccccatgatccgctacataatcaatataagaagaaccaaaattgtatgcttggacagcagtccatacatcaaccttagcttttttagcttgacttatattttgtgacaacagagtgacgccatgtttaatactggtgtggctatccgtaatactgttcgtagttccactgatactttcacttgattgcatcacatctatagcatctcccttagtttcagtataaatcatagataatactaagtgcacattagcctctgaaccattctctgcaagagtattctgcactaaatcatgatattgaagcacttttttaacattttcatggatgataactagacggtacccaatgaaaataataataattaatgctatcaaacgttttaaaaatttaaacatattatttattttgaatatcctgtatgtttttgattagtattgagtatgtaccatcagggttttggataaattcaactgattcggcatcttggtagacattgttgggtacaatcaattcaataccatttgaaagagatagcttctgattctctaacttcttaatttgacgggaatgatcaatatcacttacttgaacaggtccaggtattgcgtctttcaattcatcaacaaaagtcagcctggctgttaaattatcatcaaataattgatctgctaatttttctggagacaattcttgctcttcttctaaattcttataaatagccgatttcatttttgattggaaagaaaaatcatctttgttgaaattttcagcaattttttgagctgtctgttcaaccatttttatagattttttaacagactgttctggttgtacttgtaataaattttcagaaaaataattagcaaatgaaccattgtgtttgatacgcttttcaattaaatagtattgctttgatgacttgttaacaaccaaagcttcatctggagtttgagcagcacttggaaggttattctgtgttattgtaattggctgctcttgattttcagaaacatgagcaaattgttcctttaatgagattcgaaggaaagcaaaatgttccattccatccttgtcaaattgaataaaaactaagtcattcgttttttgatcttccgatatgacaaactcttctttccaaagttgcgcaatttgacaggaagaaacatataaatcatcttgtaaatgactcataaatacattatcctctccaaaatagccacgcttagcttcatcagaaaaaactttacttaattttttacgaaagtagtcatcaatccttggagttagggttagcggagtatctgatagcactaactctgtgtcgttaggagaaaactgatgtataataatctgtttgatataaaaatccatcataacattaattctcatacaaagggaaagcgtccgttaatgatttaatttcttgacgaacttctgtgaggacatcttgattttcatgatttttgagtgccttaatcattaattcagcgattcttcgagattcttcaactcccattcctcgactagtaattgctggagtaccaattcgaatacctgatgttttaaatggtgatagtcgctcaaacggtatagagttcttgttaagggtgatattgacttcttcaagaacattttgtgcctttttgccattctcaataacttttgtgacgtctactaagaacaaatgattatcagtaccatcagaaatcaaatgaaagtcatcatcttctttaaaaactttagccatggcttgagcatttttaataatatcctcaccgtatattttaaaggaaggatctagggcttctttcaaagctacagcttttgcagcaattacatgttctaatggtccaccttggagtcctggaaagactgcagaattaatttttttagcaattgcttcatcattggttaaaatcaaaccacctctaggtccacgtagagtcttatgtgttgtcgttgtcgttacatgagcataaggaataggactagggtgatgaccagaagcaactaaacctgcaatgtgagccatatcaaccattaagtaagcatctactgcgtctgctatttgacgaaatttttcaaaatcaataatgcgagaataagccgacgcccctgcaacaattaatttaggctgcgtttcctgtgctattttcaaaatgttatcatagtctagcatctccgtcttaggatcaacagagtaagaaacaaaatgataagtttttcctgagaagctaactgaagcgccatgtgttaagtgcccacctgctgctaagtccatccctaagacagtatctcccggctcgattaaagccatgtaagctgctgcattagcctgactaccagaatgtggttgaacattagcaaactcagcattaaataacgtcttagctcgttctatagctaaactttcaactacatcaacacaatctgttcctccataataacgatgactaggatacccttcggcatatttatttgtcaaaacagaaccttgtgctgccataacagcttttgaaacaacgttttctgatgcaattaattcaatattattttgttggcgaatttcctcatcatgaatagcctgccaaagttcttggtcaaattctttaaaattgtctttatcaaaaatcattttttactccttaagctcgttataacttttaaataatggtttcaatcattatatttatcacatttttactattagttgcaagatgattaaattaattttcaaaaattaattcaggtatcgtagccgttagtacctcttgcgtgattgcaccttgccttaaaatcttaactctatcaccagacaaatcaataatagtagaatccacacctgtcaatgctttatcatcttcaatacctaaaacttgatgattaaactgtttttgaatttctgagaacacacgaccactatcacatccagaaatattagcagaaggaccaatcagtggaccatggttagcaatcatatcaagggttacagggtgtttaggcatccgaaatcctacgcttaataacccagaattgatccaatgcggaacttcttgtgaagcttccaaaataatggttagcggtcctggtaaaaaagcatcgtacaattgctttaaataggtcggttgatttttagaatattttaaaatagtctcaaaatcacatatatttaagttcatagccttatcacgaggcctttttttaagctcatagacgtggttcacagcttcttcactcaaagctttggcaaaaattccgtagactgtttctgttggcataataactgcgccatgatcctctaaaatctgtcccaaatcattcattatctaataccaccattctatctttaccaaatatatctttcaaaactctgcaacgattgtttggaaaatatcttttcaataaacttcgtaaatcatcaccttgtttgtaacctatttcaaaatataatttacctctaggttgcaaatattctcttgagttttcaatgattttacgataaatagctaatccttcttcgtctgcaaaaagggcactatgaggctctgaagctagcacattcttccccacctcgtctttgtcattgtaagaaatatagggaggattagacacaataatatcaaatttacctgaaatgttactaaagacatctgattctataaaagtcacttccgcatcacaattattagcattttcctttgccaagtctaatgcagatacagaaatgtcactagctagaacatcccaagaggggcgttctttttttagagaaatggcaattgctccactacctgtaccaatatctaaaacagaacaatcttctactttattctctgataagattagatcaaccaactcctctgtttcaggcctcggaattaaaactcgttcatcaacaaagaaaataaggtctctaaagtaagctttacctgtaatatactgcggtgatctatgttttttaagctgttgaaaaatattttccattaattgctgatcagtatcactcacactactattttgatttaaaaggtaatcagttgttgaccattgttttaggtcttttaatacataaataaaattttcgacttcttcaccacaagcttctaataactgtccgtaatgcttgattaactgcgcataattcattatttatttaaggcttctaacttttgagtctgatcatacataacgagtgcatcaataacttcatccatttttccagataaaatagtatctaatttttgaagtgtcaaaccaatacgatgatctgttacacgattttgtgggaaattataagtacgaatacgttctgaacgatcaccagtaccaactgttgatttacgttcagcatcttgttcatcttgagcaatttgcgcaaaatggtcagcaacacgagcacgaatgatcttcatcgctttatcacggtttttttgctgagtacgttcttcttgcatttcaactttgattcctgtaggaatgtgtaccatacgaactgcagtagcaactttattgacgttctgaccaccagcaccagacgcgtggtaaatatcgacgcgaaggtctttttgatcaatttcgtattctacttcttcaacttctggcattaccaaaacagttgcagttgaagtatgaacacgaccctgactctctgtcaccgggacacgttgaacacgatgagctcctgattcatatttaagcttagaataaactgactgaccagaaaccatagcaaccacttctttaataccaccaacaccattaacggatgattccataacttcaaaacgccatccttgagtttcagcatatttttgatacattgttaaaagatcaccagcaaaaagcgctgcttcatcgccaccagcagcaccacgaatttctaaaataatgtttttatcatcgttaggatctttaggtaatagaaggatttttaatctttcttcatactcttctttagctgcttttgattctttaagttcttctttagccatttcttccaattcagcatcaccagaagcatctttgatcatttcttcagcatctgaaatattttgaatgacttgcttatattctctataagctgtgacagtttctcgagtactagcttcttcacgtgataattccataaatcgctttgtatctgaaacaacatctggatcactaagtaactcacctaactcttcataacgatcttcaactgcctgcaattgatcataaatattcatttttctttgtatctcctttaaaaccgattaccttttaaatatctggattaaaataatgttttcgacaaactgggatatatgtttcattaccaccaatttgtatctgatcaccttcatagacaggttttccgttttctgtccttaaaaccatggttgctttcttactacagtattggcaaattgttttgatttcatcaatcttatcggccaataatagcaaatgttttgaaccttcaaaaagattgttttggaaatcatttttcaaaccaaaagccatgactggtacatctaagtcatctactactctagctaaatcgtagacgtttttcttactcaaaaattgacattcatcaattaaaacacaataaggcttttgtggtaaattctgaatataggagaaaatgtccatatcatctgaaattggaactgcttcacgacgcattccaatacgacttgaaacgactccaaattcatctcgagtgtccaaggcgcttgtcataataaccacaggttttccttgttcttcatagttatgagcaacttttaaaatttcaatggttttaccagaattcattgtcccatatttataatagagttgagccaaagcggaaaatcctactttctatagtattctacctattttaccacaaaggctgaagttttcccagccattgaaaacagtgtgtactttttcacaacattatgttacaatgatgcccaataacataaaggagtaacattatgccatttgtaaaaattgacttgtttgagggacgctcacaagaacaaaaaaatgaattagctcgcgaggttactgaagtagtatcacgcattgcaaaagcacctaaagaaaatatccatgtttttatcaacgatatgcctgaaggaacctactatcctcaaggtgaacttaagaaaaaataagaaatagtaaaagaggttacccaggtaacctcttttgatagtctttgtaagcatatttcttgacaaattgaaaatatttgaaaataagtgttgattttcaagttagaaaacggtatcattagaatatattgctttggaggtggaaaatttgcaactttctcatagtttaagactcatgggaacgactatcgatattcaaattaattctaaaaatgctcaaaaacaaatccgagaggtcatagaactcttggagctctacaaaaatcgctttagtgcaaatgactttaattcagagttaatggctataaataacaacgctggtatcaagcctattcaagtacatccagacctctttgaattaatcacaattgggaaagaacacagcttagctaggcctagtaacctaaatattgctattggtcctttagtgcaaacttggagaattggattttcagatgctaaactacctagccctagtgaaatatcagaagctatgattttatctgacccaactcatatacttctagattcaaataaacaatctgtttttttaaatcagataggaatgaaaattgatttgggtgcacttgcaaaaggatatatcgctgacaaaattatgacctatctcaaaaatgagatgattgattctgctattattaatttaggcggaaacgttttagttcacggagataatcctaatcgttcagaagggtattgggttatcggcattcaacatccgaaaaagaaacggggaaaaaatattggaactgtcaaaattaaaaaccaatctgttgtaacctcaggtacttatgaacgccgtctgattattgacgataaggaataccatcatatttttgatcgacagactggttatccgatacaaacagagatggctagcatttctattgtttctaaacaatccgtcgactgtgaaatctggaccacaaggttgttcggcttatccattaaagaggctcttgatattttaaacgctgtttcctacattgaaggcattatcatcactaaagatgatcgtatctatttatctgatggcttaaaacatcattttcaactattttatcattaagaaagaggatttctaatatgaaacttattggaatcgttggaactaactcaaataaatcaacaaatcgtcaattattacaatacatgcaacaacactttgctgacaaagcagaaattgaactcatcgaagttaaagaccttccgttatttaataaacctgctgataaaaatgttccccaagtaattttggatattgctgctaaaattgaagaaactgatggtgttattattggtacgccagaatatgatcattctataccttcggccttaatgagtgttttagcttggctatcatatggtatttacccacttctcaacaaacccgttatgattactggtgcttcatatggaacacttggatcatcacgtgcacaattacaattacgtcaaatacttaacgctcctgaactaaaagcaagtgttttacctgacgaattcttgttatcacactctctccaagcctttgataaagatggcaacctacacgatatcgaaacaagtcagaagctagatgctatctttgatgattttcgtctttttgttaagattactggtaaattatcaaatgctcgtgatttacttcaaaaagaagcagaaaattttgactgggaaagtttataagagtatagaagggaataactaagatgaaatttgtaggtattgttggctcaaatgcagagcaatcatataatcgtatgttgcttgaatttattcgcaagaattttaaaaccaaatttgaattggaagtccttgaaatcgatgatattccaatgtttaatcaagaccaaaattgggaagaaagtttccaacttcgtcttcttaataataagattacacgagctgatggcgttattattgctactcctgaacataatcatactattacagccgctcttaaaagtgtgcttgagtggctctcatttgctgtgcatccactcgaaaataaacctgttatgattgtcggtgcttcatattatgatcaaggcacatcacgtgctcaaatacaccttcgtaaaatccttgatgctcctggcgttaatgcttacacacttccaggaaatgaattcttattaggaaaagctaaagaagcctttgacgataatggaaacattatcaatcctgggactgttcaatttttagaaacttgtcttgataattttatcaaatatgtaggagttgtatcatcattgagaaaacctaaagctattgaatctgaagacctctactgtcagggacaaattgatacaaccattactggtatcgacccagatgatcctgattggttagacaaggcagctgagaaagttaacgccgttgaaggggatgcttacgttaaactagacaatggtttacttactgttaaccaacttaatatgtttttaaatgctatgccatttgagctaacatatgcagatgataataatcaatttctatattacaataataatcatccagatccagatacaatgttaggaaaacgtgttcgtgaacaagtaggaaaccgtatggctacagttcatggtagtttaccaccggcacgaatgaaaaatgttgaatgggttatcggtactcttcgtaatggaaatcaagaatatgtacgtacagtcgttcctggtacacctccagaagttatcaatactcacaactatcaagctatgtactacccagacggatcttatgctggtattaatgaaattatctttaactttaaaccgtggttagattggtacctccaaactactggacaacgtttggtcggtggaactactgctgctcctggagcttcagcagttgacgctacttctagcgcttcaactagcacaggggatgctcccgtggatcaagccacagatgccacttctggtgcctctgaacattaatctcctcgcttttgaggatctgataccttaaaaagatatcaagatcctcctttttaatatttaatcaagttaataaaatcacataaaaggaatatactatgtcactttttcaagaaaaaattgcttacaattgcgctaaaaaggaagcgctttataaagagagtttaggacgctacgccttgaggtcaatgctagctggggcttatttaacaatgagtactgctgctggtatcgtcgcagctgatactattggtaaaatctctcctgctctatcaggttttgtatttgctttcatctttagttttggacttatttatgttttaatatttaatggtgaattggcgacatctaatatgctttatctcactgcaggagcctataataaaaatatctcttggaaaaaagccatgacaattttaatttattgtacttttttcaacctcgttggtgcttgtatattagcttggttgtttaatcaatcgtactcattccagcatttaacaaatgatagctttttagggcatgtcgttgctaaaaagttaggaaaacctagttcaggagctttcctagaaggtattattgctaatatgtttgtgaatttagctatccttgcttacatgttattaaaagaagaatcggcaaaaatgacggttattttatctgctatttttatgtttgtttttctatcaaacgaacacttaattgctaattttgcatcctttatgttagctgcttttagccatatcgaacatattaaaggttttactcttctaaacattatccgccaatggacacttgtattctttggtaactggataggagggggcgttttcatcggcctagcctatgcttggttaaataaaacaaaaacttctcaccatgaataaaagaaaaactgagtaataaattactcagtttttcttttatattctcatcatgaaatcaataactaaaaattaacttttttgataaataaaggaaagtatcatattaattttttaggcaatccattcaaaatgatatttaaaacaacagctgtcagggttgagataacaataccatttgtcaaaaacatttgtaaagtattaggaagactaatgaagagatttgtcccattaaaacctactcctgctgcaattgatacggctgcaatgataaagttatgctcattatgctcaaaatcaacctgattaagcattttcatcccttgaagtgctaccataccaaataaaactaacatggcaccaccaagaactggacttggaatcatttgagccattgcgccaaatttaggtaacaagccaagtataactaagaagagagctgtaaaatatatcggcttacgcgtacgtatcccagatatctgtaccagtcccacattttgagaaaaaccggtatatggaaaggtattaaataagccgccaagtaatactgccaatccttctgaacggtaaccattacgaagtctcttactgtctaatttatcgtttgtaatatctgaaagcgcaaggtaaacacctgttgattctaccatagaaactgttgcaataatacacatcattaaaatagaagtaaattcaaatctaggagctccaaaataaaatggcttcggaatatgtacaagtggtgcatctgctaccacagaagcatcaactaagcccataaatgctgcaagaattgtacctgaaatgagcccaataaggattgaaattgacttcaaaaagccttttgcgaaaatattaattaataaaacaacaccaatcgttaccagtgataaagttaaagattgtaagcttggctcttttgcattatcacccatatttcccatcgcaactggtattaatgtcaaaccaattgtagtaataactgatcctgttacaattggaggaaagaaatttgcaactttagaaaaaatgccagcaactaaaacgacatatattcctgaagcaattaaagctccaaacatatagccagaaccttgttgtgcaccaataattgataaaggagctacagactgaaaggcacaccctaatacaactggaagacccactccaaagtgcttacttaatcgtaattgtaataaggtggcaatcccacacataaaaatatctgtcgcaataagataagttagttgcttagcattataaccaagagcactagcaatcatgataggtacaagaatggatcctgcatacatagctaacaggtgttgcaagcctagaagtgctgcttgcgaattactttgcacattaaatttcattaagcatcagcctccgcaaaaacaactcgaccattttcaaacgctttaatacgggcaagagaagtaactggaacacctgttttttctaacaaatcacgcccatcttggaaagatttttcaataacgattccgataccagcaaccttagctccagcttgaccaataatttcaagtaatcctttagccgcttgaccgtttgctaaaaagtcatcaatgatgagtacagtatcatcgttagataaaaagcgactcacaatagaaacttgactcgtaacttgctttgtaaaagaatacacttcagcagttaagataccttcagtcatagtaatgttcttagcttttttagcaaatatcattggtacgcccaatgcttgagctgcgtacactgctggcgcaattccagatgcttcaattgtaacaaccttcgtaatgccggcttctttatatttatcagcaaaaactttacctatttcctgcattaactcaaaatctacctgatgagtcaaaaaagaatcaacttttaaaatgttctcacctaaaacatcaccatctttaagaatacgttcttccaataacttcataataaccccttcactctttagaaaataaaaaaataacttacctcaatcagaggacacaaatctcctctaatttatcgcttcattaacatgaaccaacaaggcaagctatttattagcttacttattgttagacattacggtgtcttgtagagacgctaagccaatcctcagcataaataagtaaatcatatatttaattgttatgtatgatagataactattgtaacatttttaattaagatttcaagatttaatttaaatggaatcaccattccaaatagaatttttaacaataacgtaatcaacgtgtctcaagctatccaattcttttcctcctgcgtaagaaatagaactttgcaaatcttgttgcatttctgtcaaagtatcctctagtcgccctttaacaggtaatagaattttcttaccttcaacatttttatgttctcccttttgatattcagaagctgagccatagtattctttaaattgctgtccttctacttccacaagttttccaggactttcaaggtgaccagcaaacagcgaaccaatcattaccatactagcaccaaagcggatagattttgcaatatccccatgtgttcgaataccaccatcagcaataattggcttgcgagcagctttagaacaccaacgtaaggcagctaattgccaacctccagtaccaaaacctgtcttgactttagtaatacaaactttaccaggtccaataccaactttagttgcatctgcacctgcattttccaattctctaacagcttcaggcgttcctacatttccagcaataacgaaagtttctggaagctcttgtttaatgtgttggatcatctctataacactgttagaatggccatgtgcaatatcaatagtgataaactcaggagcatcttctttcagacttgtcacgaagtcatattcatagtctttgaccccaaccgaaatcgatgcaattaaacctttatcatgcatacgcttgataaaaggttttctttcttcttcattaaaacggtgcataatataaaaataaccttcacacgctaatgtttcagctacctcttcatcaataatagtctgcatattagcagggattactggaagtttaaaggtatagtttccaagtttgacacttgtgtcagcttgtgagcggctagatataatacacttgtttggtattaattgaatatcttcataatcaaaaacaggaatatcgttaaacataatggttctcctaatgagtaaaatgaccttcctataactttgtataacaaagcatcgctaggtaaaaacatacctttcctttttaaattatagactttatttatttttagtcaatttttgatcaatttatttgaataatgttcgttttttttaaaataaatgtaaaatcctatagagcagtactctataggattttacatttattatattgcttttctttttcgaagataagttaatcctacaatagctaagataacaacaacgataacgaatagaactgcaaattgactaccaattatagctccatttttcggaatagctacttgtccgatggtaaaaatttgtgaggctactgcggttgcaaaagctcccgcaaattgttgtagtgtattcaagatactattaccatccgctgactgtgctggctttagttttgttaaagctgtcgtaaccatattacttgctccaatccccataccaattttagtaaggatatcaaaggctaaaagtactacaacagacttcgcaggaatgaatatagctgtaccaattaaacctatcaaagaaagggagatgcctatcataattggcttaaatgcaccaattttatccaggagataacctgcaaaaggggataaaaaaactactgctattgcacctggaaacataaacaaaccagctttggttgaagtttgatgtaaaacaagttgcaagaggttaggtaataagaacgaaagtgctagaggaatcatttgaaaagccaggacgccatacaataagattgagaaatctttatctttaaaaacattcaaattcaaaaattctagctgtttatttaaatagtaaaaaataacaaaactaacaatagctactaataagtaaaaaatagacatcttttcaatagctaaaagaagggttgccaagccaatacctaaactgataaaggcaggaaaattgagtttatcattaattcttacttgacgtttgggaatagaagccaaacctataaaggtggatatgataagtattggtgccagaagcataaaaatcatcttccatcctaacattcctgaaataacaccgccataagtaggtccaactgccggtgctaaaagtgtgaccatagcagctactcccatcattagtcctctacgctccatcgggatttgtgtaagaatgatatgaaacaataaagggagggctaatcctgtcccaacaccttgcaaaactctccctactaacaatatagctaaattaggggcaaagctatcaattaaaacaccagataaaaaaagcacatttgccaatgtaaaaatttgtctctctgataaatttttaatcataaatgctgacaaaggcacagtcacagcaacagctaacaaatttcctgttgtcacccattgaataacagcggggttaaccccaaattctttcatcaaaagcggaaaagtgacattcatagatgtttcaataagaatccctgaaaaacctaatatagccgttgtaattatggcaggcataatacgccatccctttttagtcattaaaatctccttgctttgattattatcataaaatagagcaccccgctaaatcaaggtgctccatttaattcattcgaattaaaattaaattgtttatattagttgtcaaaggacaatcaacagctcttattatatcaaataaagctaagaaaaacaaagagttttttgaatattaatgtcttcactttcttatctattctctactcatcaatcaccacttcagagaacataacaattgcaatttactcttaataccgttatcatgttcatatgctaatacccaagaaaatagtggcttttgcctcaaatgaatctgaaaataatttctttattacgttaaagacttactttaattatttattttctatacaaatcattacagatatttcaactctcaatcatgcagattttgacggtagctttgcattccatgatatagaaactagcatacctcatctggtaattgactccaactacttagcgattagtcagactaactcaaaaatagaggctaacgatattaaaacgttctcggaactctccaaaacaatgaccgagtttcactatatgctaaattttgacttatttaaccatctcccatatcgttttagattgcataataaggacggtcaaacaatttattcgaaccataaacctgaagatccttttgatatttatcctgaagaagaatatcctatagacaaatgggttcaaaacagcctaatagagaaaaaagcgaaagagctacatttactcttacctagcgcatcacaagattatattctagtacaatcttataaacgcttagaaaatgatagtgggcaactagttggttatattgaacatgttcataatattaaaccactgctagagggttatttaaaagaatccggtcaagctatcgttggatggtctgatgtcacgtctggtgcttctatctctaacgatgattttgaactataatccactcgtcactctaaaaagaaaactaataactaaaaggcactggtttaatttcagcgccttttattaatcaatctccagttgttgtaagttcacttttttctttaattggtagacctcgattagctgtaaaaatcaaaggaactacttctgttgtaacttcggaaaattgtagaccaaaccatcgtattggtgttgctgtccaatgctttatagatgatttcattagcataacaaatcgttcaccaggttttaggttttgactacttgagaaacgttcatcaaggacaataaacctaaaatctcctacgttactatcaggtctaacgctgtatgtctttccttgtttaggcagacgtccactttcaagtaattcttctacaatcgtacgaagatagcgtgacacagtctgacgcatcttaaatccaaggtaaagttctaccttcacaatgaagtctgttcccatcatgtcaactttatactcagctgtataaggttcatcagtgaccttaatgtttacaaaccaataaacttgtgcttttttagggcgcttatcaaggatagaatacatgatagacttatcaatcatgtcttcttccatacgatttgtcaaataaacaacgttagtatgataaatcggataacgatgatcatgtctaagtttatctaattgtccgatgtaatcttttaaatccaacaacttaacataacgcgaaacaattttactacctttataccagatagtcatgatgaatataattgctactgctataataacaacaacatagcctccatgcataaatttaacagctgaagcaaggaagaagattccctctaaaataccaaagaaaatcatcatcaataagactaaacctctttttactcctttttgaattaaaaagaaagacagtaaaatagttgtcattagcatcgtaattgttatcgctaatccatatgctgcttccatgtgcgctgaagtcttaaaaagcaaaacaatagaggttgtaatggcaaataagaaccaattaataacaggtatgtaggtttgaccaatattgtcaccaggataagttgaacgaaattgcgggaatatttttagtcgcatagcttcagaaactaaggtaaatgatccagaaatcagtgcctgtgaagcgatgatagctgccaaagtagctaaaataacgacatgcattgtaaattgcgaagggatactagcaaaaaagggattcaattcatttcctgcgttcttattagctaaaatccatgccccttgcccacaataagaaagtataatggcaaccttaacgaacggccatgaaacatgtatatttccacgcccaacatgacctaagtcagagtatagtgcttctgcccccgttgtcgccaggaaaatagatcctaaaataaaaatacctttatgattctctggactaaataacaatttcaaaccgtagtatggattaattgctttgaaaacttctggatgggcaaaactattaaggagaccgctaatacctaaaaaggcaaaccatataaacataattggcccaaataatttcccaatcacacccgttccaaacctttggatggcaaaaagtaacagtaaaataaacaaggtcgcaaaaataacgttactctgattctggaaaatatgctgcaaactaggaactacttttaatccctcaacggctgaagttacggttacagctggcgtcaaagctccatctgacaacaaggttgcacctccaataacagctggcacaattaaccaaggtgtcatttttcgaacaagggtatataaagaaaaaataccaccttcgtggtgattatccgcctttaaagctacaagcacatacttgatagttgtaataagtgtcagagtccatatgattaaagatatagaacctaagataaacgattctgtaacactagaaataccaccttggttttcaaccaatgattgcattgtatagagtgggcttgtaccaatatctccataaacaatgcctaaagcaataataaatcctgcttttgatgctttatcaaaagaagaatgattgacatgttgcatttctgccaaccctccgattaaataatattagtcaaaaaaatggctgaactcattatagcagattaagttaaaaaaacaacacttatctataaaaagaccagaaattattaaagcgtttcctggtctttactattttaatcacgataaacaggttgaggtccataagtttgactgactggcattatttctatgcgattaatattaatgtgttctggttggctagcaacccatgacacggtattagcaatatcctctgcttgaattgcatgcgcaccttcataaagtttttcaactcttttatgatcccctttgaaacgtacagttgaaaattctgtcccttcacataaaccgggttctaggttagtcactctgattttagttccagctaaatcggcacgcaagttgagagaaaattgttttacaaaagcttttgatgcgccatagacattagctcctggataaggaattgttcctgcagttgatcccaaattgataattaaccctctattaacttctaccattttaggtaaaatgcatcgtgtcaagtaaattaatcctacaacgttagtattaatcatagtcatccaatctccaaaatcagcttcatatgatttatccaatccaagtgctaaacctgcattattaaccaacaaatcaattgattgcaattttttaggcagactttctaaagctttgtcaaccgattctctacttgtaatatccagttgaagtggataaaagtgaccctctgaaaacttttctccaaggcattttaatttatccattcgacgagcacaaccaataacgctataaccatctgaaactaatttagtaacaatagctgcaccaaaaccagcagatgccccccgtcacaagcgcaactttacgtgatatcatagacactcctcctctagtatatagaaaaacgagctaggaaaaatccttctcgttttataaattattttgatttctcatcaatagcttgagcagctgtaatgatagcaagtttataaatatcttcagcacttgatccacgtgataaatcatttactggagcattcaatccttgtaaaatcggtccgattgcttcaaacatacccaaacgttgtgcaattttatagccaatatttcctgattgaaggtctgggaaaataaaaacatttgcttttccagcaacatcactattaggagctttaatttctgcagtttccggaacaaaagctgcatcaaattgtaattctccatcaacagctaattcgggagataaatctttggcaattttagctgcttcttgaactttttcagcttgaggcgcttttgcacttccttttgttgaaaaactaagcatagcaatcttgggatcaatatcaaatattttagctgtatccgcagtatttactgcaatttctgctagctcttgtgcattaggatcaatgttaatagcacagtcagcaaaaatataacgttcctgtgtattttcacggttcatcaagaatacacctgaagtgcgtgaaattcctggttttgttttaataatttgaagagcaggacgtacagtatcagctgttgaatgaatggcccctgataccataccatctgccaaaccaagttttactaacataaccccaaaatagttaacatccttcaaaagacgatctgcatcttccatagtagctttgcctttacgaatctcaacaaaagcttctttcatctcttcaaatttttcgtattgttcagggtcaataatgctataatcttgatcaacaaaaccaagtcttgccaaagaatcgtgaacttcgtcagccttacctaaaataacaggatcaacaagaccttcaaatttcaaacgagctgctgcacgtaatacacgttcatcgcttccctcagggaaaacaatcttaacataatcacttgcaactttttctcttaaaccaccaaataaggaacgcatatatataaaaccttctatttctaaattaatgtaattccatgataacgctgtcaaagtcatctgtcaagtctagcgtctgtttatttatttttcccataaaagggtcgtaaaaagacaaagaatgacaatgcaatgcttgcctgtttattcctagatccatacgtcctccgtacaaatcatctcccaaaagaggaaagccgatatgagcaaagtgaactctaatttgatgagtacgccctgtatgtaatttgatatccactaatctaacatcaccataacgagcaactacttgataactagtatgtgcatatttgcctgattcatggacgcgcctcgtaataatactatcaacatctcgtgcaataggagctataatatcaccactatctgctaaatcaccactccctgatactaatgcataataccttttttcaattgctttagcctgaagttgtttatctagacgagcatgggcataaccatgcttggcgaataacattaatccacttgtatctcgatccaaccgggtcacaatatggacctgctgattggcatagttattagacacataatagtgttttataaaattagcaattgtatttgaatgaatagagctaggaatactagcgaaaccaaaaggtttatttaaaatcaaaaaatgatcatcctcataaataatatctaaatcgtgaggcactggttccaaagtttcgtgagaaggctcgtcaggaatatctattgtaacaacatcgccaatctctaataagaaaatagcgttctgctcttcaccattaacaaaaatcttaccacctctgtacttaatctttgctaataacccccttgaaacatcatgacttttcaaaagtgttttaactttgcacctttcttttgctacgtattcaaatttcaatgttcaggttctccgataaaagcatcgttaacacgttcccaaaaactagtgtgacttggagttgaaacaaagttaatacttttttcgtcaatactatattctattttggtaacattcttgtaatggactgttttgttatctatagaaattgtatagacaccaactcgtttaggaactatctctatagcatcttttttggggatgataaccgatgaccccaaggtacgatagacgcgattattaagactagaaatttctgttagttgcaaggcttctatcgttgggtggagtactgccccccctagtgatttattgtaagcagtactaccggttggtgtagaaactaaaatgccatctcccctaaacctttcaaataccacttgattaataacaacatccgctaccattgttttttcaatacgcttaatagtagactcatttaaagcacgcgcacgaataactcgaccatcttcaagggtaatagttactttcaaaatgggataggagatttgttcacctttatcatttttcaaattattaattaatgtgtcaacttcaaaatctcgatagtctgtataaaaccctaaatgtcctgtatgaacaccgacaaaccttactttatccagttgtttttcgtacatgtggaaggctgacaaaagcataccatctccaccaatagaaatgacaatatcaggatccttttttgataaataaaaatcaggatcatgtttaaaagcagcaaagagctttgaggctacacgcttgctttgatatttcccgttagcaattatagcaacacgtgttgctctatctgtaaaattcatctgtgtcatcactatttcctacaccatcgctcaattttcgatttaaaggatcaaataaaagctgtgcttcacgaatatcttcgcgaatcttacgcatttcttcatccaattctaaagcgatttttgctgttttctccagtctttgtttaatttcttcagggaagtccccctgatacttgtaatttaatgaatgttcgatggttgcccaaaaattcatagccagagttctgatttgtatttctgctaaaactttcttttgtccatctattgtgtctacaggatactctacaacgacatgatatgaacgatatccactagatttcatatgggtaatataatctcgctcctgaaccactgtcatgtcatgacgttttctcaataaagcaaggacttcatcaacgtcatctacaaattgtaccatgatacgaagccctgcaatatcttgcaagtcctgagcaagattttcttctgaaataccacgtaaaaccatcttttcttgaatactttcaaccgactttacgcgtccagtaacaaattctattggagagtgacgattttgctttctaaattgtttacgaataccacgaagctttatttttaattcaccaaccgtttgaatataagggtctagaaatgtttcccaatccattgacattctaatcctccaaaatatttaatgtactctcttgtaaaataaactttttttctataaaattaacacaacaattaatattataccatatttaggaaaaggaagtgataagatgacacacctagaaattgaatacaaaactctattgaataaagacgaatttaatcgtctaacaagcttattttctcatgttcaacctattactcaaaccaattactattttgacacagaaacatttgaaatgaaagcacaccgaatgtcacttcgtattagaacgttacctaaccgtgccgaactaacactaaaaatccctagagaagtgggaaatttagaacacaatcatgaccttactttagaagaagctaaatatatcgttaaaaatggccaattccctgaagatactgagattgcttctttaatccttgaaaagggagttgatccaaccaaattagctgtctttggacaacttacaacaacaagacgagagatggaaacttcaatcggcttaatggctctagacagcaatatatatgctgatattaaagattatgaacttgagttagaagtcaaacaacctaaacaagggaaaagagatttcgaccagtttttaaaagaaaataatattaattttaaatacgccaaaagtaaggtggctagattctctgctactttaaaaaataactaacgttgagagattggattttccaatctcttttataattctcatttaagcaagaacttaaaatctcatactatctatcctcaacattgttattgcaagcattttcatgtttcttatcgtgaattttttctatttttttggtaaactattagtatcaatctaaaggagtcatctatctcatggcagaacaatacgccgataaacaaatcaaacttttctcattaaccgctaatagagaaattgctgaaaaaatttcccaagcttcaggaattcctttgggtaagatgtcatcacgtcaattctctgatggcgaaattatgattaatattgaggaaacggtgcgcggtgacgatatctatatcatccaatctacaagcttcccagtcaatgataatctctgggaattactcattatgattgacgcttgcaaacgtgcaagtgctaatactgttaacatcgtagtcccttattttggatactctcgtcaggaccgcatcgctgcatctcgtgaacctattactgcaaaattggtcgctaatatgttagttaaagctggagttgatcgagttcttaccctcgacttacatgcagtgcaagtacaagggttcttcgatatcccagttgacaatctttttactgtcccactatttgctgaacactataatcaactcggtctctctggtgaagatgtcgtcgttgttagtcctaaaaattctggaatcaagcgtgctcgtagtttggcagaataccttgactctccaattgctatcattgattatgcacaagatgattctgaacgtgaagaaggctatattattggtgaggtagaaggtaagaaagctattattattgatgatattttaaatacaggaaaaacctttgccgaagctgcaaaaattttagaacgtggtggagcaactgagatttatgctgttgctagtcatgggctttttgctggcggcgcagctgatattttagagtctgcaccaattagagaaattatcgtaacagactctgttttatctaaagagcgtattcctagcaatattaaatatctgacagctagccatctcattgcagatgctattatccgtatccatgaaagaaaacctctaagtccattattttcatatcgttcagataagaaggattaattgatgatttatttagacaatgctgctactaccgctctaaccccatctgttattgagaaaatgaccaatgtcatgacaagtaactatggtaatccatctagtatacatacctttgggcgtcaagcaaatcaacttttacgtgaatgtcgacaaattattgctgaatatctaaatgttaattcacgtgaaattattttcacttctgggggaactgagagcaacaatacagctatcaaagggtatgctcttgcaaatcagctaaaaggtaaacatattattacctctgaaattgaacatcattcagtcctacatactatgacttacttatcagagcgatttggttttgatattacttacttaaaaccaaatcatggacaaataactgcaaaagacgtgcaagaagctttacgagatgatactattatggtatctctcatgtttgttaataatgaaaccggggactttttaccaattcaagagattggtcagcttctcaggaaccaccaagctgtttttcacgttgatgccgttcaagtctttagcaaaatggaacttgatcctcattctttaggaattgactttttagctgcttctgcccataaatttcacggtccaaaaggtgttgggatactttactgtgctccccatcactttgatagtctacttcatggtggagaccaagaggaaaaaagacgtgcttcaactgaaaatataattggtattgctggaatgtctcaagctcttactgatgctacgactaacacccttaaaaattggactcacattagtcagctgagaacgacctttttagatgctatttcagaccttgacttctatcttaataacggtcaagactgcttacctcatgtacttaatataggttttcctggacagaataatggcttgttattgacacaattagatttagctggattcgcagtttcaacaggttctgcatgtactgcaggaacagtcgaacctagccatgtcttaacaagcttgtacggagccaactcaccacgtctaaatgaatcaatacgtattagtttttcagaactaaatacccaagaagaaattcttgaattagctaaaaccttaagaaaaattataggagattaatatggcatttgaaaaagaaataaatcttccagactgcaattacatttacactatcagcccgaacattaaaaaatataccttacgcgatactacattcactcaaaatcgcttaggtaattatgaattagagcgtctcctagaaacagtgcctaattctggcgatggctttcctctaaagattacaatcaataaagaactttctggttttaagctcttaattactgataaatctggccttagaatagtaaatatctttaaatctaccgatcataaaattcttcaagacaaattttatttcttaatggacagcctcgttgagcgtgatatctttacgaaaaccacaaaataatttatcgaccactatttttaacattttagtggtctttttgcgaaccattttgttgtcactttcacaatctttttgtacaatagagatgtgaagaattaagttatataactgattctaaatcgaataataaaatttttaacaaggagataattttgtgattatggataagtctattcctaaagcaactgctaaacgtttatcactgtactaccgtatttttaaacgttttaatactgatggcatcgaaaaagctagttccaaacaaattgcagatgccctaggtatcgattctgctactgttcgacgtgatttttcttattttggtgaactaggacgccgtggttttggttatgatgtcaaaaaacttatgaacttctttgcagaaatattgaacgatcattctacaacaaatgttatgttggtggggtgtggaaatatcggtagagctctcttgcattatcgtttccacgatcgcaataaaatgcaaatttcaatggcttttgatttagatagcaatgatttagttggtaaaacaaccgaagatggcattcctgtctacggtatttcgactatcaatgaccatttaatagatagtgatattgaaactgctatcctaacagtacctagtacagaagcccaagaagttgctgacatcttagtcaaagcaggtataaaaggcatcttgagtttttctccagttcatttaacattaccaaaagatatcattgttcagtatgtagatttaacaagcgaattacaaactttactttatttcatgaaccagcagcaataaatagttcattatttataaaatatctgcttcttctcgaaaactataatatttattttttccaacgatgatgtgatctaggcagacaattcccagatgatcacatgatcgttttatttttttagtgaaacttaaatcactttcactgggctttggagaacctgagggatgattatgtatgataatcaaagaagttgccatgtttttacaagcataatgtagaatttctcttggctctgctactgaacgacgtacagtaccaataaaaatagttctctgttcgataatacgattttgtgtatccatataaatagctactaaatgttcttgttttttatcccctaattcgagcatcattttcctcgctaattgttcactacttaaaatttgctctttacgatcatattcagctttgtgaatccgttttgctagttctagcatagcttttatttcgacggatttaacctgaccgattcctttaatggattgcaactcctgtaaggataattgaccaaaatctgctaaactgcttatgttttctaaaatttgcgttgaaatttccagaacaggtttttctttaatacctgtacgtaagagaatggctaataactcctgattactcaatctatctgcgcctaaatcaactaggcgttctcttggtaataaagcttccttttttaattcaatatggtacataaaacacctccagtcataatattcgtaaaccaatcaaaaactcatgttttaaatcaataaaaaatacttagatgaaaaatctaagtattttttatttaacgataggttcgtgcacaatttctaagcgtttgtcgcttgataatatgatcttttacaatctgatagatagtagctgcaacaggaacagcaagtaacatgcctaaaatcccccataaagcacctccgatagtaatagccattaaaacccacatagaaggcagtccaatcgatccaccgacaactttcggataaatgacatttccctcaaattgttgtaaaaggatcaagaaaagaacaaacaagaatgcttcagtaagcgattcagtagcaattaagatgaaaccgattgtaacaccaatgtaggctcccacaaccggtattagagctgtaaaagcaactaaaaccccaactgttaaagcataaggaaattggaagatcaacataccaataaccgtcaaacttcctaaaatcatagcttctaaagtttggcttacaaaaaaaccatggaaacgttgatgaaggatatgacgaacgtaatggaatgttttgcctgttgaacctaaataggtatcaattaacaaattaaactgacgtcccaactgctccttgtttgccaaaacgtaaattgaaaaaataaaactaacaaaaacattcaggagtgttgccgcaatagaggaaactgaggttagtaaatttgttaaaacagataaaacttgcttcaaaatctgctggctataaccacttaaagtagaaactaagtctttatctgttcccatataatttaaaacctcagaaatttgtttattctcattgagattattaaccaatttagcaagtgctccggtatcaataaccaataaagaactcaaactagaaatcaaatctggaatgacaattgaaaatagccagacaattaaaccaataaaagttgcataggataaaatcatagaaacactacgcttgattgccattaatagtctagatcctttaaaaagctttatatataatcgctcatagactgacattacaatattaataatataggcaattccagctcccatcaaaaaaggaaatattgccttatgaagcgtagttaaaatattagaaacagctccccaataagcctgtatagcatagcaaatagcaaatgttatgacaacataatagacctgccgtttttcaaatttcatgaaatctccttattaatcttaatttctttcaattattatacactattttatgaatgagaaaaagagagttaacagttattagtctgttctttattctatttgactgccattacttgcaataaccttcttgtaccaataaaacgattttttcttgtaacgcttgagtgtcccctctcctttattattgcgatcaacataaatgaaaccatagcgtttttccatttcaccagttcctgcagatactaaatcaatacatccccatgtagtatagccaattagattaacaccatctacatatatagcatctctcattgcagcaatgtgctgacggaggtaatcaatacgataatcatcttctacgtaaccattctcatcaggaatatctactgctccaagtccattttcaacaataaacatcggtttttgataacgatcccagatagcatttaaggtaatacgtaatccaagcggatcaatttgccatccccattcagaagatttcaagtaaggattcttaagagatgcgaaaatattttcttgaacctgttcactgacagttggattacctgaagctactcggcttgaatagtaagaaaatgaaataaaatcaaccgtatagtctcttaacaaagcaagatcttctgctgtcatttgaattgaaatacctaaatgctcaaaatgttttttagcataattagggtatttgccacgagcttgcacatcaataaaaaaataattttctctatttttttgcatcgaagcccaataatcttgtggatgacacgtatttggatagtattgacctgcagctagcatacatccgatttgattatttggatcaacttcatgagcaatttttactgcaatagccgaagccactaactcatggtgagctgcttgatatttaatttgctcttgattttcaccatcttcaaaatataagccagcgcccataaaaggagcgtgtaaaatcatattgatttcgttaaaggtcaaccaatatttaactaaccccttaaaacgagtaaataaagctcgtacaaggcgctcataaaaaccaatcattttacggctccgccacccaccgtaatgtttaataaggtagataggacagtcaaaatgtgtaatggttaccaaaggttcaataccatacttacgacactctttaaaaatattttcataaaactgaagaccagcttcatttggatatagctcatcaccctttggaaaaatacgcgtccatgctattgacatacgataggttttgaaacccatttctgcaagtaatgcaaggtcctctttataatggtgataaaaatctattgattcttttgctggataaaagtatccttcctcaaaatcaaacattttcttttgtcctgaaataattgcaaatcgatcttctccagtaggaacaacatctacatttgctaggccacgtccatcaacattgtaagctccttcgcattgattggcagcagttgccccgccccataaaaaaccttttggaaatacttgttttaccatcatttacccctcttgttttttcttatcataatattaaaaaagaccagttactgacattgattcgccaaatactggtactatccatgacatgaactttctacttagaaggtcttttcactaattctgtgtatttaaatacttaaaaatagtatcaaaacacttttaaaggtagagttttatcgtttcagaaattttagcataggcttgatctgttaggtgcaaaccatcttttgtaaaactgctagcaagctgacctttttcgtcaactaataaatcatacaattcaatataattaatgccagaaattactgataaggttttgtttaaagcttttattgtttgattatttcttaccttgacacgctctatatagtcatcttcttcactaacaggtaaaacactcagtatattaatctctgtcatataagattccgcacgaatttctgcaattatatccgtgatattagctatgatttctgactgtgaatgccctaaaccaatatcatttgttccaattaaaataaatactttggatggtaatagttcccatacttgggttctcaagttttctaaaagccaataagtatctgatcctgctactcctctattaactaaaggatagtcacgtcctaaatgtttttttaaaggaaaaaactcaacgatagaatctcctgtgaaaacaatggcaccttcttgtactgtctgattgttaatctcaaaaaactgttctcgtttcatttgataatctcttaaagctttgtcaataacttctaacatcgttctccttcattattaaatatttctctaggctttcttgtattataacaaaatttcacctgagaattgaatagtatgcttcgttaaaagctacgtggtcctattcattatcactcatcttgtgaagaaagttctctatcgtttctaacacaccatcttgatcgttactaactgtttgatatttagcaatagctttaatttcttctggcgcatttgacatagcgtaagaaatatttgctgctctcaacatttccacatcattgcccccatcaccaaaaaccatcacttgatcctgtttcaatccccacttttcaaggagaatagcgataccatccgctttattgacatcagctggtaagacatcgatacaaccaaaaccactagaggtcaatctgatatgatgatttttaaagtgttcactaatatctaacaacatctcagaaacaagattttcatttacccaaagtgtcatttgaaaatagcggtcatcatctaagggcagcaaatggtctttatagataaaattaggcatatagtattctaattcagtccgcctattaataggagttcttcgctcaaggtatgaacgtttttcaccagataagctgatgagtgtctcaggatagttctgatataaataggataaaacagctgcaactgtatcattagataaataagtttcttttagtaatgtgccatcttggtcaatgacacgaccaccattttcagcgacgtaggcgatacgattagggtattccaaaaagtttaacaacaattgatcgtataaattaccactagcagctacaaatttaatatcatacttctccatcaacgttaataaagaagaaaaccgtgctttatcataagttttatctgagcgtagaaaagttccatccatatctgttgctattagtttaatcatacaagtaacctttgcctttcaagagggtgccaaatatctcaatatgttctttcattatatcacatataaaccaaaaagatttgatacctgatacgtcaacggttctattaattaagttaaattttgtttcagagattaaatcgacttttacctatacttatctccatactatcagagcttgtttaacataatgatttactgaagagttttcttattgttgagttgaataatagattcgtaactattacaatagtcataataaaatatttgagattcgaaattgctatacgtgtttttgagagacctaacattattttttttcacatagttattctgttttgaaaaaataaataattgagtatattaataaatttggtcatattaatacaacaaaaaatccttacatgagataaggagattaaacgaccctgtaaggattttgaagttattagaaacactctaagcaaaaattttaaagcgttttctctatgacttatattatatgtcatgttcctatacaaaacttacactatcctttcaaaaaataatactatcctacgaaacccattttttgatagttttctgttataataatactatcctacgattttagaaagaaaaacgatgaactcacttgataatttactatcacataatttagaagataaccggcatttattaccctatgaacacatgcatactgaggttagaaatggttaccctgacattttatttcactggcatccggaacttgaaatttcatatgtccacgaggggaccgcacgttatcacatcgattatgatttttttaatagccaatctggtgatattatcttgatccgtccaaatggtatgcattctattcatccgattgaaaataaagagcatatcacagatagcattaaatttcacttagatttaataggatattctattgtagaccaagttagccttcgttatttacaaccgttgcagactagctcttttaagtttatccaatgtatcaaacctagtatgacaggatataatgatatcaaaaattgtttgtttgatatttttaatatttcaaaagaagaaaatcgacattttgagctactcctaaaagctaaattaaacgaactcttgtatttactctattatcatcaatatgtcattaaaaaacatactgatgatacctacagaaaaaacgagagaattcgtgatctgattgattatattaataataattaccagcaaaatcttaccattgaatttttagctgattatatggggtatagtaagacacattttatgaccgtatttaaacagcatactggaacatcctgtacagaatttatcatacaagttcgtcttaataaagctagtgaacatcttattaactccactacggccattattgatattgccaacagcgttggttttaataatctatcaaattttaatcgccaatttaaacgctattatcatacaactcctcgccagtaccgcaaacaatttaccaacaaaaaagacggtagtacgcttgtctatagaaatataaatacaaaaaaatagaaactagttaaatccatgactagtttctattttttattatttaagcgttaattagtttacatcagctgttcacgtacttctttaatttccgattcattcacaactaaaaaaatggtgtcgccagcattcaagatagtatttcctgatactacagccgatgtcttatgatgaatttgagtcgttattaacacattttctggtaattctaaatctcggacatactttcctgatattttatctgaaacagttaattcaatcaatgtaggtgtcattactttatcttttggattgaaggtcattttagccaacatcgcttcataaataggttctccctttaataaatccatgacaatataagataccatcgttacaattccaatagccattaattgttttaaatcgccaaccatttctgtaaccaaaatcatagctgttagtggtgcttttgagattgcaccaaaatagcccgccattcctagaacaacaaataaagatatctgctgatgagatattataccaaagtactgcatacctactgcaaaaaaagcacctgctaaagatcctaaagctagaattggtaaaaaaattcctcctggcaagccactactgtaactcaacatactccataaaaaacgaatgaggaaaaataatcctaacatcatcagactaagattactcctaggcagtgatacaattaagccatttccaccccccaataattgtgggaaatagtaaccaataggaagaataaaaattaccgctaatataccatataggtgagatggtagatgaaatagtttgcccaaataatcatagatcacatgaaatcttaaaattacccactcatagataaaacctaagatacccaaaaagagacccatgagtaaaaaaatccaataaaagttgagatttaaagatggtaattctgatggtaaagctaaaactggggttaaaccaaagatattaagtgagacaaagtttgccactaaacttgctaccaaagctgttatccaaactaagcgagaaaaatgatggtaaatttcttcaactacaaataaaaggcctgcaataggagcgttgaaagctgctgaaagacctgctgccgcaccactagcaattaaaacacgtttttccattcgactagcattgagatactgtgcaattcccttgcctgtcatagctcctaactgaatactgggaccttcgcgaccaagcataagtcccgaagaaatagctaaaatacccgcaatgaatttcttccatacaatactaaaccagtctggcgatagcattcctttaagttcaccttcaacatgcgggatacctgaacctttaatatcaggatcagatttgataaaaaaacctattatcactgcagcgataatactagtaaccgtaatgctcaataaaataattggttgataatgggcacttttataaagttccataacaactaaaaaaattttttcaatcgctaatcgaaatatgctgacaacaaatcctgctattaagcctactactattcctctccaaacaaatcccagaattgattcaagtgaaaactgaaattcatttttatgattttccatattttcctccttttcttacaattattttagcaaaaatatcacaaactttctaggaactcttggtaactaaaaatacctctcatcagagaagtacttttagttaatagattacttacgatacattttaaattgtaagtacaaatcattgtaaataccaagccatttttgacccaagttattataaacttctaaatgatcaattgttttatcaggaggataaaatgctttatcatttttgatatctgctggtaacagcgcttttgctttgagattaggggtcgcataaccaatatattctgcattttgtgccgcatttttaggttccatcatgaaattaataaaggcataggcttctttgcgatgctttactgttttggggattacaatattatcaaaccaaaggttcgatccttcactaggaacaacgtaatgcaaatgcttgttcccatcaagcatttctcgtgcttctccagagaatgtaacaccaatcgctgcatctccctgaatcatatagcctttcatctcatcagcaacaatagccttaacgtttggtgttagagcatctaactttttagaagcggcttttaattctgatatgttctttgtattcaatccatatcccaaggaatttaaaccaactccaataacctcacgtgcactatcaactagcatgattttatttcgaaactctggacgccataaatcatcccaatgtttaggaggagttttaactaattgatcattataaacaatcccaacagttccccagaaataaggaatcgaatatttatttttaggatcgaaactcaaatttttaaacctggctccaatagcatcccaattagctatctttgaatgatcaagtttaaccagaaggttttcttttatcattttgtcaatcatataatcactaggtacagcaatatcatatgtcgtcccaccctgcttaattttggtgtgcatagcctcattagagtcaaacgtttcgtattgtacttcaattccagtttcttttgtaaatttttttaataaggctggatcaatatagtctccccagttataaataactaacttatctgagttaggtgttgaactactctttttttctaagtaagtggttaaaccaaagaggatcaggataacaagaacaataccgcctaaaaaggaataaactctacgcattcttttctcccttctctttcgaaatatagtaataaccaattaccaataaaatactaaataaaaagacaatagttgacaaggcgttaatttccaatgatataccgcgacgtgcgcgtgaatagatttctactgaaagcgttgaaaagccattacctgtaacaaagaaagtaaccgcaaaatcatctagcgagtaagtgaaagccataaagaaacctgaaataatacccgacgacaaatagggtaacataacttctttaagcatttgccaagttgaagctcctaaatcataggaagcattaatcatatcatcattcatttcttttaaacgaggtaagaccattaaaacaacaataggaatagagaatgcaacatggctcaataatacagaagtgaaacctaactgtaaaccaataacagtaaatactaagagaaaacttgcaccaatcataacatctggtgctactaaaaggatattattaagcgataaaatagaggtttgatgtctacgtcttacctgataaatccaaatagctccaaaggtaccaataattgtagctaataaggcgctaagaaaagccaaaaagaatgtttgcactaaaattagcattaagcggctatcctgaaacagttctccatagtgactaaaggtgaatccagtaaaagaattcatatccccacctttattgaaagaataaaaaatcaaataaataataggaatataaaggataataaaaacaagtgctaaatagatatttgcgaattttttcatgctttcctctcctttgttaaccacataatagcaaccatcactaaaattaaaataacccctatggttgagcccatacctttattttgtgtgattaaaaaatgttgttctatggctgtccctaaagtgataactcgattaccaccaataagacgcgtaagcataaagagactcaaactagggataaagacagactgtacacctgctcttacaccattcagagataaaggaaatataaccttctgaaaagtttgccatgcatttgcacccaagtcatcacttgcataaatgagattttgatcaatatcatccaaggcattaaaaatgggtaataacataaacggtaattcaatgtaagctgctacaaaaagaaatgaaaagtctgtaaatagaatctgttttgggccgatacctataaaggttaagaaggcgttaattcccccttgttgaccaaatatccccataaaagcataggcttttaacaaaagattaatccatgttggcaaaataactagcattagccataattgcttgtgttttaattttgtaagcaaataagcagctggatagctaatcaaaagcgttatgaaactaacgatgcctgcatataggaccgagttaaagctcattttaagataggttcctgagctaaaaaacgtctggtaattagctaaagtaaagtgcccattaatatcaaagaacgagttccaagcaatcaaagcaacaggtgctaatacaaataagaataaccaagccatataaggaattgaaaatagactagaggttttcttcatttctctcctcctcgatagcattgattaaaccatcctcatgatcgtcagtgtctacatattcttcaatgcgcgcatcaaattcttcttctgtttcattaagacgcataatatgtatatcttctggagtgaaatctaaaccaataacttcaccctcaatagctttacgagttgaatgaatcatccattcattacctaaatcatcataagcaataatttcatagtggacacctcgaaaaagttgtgtgtccactttaacttgaagttttccttcatcgggtagggtaatttgaagatcttctggacgaataactacttggactgattcattagggcgcataccgccatcaacagcctcaaagcgcttaccgttaaattcaaccaaataatcctcaatcatcttgccagataagatatttgattcacctataaaagttgctacaaaatgattgataggttcatcgtagatatctactggtgttcctgattgaacaatttcaccttcattcatgacgaaaatccaatcactcattgccaacgcttcttcttgatcatgtgtgacaaaaacaaaggtaattcctaaacgttgttgcagttcgcgcaattcatattgcatctctgtacgcaatttcaaatccaatgctgataagggttcatctagtaagactactttaggttgattgatgatagcacgcgctatcgcaacacgctggcgttgtcctcctgataatttttgaatggctcgtttttcaaacccttctaaacgaaccatttttagagtttcttgaacacgtttttgaatttctttcttatccatttttttcaactttaatggaaaagcaacgttttcaaaaaccgtcatatgtggaaacaaagcatagttttggaaaacggtatgaacatcccgtttattagtgggaacatcattgatgcgtttcccatctaagtaaatatcgcctgtactcgcctctagcaaacctgcaataatatttaagatagttgatttaccacttcctgaggcccctaataaggtgtaaaatttaccttcttcaagttcaaaattaatatcttttaagacaacggtgttgctgtcttcaaatacctttgatacatttttaaatgcaatgattgggttagtcaattctcataaatcctccatttttctgactaaagtaagcactaaactactttataatagcgactcaccgataatacgaacttctggttccaaatggacacctgaagttgattcaacggtgttaataacatgttcaataagattttcataatcttgagctgaaccttctgcaatgttaaccataaaaccagcatgtttttgactaacctctactccaccaatacgttgacctttaagatgtgcttcgctaatgagttgccctgcaaaatgtcctggaggacgtttgaacacagaaccacaagaagggtattctaaaggttgtttcagctcacggagataggttaaacgatccatttcctgagtaatcatgagatgatctcctggttttaaggcaaacttagctgatataacaatatctccactctcttgaatgacagaatgacgataaccaaattgcatattcctagcttcaatcgttttgagttcaccctgtggtgtcaaaacctgtgcagacaataaaatatgagcaatttcaccaccgtaagcgccagcattcataaagaccgctccacctacacttccaggaattccgcaagcaaactcaaagccagttaagctatgataacgtgcaatacgagttgtttcaatgagattagctcctgcttctgcttcaataacataaccgttgactgtcacagttgacagtttatcaaacatgataacaaaaccacggataccaccatctctaacgataatattactcgcatttcctaaaaccatccaaggaatattttgactgttagcaaacttaacaatacgcgatagttcaaggcgattccttgggaatgcaagataatcagcaggtcctcctactttagtataagtatatttctttaaaggctcatcaaagcgaatatcgagaccttctaattctttttgtattgttttaatcataacctttatctcaattctgttttattgtgttttatagacacaaaaaatcggcataaaaccgatttctattataccaaaaatataggttgttgacgatacattatcacaatttctgtgtattttaattttaaaatcctaactgactattcgactggttttaaataatgaacttctcctaaattcaatttttcgagatagtcttctagcttagaaccattaggtaaacttagttgaggtgctatttcgagtaacggaactagaacaaatgctcgcttcgtcatatacggatggggtactactaaatcttcttggttaatcacttgattaccaaaaagtaagatatcaatatctattgtccttggaccccagtgctcatgtctcacgcgctttaagcatttttcaatttcttgacaataatccaataattcaaaaggtgctaagtctgtctctacctgacaacatatattaaaaaaatcttcttggttagtattcccccaagcagctgtttcataaatagcggaaatttgcgcgacttttgtcttttgcaaatgatcaattgaaaagagagcctgcttcagaaaagtttctctatcaccaatattactacctaaactcaagtaaacggttgtcatgctcgcctgcgctccaattcaattccaactgattcatagtgcccattaattggtggattgtcttttgtaatctttaatgtaatagcttgtactggatgaaactgtaagaaaatatcttcaacaataacacctgctaatttctctattaattgatactgttcgttttcaacatgatttttaatacagtcaaaaacttcaccataatgaaccgtatcaattaaatcatcagtttgtgatgcttttgccaaatcaagtgatagaacagcatcaacttgaaaaacttgccccaatgtttgttcttccgaaaaagcaccatgataaccataaaaccgacatttatttaaataaatcttatccatattacaccaactgactaattactgtcacaatgtccttatttacttcaacattgtgaacacgtacaatctgacacccctttgctattgcccatgccgataaagcagccgtccccatatcacgttcagttacttccctattaccacctagaagataattaacagtacgttttcgagagatcccaaataacacaggataacctaaatcacacacttgttccaaaccttttaatagttctaaattttgctcctctgttttagcaaaaccaaagccaggatctatccaaatattatcctttgaaacacctgcttctaaagcacgctctgctctttcaagtaagaattcacaaacttcttttttgatatcttgataaacagcttcttcctggttatgcatcaaaataattggaacatttcgttctgctgctaaagatagcattttaccatcatataaacctgaccaaacgtcatttaaaatatgtacacctgcatcaagggctgcttgagctacctctgttttataagtatctattgataacaaaagatcagggtagacctctctaatagctttaatcattggaactacacgtttaatttcttcttcagcagtcacaaatactgcacctggccgcgttgattctcccccaatatctacaattgccaccccttgttcaagcatctcaccaacttgatttaaagctgaatcaattgtggtataagaaccaccatctgagaaggaatcaggcgttacatttaaaatccccatgatacaagctttacctgtaatatcatattgtcctattttcatcttttatcctttttgtattagcgatagaatttcttgtctttcatatcgatcgtccttgtataaaccacgagctaccgttgtaatcgtcttacttcctggttttttaatgccacgcattgtcatgcacatatgctctgcttctatcataacaaaaatacctttaggcgccaaagcatcctctaaagcttgtgcaacttgtgctgttaaacgttcctgaagttgaggacgcttactcgccacttcaactgcacgtgcaagcttactaagtccagtaacacgtccatcgtttggtaaataagcaatatgagctttaccataaaaaggaaccaaatgatgttcacacatggaatagaatggaatatccttgacaatcacaacctcttcatgattttcagaaaagactgcagtgaattgctcctttggatcttgattaagtcctgagaacatttctatatacatttttgccacacgcttcggtgtatctttcaatccttctcgattaggattttctcctaaagcctctaaaaattgataaatagctttttccattttttcttgattgggcattaatttatcctatcctttttaagttgttgtagttttgattaatagtagctcctgacgaacttgagaaataaaataaagggagccagtaatcacatagaaatctttatctgatgtcagatttatatcatgtagccatttcttccaatcactaactctagtgtacgctttaggatatttgtctaagtttattgatttagggtaatcaaagctagtaaccgaaaccggagcgatactagacaatgattctaacatactctctatcggtttagtattaattgcagcaaatagaatatgcacgtttttctgctgatatttttttataacttgaacgagagcatcgacactttcattattatgagcgccatcaatcattacattcggaaagattaattctgtacggcctacccattttgtcatttcaagcccatctttaatggtctgtagggttaactttggatatttgtctcttaataataaactggtagttatagctatgctagcattggaaacttggtgatgtcccggcatttgcaactgaatatgatcaatatttgcttgaggacctatatagttaaaataattttcctcttcttttatataaaagtcattgtgtaaacgataagtctggctgtgggtttccttggcttttatttgaaagacttcttcaacatcctgacgatcattagcatatacgaatggaactcctttttttaaaacacctactttttgctcagctatatctacataagttcgtcctaaaacctcctgatgatctaatccaattgacggacaagtaaccgctaaagccttgaacatgttggtagaatcataataaccgcccattccagcctcaataatgacgatatcaaccggacagctattgccaaaataatagaacatcaaaactgttataacttcaaattctgtagctggttctaggttggtctcaaggtgcaaccgttcaacaactggacgaacagtttcaacaagtttgataaaatcagactctggaatcatttgaccatcaatgctaatacgctctctaaagtcaacaatatatggtgatgtaaatgttccaacttgataaccagaattggtaaaaatatgttgtaaataactagttgttgatcctttaccattcgttccaacaacatgaatggcagataggttgttttgagggtttcccagctgctctagcatccatctcatacgttccaaacctggtttaataccaaaagctaatttactatgaatccattctagcgcttcttgataagtcatcttatttacctttctttaacatcgtatgtacttgtccaatactaaaaactaaaatagcaagccagataaaaataaaacctattacctccccactaacgatagtttctttaaaaataaacaatgctagcaataattggatggttggattgatgtattggataaagccgataatatttagaggagccctcttaatggcttctgcaaataataaaagaggaactgctgtaatgattcctgaaagtgagagtaaaactaattgtaatatattataatcagttagaaaatctttggcgaaaaacactatataaatgagtgcaaacggagcaataaaactactttctaccagcatcgaaaaatcactagataaagaaattgatttttttaataacccataaaaaccaaaagaaagcgctagagttagtgaaattaaaggaaaatgaccagtttgataaactaaaattccaactcccatgattgcaatcaaaattgcaaggctaactactcttgccaggtgttcacgtaaaacaaggaccgacaacaaaattgaaataatcggcatcatataataaccaagacttgcctcagtagcgtgaccatgcgtgactgcaaaaatatagaccaaccaattaattgaaattaaaatactggctacaaacattgtccaaaatgactttttattattaactaagccttttaagtcttttaaatagactgtttttctacccgaaacgagcatataaataagcatagttaaaacagtgaatataatcctataagcaaacgtactatatgcttcaattccagataataatttccaataaagagataacagcccccataaaacataggctgacaagccaaggataattcctaaattatcttttctcaactctcactccttttcgctcaatattaagcacttgaatctgtccacctaaacataatttacttaactctgtgacaattgcttgttctttttctttcgaacacagaaccattaccgtcggtcctgctccagacaaataagtagcatacgcaccattttgagtgctgatttgttttatcacttcaaattccttcaccaaaggttgacgatatctttcatgaaagaggtccctttctatagcccatccagcagttaccaaatcacctttcaacaacgacgcaaccatcacattagcgacgctgcttgaagcaactgcatcctcataactcaatttttgaggtagtacatttcgactatcacttgtttttaattcataatttggaataaaagcgataaaggaactatctggaaacatcacttccaaacttttaatatcatttttcactattgatgaaataactaaatcaccaaaaatggccggtgctacattatcaggatgtccttctaatcgggtagctatctctaatttttctttttgagaaagagccaaatttcctaattgattggctaattctattcctgcaacaattacagaggaagaagagcctaaacctctggccaaaggaatatctgaaaacatttttaagcggtgtggtgccaaatccgacttaacatgcaaagctgtttgaataaggaggttagtatgatcttttggaatatttactaaattgtgttcaactaaccactctgtactttcttctaatacttcaatgattaaatactttgataacgcaactcctattgaatcaaagcctggaccaatattcgcactagttgcaggtacaattatcctcatttcaccctcctattactttgaaaacattgattaactgaatgacaccactctcaggaaactcctcaataaattgagttattttctcttggctaacttcatctgttaatacatagatttcttgttgtttatcacccaatgctttttcgataacatttttcaaacctatattttcttgctcaaagtaccttccaagtgtatcactatcttcagcatttctcaaagaaatagctagatagtactcattgaaaatatcagactgcattgacaacctacacggacaatgataagtattcataggcttaatttttatctgtgatcgaatactacgactaatatcgatgatatccgctaaaacagaggttgctgttggattttgtcccgcacctggtccataaaaaagagactgaccaatccctattgattcaatgaatactgcattcatcacatgattaactgcagctaagggatgcttttgagaaattagtgtcggagaaacgtctacacttataccagttggagtttcacgaagatcagctaccaacttaatggcaaagcccatctcctgagctacttcaacatcctctgagcgaatactagaaatccccttataattaacatcatcaaaatcaataggcataccaaatccaaattgacttaagatagtggctttgtaggcagtatcaataccttcaacatcatttgtgggatcactttcagcataacctaactcttgtgccttttttagagcttgttcataagaccatccctcttcaaacatttttgttaacatgaagttggaggtaccgttgagaattcctaataaacgtgtcattttatctgaggcaaacgaatgcgatagggtccttaaaataggaatgcctccagcaactgctccctcatagaataaagctagacctctagcgtctgctaaatccatcaactcttttccgtgtaaagcaatgagatctttattggctgtcacaatatgtttaccaaatcctaatgcttgactcaaataagttttagctggctcaatcccccccattaattccactacaatatcaatttgtgaatcttgaagaatagtatttatctctgtcacaaagttataagtaaatccctgattgatgaaacgctggcggctttcattatctcttactaatactttatcaatcacaatatcttcgccttctaaagaaagtagcttatgttgattttcttttagcaaatatggaatacccttagcaaccgttccaaaacctaataaagctattttaatagtcatgaatttctccttagaaattgtctctaacttcaagacaaacattggctatattataacaaattaccaatattttttatagggcaaacgcgtcttgtcctatgaaagttcttaaaaagagaatattatttcagaaaagatgatacaataaaagtactttaaaagttaaggagaaataaatggcacacacacctactagtcatcgtaaaccacgaaaacgttccccatggttagctattgcttctgtcttttttttgttaatagctttaatcggcatatttctattcttcaacaatcgttcaaagcaagaaataaaaacaaaaacgaacgcctctagtcatcgaaaaattgtcacatctatcaaaaaaaagaaatggattaagcaaaagactcctgtcaaaatacccattttaatgtaccatgctgttcatgttatggacccttctgaagccgccagtgctaacttaattgtggcacctgacatttttgaaagtcatataaaacgtctcaaaaaggaaggatattacttcttagcccctaacgaggcatatcgtgcactaaacgaaaatgccttacctgaaaaaaaagtcatttggattacttttgatgatggaaatgctgatttctacactaaggcataccctatactcaaaaagtacaaggttaaagccactaataatatcatcactggctttgttcaagaaggacgagaatctaacctcaacgttcaacaaatgctagaaatgaagcaaaacggcatgtcattccaaggacatacggttactcaccccaatctttctctcttaactccagaactacaaacccaagaaatgacactatcaaaacagtttttagatcaaaaactctctcaagatactcttgcgattgcttatccatcagggcgctacaatcctacaaccttggatattgctagtcaatattataaactagggcttacaacaaacgaaggagttgcaacaaaagataacggtttgctttctcttaatcgaattcgtatcttaccaactactagcgatgatgatctgatcaagacgattaaccaataaaaagaagccttctggcttctttttattcttcataagatttaaatggttcatttttacgtggataacgatctggagaaatcgataagcccatttcttttttctcatggaaaagctccactaataacgctagcatcatcaaaatcattacgaatgaaaatggcagagcgacaataattaaaacgttctgcagcgctaacagaccaccagacaagagtaagacaatagcaatcactgccaacaccagcccccaaattactttagttcgattttttgggtttaaattaccatcttctgtcaacatagccaaaacgtacgttgcagaatctgctgatgtaataaaaaatgaaaaaattaaaatgatagcaataatggataaaagccaacctaaagtgtagtgattaaaagtagcaaacaatacttcctctgttgcaaactttgtcaaattagtacccagttgttgtacctgagttgataatgtgccaaatgctgcaaaccatacaaaactcaataatgtcggtattaaaagaactaccgttaaaaactcccgaatgctacgccctttagaaatacgagcgatgaaaactccaacaaaaggagaccaggaaatccaccacgcccaataaaaaatcgtccaattatcaatccaagaacgtttagtattgtcaaaagcagctgcacgaaagctcattccaaagaaattttgtaaataagagcctaaagactctgttagggtatcaaaaatacgaaccgttggtcccaatacaataactaaagctaagagggctaccgctaaaatcaaatttaagttcgataaaattttaacaccttttcctaaacctgataaagctgacataacaaataaagctgttgtaatcaggataataacaatttgaacaaatgcattattgggaacacccaataaaaaacttaaccctccgttgatttgagcagctccaaatccaagtgtcgtagcaactccaataactgtagcaacaactgtggtgatatcaacaatttttcctagccaaccatctgtcttatcaccgaaaagaggctttaaagtgacagacaagaggtatttctcttgctttcgaaatccaaaataagctagagctaaagcaaccaatgcatatactgcccaagcatgtatcccccagtgaaaaaatgtaaaacgaaatgcatcagctaatgctgtttgcgattccttaggtgcaccaggtgtcgaaatagcaaaatgcgataagggttcagctgctccgtagaagaccaaaccaatccccatacctgctgaaaacatcattgctatccatgatacagttgaatattcaggacgtgaatgaggttgccctaaacgtatttgtccaagaggactcataataaaaaagacacacaaagcaagaattgaagtaactaacaacaagtacaaccaaccgaaattggtagatacctgttcacgcaagatttgtgtccaagattgaaaaccacgaggaacaataattcctaataagactaaaataagcgatacaattagtgaacctgtaaatacaggcgtaatatgttttttactcaaaatttcctcctatactaaaatagtatagcatactttaataaatactcctctcattttaaccacctgtatcaagacctctccttgtctcctcaacaaaaaagaaccaaataacattatctggttcttgtgtttgacttagtgattaatcactatttggtgtaaataccaaatgttcgttgacaaaggcatcaaatccaagttggctcaactcacgaccatatcctgaatttttaatacctccaaacggtaattccggtaatgatgtccaccctgaattaataaatgtcatccctgtttcaatctgagccgccacttttttagcatgttctggatcagaagaaaaaacagtgcttcctaaaccataactagaatcattagctaaagcaatagcttcttcttcagtatccactttatagatagaggctacggggccgaaaatttcttgattatagattggatttgctttagtgatattcgttaaaacagttggcatgacgaagtttcctggatgatctatagtgtcatttccaaaaactacctcagcaccgtggtctaccgccaatttaatttgttttaaaacatcatcctttgcacctgcagatgacagtggagccaaggttgtttccgaatccattgggtcgccccatttagcagacttaaaggtctcaactaccatatttacaaattcgtcatacttatcagccatgacaatgaaacgttttgaagatgtacatacttgacctgcattatataaacgcgcaaagaatattgttttactaagtaaatcaaaatcagcatcatctaaaataagaaaagcatcgttcccacctaattccatagacgattttttcaaatttttaccagcttcagctgctattgatgccccaccacgctcagaaccagttaaacacacacctgcaacacgaggatctgatataaggtttgaaacttgatcatacgaagcaaaaatatttttaaacgctccttctggagctcctgcttctcggactaaatcctcaaacgcttgagctgaggcaggacaaatagaagcatgttttaaaagcatagtattacccactataaagttaggggcaaatacacgcataatctgataaaatgggaaattccatggctcgacagcaagtaaaacaccgacagcttgcttcaaatagtaagcctctccatttggactttctaacggaacaggttttaaaaacttttgcccattatcagcataatagtcagctatgtctgcacacaagtccacttctccttgtgcttcagtgaaaagttttcccatatctttagtcataacttcagcgtacttatcacgatccttacgtaataaatctgctactttatgcaattgattttggcgttcttcaacattatcttctttgcgccatgtcttgtagagggcatgcgctatgtctaatgactgttcgagatcactgtcactgatattatcgaattcatgcaatacttcgttagtgtacggataaattgttttatatgccataatgttccctccttttgatatcctcattataacatttatgaaatcgattacaaatatttagctttagacaagatcaccaagttccaaggatagcttgcattgttaaactaactataataatgcctaaccaacacgctgcacctaaaagaattgattttcctccagttttaattagtttgctaacattagtatttataccaattgcccccattgccataacaataaaaaatttagataaaaccttaagtggctcaaagatacgtaacgaaaaacctaatgaagcaactatcgttgttagcaaagaagctaagataaaataaagcacaaacttcggaaatatcttagtaacacttacagattgttctttctgcgtttgtttcatatggtaaatagataatacaatcgtaattggaatgatggctaatgttcgtgtcaatttaacaatagtagctccgcccaaagtattgctgtgattgatagcatcccatgcagtagcagttgctgtaactgacgaggtatcattgacagcagtccctgcaaataatgcaaaaccgtgatcagagagaccaataaaattccccagcgttggaaaaattaaagccgctaagatattgaataaaaaaataaccgaaatagcttgtgctacttcatcatctttagcattaataactggtgcagtcgctgcaattgcggacccaccacaaatagatgaaccaacacctattaaagtagcaatcgttttatctaacttaaataacttttgcaaaacataagcaataatcaatgaaatggaaatcgtcataataatgatgggtaacgatgatataccaactttcatcacttgcatgaggtttagtccaaaacctaataagacaactgctgtttgtaaaatatatttagatgtaaaagcaatacccttattaaataattgtcgattttgataaaaggatccaacaattattccaatcaagatagcaaaaactggtgctcctattaaagggagataaagcccaagcaaccaagatggtatagcaataataaagcataatattaatccaggaattttttccttaaataacatgatagtcctcctcacattgactattatatcacaagctttaaaacgtgacaggaaaaccgaaagaggaccagaatatgctctgatcctctttcattactaattcacaattatttagttactttcataaatggatatgatttttcattacctaaaatcaatttagagccctcttttttataggctgttttttcaccatttttcacaatattaccatagaacgcatttgcctttttattgatatgcgatactttaataacacttgttaagcgatgtactttaccatccataactggcaatgtcatttcaccagtattagtattatattttcctccggcagcttgtgcagcactttgaaaacttctatcaatttgttggtcaatttgttggtcagtgatttttgtttcatcaaaaatctttttacctgcttcacttaaatcattgtaagtcaaaccttgatcttttaattgtttttcaagagctttatcaataaaagtttttatagcttgatggaattttacctcatcaatttgagcagtgactgttatctttgcctcatcgtttttgacgttcatatgcatattagcgcccttaaccaaatcagctgcactaatccccatatccgctgcctgacttccaagttgttgttctatttctttctcaacttgcttctctaaagaaactgtacgccattttccctctagtgactgatgattattccagaaatagagaccgcctgcacctacaattagaataagtactagtacagttaaaaaaacttttaaaaactttttcatgataaaaactccttatgataaactacattaatcataacataatatcacaactccttcaattaaaatagtaaaataattatataaaagtttgtaattttatacattttaataaaacctattatttgtaaaaatgacataatctaaaacatttaattttactacataataattataaaacaattaatctcagtaaaggttttcatttgtatatttaaatattttttcgaattattatattatttgtcgcttttttatggtaatataaaataaatatagattttaaattaatatatacatttctatatttattgatttttatctcagtataacttagtgtcgtagagattaattcctatcattcaccgctttattttaggataactaaacaatttattgtttaaaacgaaaggatttatgaatgtctaggaaaacatttaaacgtatactatcgattggagtttgcacgctcgtactatcgatgagtctttattacactgaaaaagcccacgctattgctggtcctagtgaccgccaatacgtagaaaacccaaatcctcacattattgtaaatgttacaggtactgatcaaaacggaaatagcattttaccgcattatatcgaagtcaatgtaaagatgggacaaactttaagtaaaaaagaaattctagattatattgctcgaaatttaaactctagtgtggaggagaaagtaaaaacgttcaatacagcaacatcgagtttaaggaaagtgcttatctgaagcgtcaattagatgatggcaagacagaagaaatagcaattgataacgacggtgttactgtacctaaagacggtccaaacaaattttggattgacgttccagtaacttgtacggtaaattcaataactccaaagctccataaagtagaatggggtacacctatttcagttttacattatgtacagttcgttgataaaactacaggtaaaactttagaggattttaaaactattgattttgctgaaatcgaccttggaattcgacataccggtgatagcattaccgataaggaactatataactcagcttacagtgcctttttaagaagtaaattaactaagcaaggttatcaattccaatacagaattagtacagatgttcaacaaaatcttcaagtcaccaaaaaactttacaactacgatgtaaatgaagaattgattaactatcaaatcgaaaacaatagacccacactaaacctatctaatgaagccgagactgatatctttttcgaaagatattatgtttctagagatggagatagtttagcacgtacagaatcaacaatttcgattaaaatggttgatgccaaaactgaacaaccgctatttaaccacacattaacgggttatcaattgtcaactgtttccaatgtctataacagactctttgaagaaaatcttatcccaactacaaaatcaggagaaaaatattttattcaaaatatgaaaaaaacagctgaacaagaatatactgtttacctttcagaaacaccttattctgaagagaacgctcccgtaatttcttatgatgcaagacctgttgattgggattatcactcaggcgcttcaggatcacttgaaaatcagcctaacatctatactgaagaagattcaactgaatttttgggtaataaaccacaagcagcttgttatccaaacaaacaatttgcttgcgaaaatactgactctaaatacaactatagctatttagaaaaatagttataaccgatagggttaatctctcattatcttatactgattaaaatcattaaacttgtttccattttgactggaaacaagttttttatatttatttgtcacatataattgacagtcttcgaaaaatgatatatactcaaaatgtcatctatatatgacactcttcttagattctttactaaaggagctaataatcgtgaatcgtcttagagaatacagaattaaagctagcatatctcaattagctttagcaaaatcagttggtgtcgccagacaaacaataaaccttattgaaaataataaatacaatccttcgctagatctttgtataagactagcggaatgcctacaaacagacctcaatactcttttttgggatagtagacatctataacagactagactctctaaatctatgaaaactcgggaggttaggtcgtgttattatttcaatctcaaactttattaaatagttcaaggataggagaatattatgaaagaaaagaaaaatttggggataaaattaataaaatccctatatggtattaatggcccattcgatgaatacagagaacaaaaaatcaattaccttggaaatctattatttgcaaccactagcctctatcacattttatcctctatcatcgcctggttcacggtaagtaaatatcccacagagactgcatatactctcctagctttaacattctttctatatttttgtatttttctaattgttattccctcttatctcaacagtcatgatttaataacgtcactagaagtctcaaaaaatgactatccagtagcaataaagaaaaacaaacaaaaatttatcaaaatcgggatattttatactgtcatccagtggcttatcttgggtttaacaactagcaataacactccgctgattgtatcactattttctttaaaagttattttgtctagtattatgtccggtgtagcttacaatggagttatgtatctaatatttaaaaacaatgttgatattgaaaaagatgaataatgacaacatttcatctctaattgttctcactgtctatataaataataaggctggaaaattttccagccttattatttatggtaatatctttgcagcattaatcgccgcttcgtagtcaacatctgaattaacattgtcaacgtattcggtgtaagtcaccttattatgctcatccaaaataagaactgcacgtgttaacaaatgccactcattcatcaaaagagcgtactcttgaccaaacgaatgatcataaaaatctgataataaaatcacgttatcaaggccttcagcactgcaccaacgcttctgagcaaatggaaggtccatagaaacagtaataaccactgtgttatctagctctgataattcctcattaaaagtacgtgtttgttttgaacaaatacctgtatcaatagaaggaacaacgctaataactttctttttcccttcaaaatcttttaaagatttttgagataagtctgtagctattagtaaaaaatcttttgcaatatccccaacttgtagctgttttcctgtaaaagtaacaggatttccaagaaatgttgtcataagtttacctccttatcaattacctttattttactatgaagcttcttctttttcgaataattgaactgataattaaaggtacttacttccttcgcgtatgctcaaagtcgacaactcatcacaatgattactgataaagtcctttacccatactttattatactttgaataatccctaagcgcccagccaatcgccttattgataaaaaattcttgacttcctgtatttcttaaaataaaaagtgacaaaatatcagtatttgttttttctttaaatcctagttgatgctcaatagctagtcgcctcatccaaaaatcttgatcaagtgaccattctgacagtaaattcataaccttgtcatcttttaaggataagttcccaaaaatcttagtcagaacatcaatactatcccaccactgttgatgacgagcgtaaaactctagtctagagcaatcattataggtgagaaattgactcatagctaatagataatcaagtacaaaatgatgatattcacgatagtcactttgccaacatttatcaagcaattgccaatcaatttttgcttgtcttttagcagcctttataagctctttgtagagcatacgtcgctcaggtgatttaataccatagcacttaaaatgatggcgtaaataagcctcctgttgcttagaaacttctttgtcacttgcagctttaaatttcctctctaaacttaggaataaatccattacgtaatccccttgtatttttcaaaaagcgttgtaattccttcatgtacagattctcttgatacacgtaaattagcgtaaggagtcagttcatcaaaatcccctacttgaacactataatgcgcagcatcaaacatagaaatatcatttttatcattgccaaaagctataaaacgattcccaaataatttcttagtggcttttcccttgtcaactgcaatgggatttatgtacaaacatttttcaaattcgtggaaaaagtgactactaagtccaaaacgatttaattccgctaacatttggtctgcccttcccagctgatcaccaaaatacaacaccatttttatcggtttctcaattttagaaacttctagaagctctccccttttttgaggatcaacataagcaataaagggaattttagaagcctgataagtagcgtaattaaagacctcatcaacaaaatatggaatctgatggcgatgacaatatgaaataatagtactaaaaaagtcactttgtaaatagtaactatccactaagtgaccattttcatgtaaagtcgcaccatttaaaccaataatttttgataaagatagcttgtcgccaaggatacctatagtgtctctataagatcgcgctgtagcaaaagtgactctatgaccataatcaatctgggctctctctagtattccttgtatttctttagatagactcataccatcaaaacaaagagttccatctatatcaaagacaaaatccattctctcaaagtcccatccttaagttaaaataggttttcatacgtgcataaacatcttcatcaccaacaaaaaagatatgatctccttgctctataactgagaaaggccccggagaaacaataaatttcccttcgtgttcaatagccacaatagtcgcaccagtttgatgccatacatttaattctcctattgacttaccaaggtgttcagaatcttcactgacaataatttcatatggtgctagtgggtattgtttactaaccgcacgtgtttgaagcaaaaaatcatcaactaaagtagctaactcttccatttcttgttgctgagccttgatattatcacggattttacctttcaaaatagcaactgaatgagaggtttcatattggtttaagaattcaattgctttttctttagagagaataatggctccactgccatgctttaaagttaaaatctgtaaatctgctaaaatattaagacccttacgtgctgtttctggtgatacgttgaatgttgaagcaatagttgttctagatttcaacttctctccaacttcataatctccatttgcgattctttgtgcaaccgctactgctattttttgatatttagatgttacaatttcagattgttcagaaaccatccaaccctccttatcctaataaaaacatacatattaaaccacaattagcaaaatattgcaaatatatcttttttgttaatatctaatgtctttagtaaatatcatataaaaggagctggtctcccagctccgagtgtcttatcataaaaagtagtttactgaattaagattcactagtacgagcttctgagattttttcttttgcagcctcagtaccatttgatactgcttcttttgttttctctgctccagaggaaattgctgctttagctttgccagcttgttcagaagcaaagtttcctgttgcttgtgctgcatcagatacacgatcttgtactgtcactgagtcagcttcatgttcagctttagtcttaatatctacgacatttgcgttcaattcaacaactttaaggtgggtcatcacttcaacgttttgactgacaatcgctttaatgctttcaacgatagctgggatgtccttgccgtattcaacaacgatgtctaaatcaactgcaacttctttagtaccaacttcaacatttacaccatcagttactgagtcagaatttacaacgctattttttagattagagaagaaacctccactcacagctaagagtccgtctactgattctaaagcatgtccaacaattttagcaattaccttttcttcataagttactgaagttttaatatcttgtttttgattttccataaataaatgacctcaaaccttctagtcctttttcttaaagctctctgaagcacccttaatggtatctttaatgtcagcaagtttttcttttgcatgacctttcaatttatcaactttaccttcagattcaacttctttatcgccagtaagtttccaacagattcttttactgaaccagaaaccttatcaacttttgcatcaaatttttcttcagacataatagcctcctactaataacaatactttaaactacacttaaatcaattattgtacacgtggttcagacttcatgtcttccactttatcaacaccgctacctacggcacttttaacgtttgaaacttgattcgaagcaaattcacctgttgcttgtgctgcacttgttacacgatcttgaagagttactgaatcttcttcatgttgagcacgagttttaatatcaacaacattaacattaacttcaaccacttcaaggtctgtcatacgtttcacttcagcttcaacaacttttttgatatcggcaaagatagttggaacatgtttttggtattcagcaacaatatccaaatcaacagcaacttgctttttacccacttcgacatttacgccatctgtaactgaatcagaatttacaacgctattttttaaatttgagaaaaaaccaccatttacagccaaaagaccatctacatgctcaatcgcaattccaacaattttttcaatcactttatcttcgaaagttaattctccacgaacagctgtcgtgccagaattgttagttgtgtttttgatgtaagtttcagtcataatagttcctctttcttttatttaaataatgtagaataaatataaacgaaaaattttattttctcttattaaagaattggtcaagcatacctgttctttgcacataaagtccagcataagcacctagcacaatgataacaagagcaagaattgttttaaagaatccaatggttacaatcattgcagctaaaacgagcccaataactgcacctcctagtggatatctgtatttcctcacgaattctgacatattagactcctattctacacgacttttattcgtcttagcatttccaacattttcttcttcaacttgcttaacaaatactctagtgttcattttcttttccaacccaaagaattcttttaagccaagttcaacatcactttgaatatgttcaagttgttccggtacatttgtacgagaagttaaaagacctttaacatcaactttcacttttttcttatataaatgagctgtcacactaggagatttcatcaaaccagtttttaatacttctgttttaacaaatccctctattgcagatttttttaacatcaatttaccagttttatcagctagtttatactctgtgtatcgtcttggataaaacagaactaccaatatagccagtaaaacgatcacaaacagcactaatgctccccaaaagaaataatgatacataccaacgtcaatcggtgatggcaaattaaaatcccaatctaaccaattaaaagatggtagataaatgtgttgtttactgataacagctacaaatcctagtagggtaagggagattagacctagtaaagtatataaactttttagtccttttgacataggtaactccttttctagttattcattttacctagtacaaatgaagtaacaatgacaacaataatagcacctacgattgaaggaatcaaagccatacctgctaacttaggcccccatgttcctagtaaactttgaccaacaaatgaaccaactaaaccagctaagatgttagctatccaacccattgaaccacctttgttagtaacagcccctgcaatagcaccgataatagcacctacgattaatgaccaaattaaactcatgataaataccttctctttcttaactaatcattccactagttatgtagttatgattttttgcctaatacaaatgaagtaacaatgataacgataatcgcacctacgattgaaggaatcaaagccatatctgctaacttaggcccccatgttcctagtaaactttgaccaacaaatgaaccaactaaaccagctaagatgttagctatccaacccattgaaccacccttgttagtgattgctcctgcaatagcaccaataatagcaccaacgattaatgaccaaattaaacccatgataaatacctttcttcctaagtacatctcagtgtacaaacttattttgttcttaactaaataacaagagtttcttaagtgaccactcggcaattaattaagttgttaactatactaatattatacaactttataaagtgactgccaagtaaaaagcttggtaaatgcttttatttttaagtgaccacttgatatttaattgatattgttattatactctttttagaaaagaatgcaagagaaacgcttctttttttaaaatagtatggtcacttttagaaaacgctttaatatcaacctttttagtaagtaaaaaccaaatgataacttattttttctattcaaatgatgcaaaaagactaagaatacaattcttagtctctgattatttaagcatataatagaagaaagttagttttcctttttgctaataggagcgacactcgctaataatttctttaacccaatacctggaaaatttatttttaactcttgagtctttccgctacctgaaacttcaagcaccgtaccgtccccccattttttatgagttgcaacatcaccaatctcccatgatgtctcatggctattgttcgcgttaagagcctggagttgggcagttacttgagattgtgaattacttttacgtgcctgaagcgcttgttgaagactcattccttgaccaaattgtgtaggctgttcttttgaatatttcacaccaaatgaagaattaactggtcgagctaacccttggtattgtatcagttcatcatcaatctcacgtataaaacgggttggtctattataactagttttaccaaataaagtacgggtattagcattggtaaggaaaagtatttgttctgctctcgtaatcccgacataagctaaacgacgctcttcttctaattcatcagcatcctctattgcacgcgataaaggaaatactccttcttccataccgattaagaaaacaactggaaattctagacccttggcagcatgtaatgtcattaaagtgacctcagccgtttcagtggcgctatcatcagtatctgctattaaagctaaatcatttaaaaaacgcgatagacgatctaaaccagtttcaccctctactgtaatctctgggttatcgtcaaaatttttagtcactgacaagaattcttcaatattttcaatacgcgcttgactttctaatgtattttgaacttgaagtgcttctagatatcctgtcttatccagtaggttttctgtaatctccgttacagttaaactatctagattactacgtagagtcaaaatcagattagctaaatcccaaacagcttgagcagccttcccttttaagggcgacatcatgacatttgaagaggcatcaagaagagacatgctctgttcataggcaaatgaccgtattttttctaaagttcctggccccacccctcttttaggttcatttacaatccgctcaaaagaaatattatcagaagtatttgcaaggatattgagataagcaataacatctcgaatttctttacgactatagaattttgttccaccaaccattgtatatggaatattggattttaaaagtgcttcctcaatagtacgagattgcgcattcgtacgataaagaacggcaaaatctttgaaattttttccttgttctcgaacgatgttatcaatagttgatgctacaaaaactgcttcttcttgctcgttgttagctctatgatatacaatttgctcaccttcatcattttgagtccataattttttgggacggcgatttttattatgattaatcacattattagcagcttgaagtattttcttagtcgatcgataattttcttctaataatacaactttggcttgcggatagtccttttcaaaatcaagaatattttgcatatcagctccacgccatccgtaaatggattgatcggcatcaccaacaacacaaatatttttgaaacgcgaagctaataacttaactaattggtattgagcgtggttagtatcttgatactcgtctacatggatatattgatacctctgttggtaataggccaaaacatctttattctgatcaaataatcgaagtgtcatcataatcaagtcatcgaaatccatggcctcacttctacgtaattcctcttgataagctttatagcatttagcaattacctgtgtatacatatctccggcttgcttctcatatgcaatttcatcaagaaggtcatttttagcattagagattgtacctaaaattgaacgttcattccacttttttgtgtccaaatttaattgcttaatgattcgcttcattaaagtacgctgctcacctggatcaacgattgtaaagttacgattatatccaatataatcagcttcacgacgtaaaatacgaacacacatactatgaaaagttgcaatcaaagtatcttgggtagctggattcaaggcgatagcacgttcacgcatttcacgcgctgctttattagtaaaagtaatcgctaaaatattccaaggattaacatatttttcatctattaaataagcaatacgatgagtcagaacacgtgtttttccagagccagctcctgccataatcaaaagcggtccgtctgtcgtttgtaccgcttctgcttgtttatcattcattccaattattaaaggattcatttctactcctaattttgtcaaaattgcttctctagtatatcattttttcatctttttcccaatagaaaaaggagttaaacagacgctgtctaactcctaccttttttacttctcttttctctctccagttacaaacattgtaaaaatagcagttgtaaccatttcgcctttctgatttttaatgtgaacatcaacgactttttgtagtacgaccattatgaacacaagtaccgatgacagtaagcagatcatctaatcggcctgccctcaaatagttgatatttgattgtagagttaccgcttcatatcctgttgaaatagcaactaaaccactgacttgatcacacagtgtaaacaaataaccaccatgagcattaccataatagttgagcgaagagtcaacgaccttcgttgttaaggtaacttgaccttcttcccagttttcaatttcgtaattctcaaatacttttacttgttctaaattgaatttcattctactataacctcactttttttatgaccattatagcagaaaataaggaaaccataactgtaaacgtttttattttaaactttttaactgacctattataacaaaagagctcagatactctgagctcttttgtcatgatttcatgctttcttttggcaatattaaatttaatataatacccactatagcacttaatgctgttcctgataaagttagagcacctagatcaaggactgctccaccgaggcctaaaactaacatggaactagcaataatcagattacgaacctcagcaaaattgacacgattttcaatcaacacttttaatccattacttgcaataacaccataaagtaatatagccattccaccaagtactgcactaggaattgtagagatcaaagctgtaaatttaccaaagaatgaaaaagcgattgcaataaaagctgcattacgaataaccgttacagaagctatacgcgtcatgccaataacacctgtattttcaccataagtagtttcagctggtcctcctataagagcagaaaatgcggttgctaaaccatctccaattaaaagacgatttaaacctggtttttttagaaagttacgcccacaaatctgacctaaaactgtatgatcaccgatattttcagcaatcgttacaattgagattggaagaatggcaagcatttctggtccaaagtaaagtttataactgtgaaataaacctgtcttaaacggtaaatagaattttggcaattcaaaccaggcagctttttcaactggagataaatctaccaagccaagaatgattgataaaatataacctccaataattgcaaataaaaatggaataatcttgataaaacctttccctttagtattgataaaagctgcaatcaagaatgtaacaacagcaactagcattttacgccaatcacctttagcgacaaaacctgcattagttacagcagagtttgccaaacctaaaccaataacaataatcataggtccaatgattattggtggcaaaatcttatcaacccatgaatttcctacgaacttaataaccgtcgccacaacgacatagattagacctacaaaaagaatacctgtttgagcagccgaaatatcgccatgcatttgtttcatggctaatgccatagctgtaatataagcaaatgatgagcctaggtaaacagggactttaaattttgtcgcaacttgataaatgagcgttccgcaaccagaagcaaataaagccactgatacaggcatccctaaaataagcggaactaatatcgtagctccaaacatggcaaaaacatgttgaaaacttaacagcaaaccttgaaataattctggtttttcatcgatatctagtaataagttagtagaatgtacttccttatctactagaatttgattactttcacctttagcatttaaagtcatatctaaactagtcctcttgggcatacaaaaaagcccactttctatagcaatatagtcataggctttatttttttcctgatgtttttctcacctcacgggatgagtttaaaaacctacgctgaaagaattatagcataagacattttagaaaacaagacttttttgaaactatattgacaaaactatgctttttcattatgatagttaacataataaaatataccgaatgacgtcattcaggagaagaaagttagactttcgccgaaggaattacactctcaggtgtcttaagacaggactgattgacagacggacttctggagagacctataagtagcaacatctttgtattgacaccaagatgtgctctaggcgccgaaggggcaagaagagtaaaacaactcctccaatctctcaggcaaaaggacagaagctaaaagccaatattaataatgagtagtaagcttaataagtttactactacctttatttgtgcgctttttagctagcatctttcagaagttatctcttttagagataacttctttcgtttcattacagaatccataggtatgtcatgtatcaaaggagaacatatgctaacactttttactcatatcaatagcttcgtttggggtccacctttacttgctttattagtcggaacaggtatttacctatcatttcgcttaggttttattcaattgagacaactttctagagctttcaaattgattttccgagaggataacgggcaaggagatatttcaagttatgctgcccttgcaactgctcttgctgcaacggtagggacaggtaatatcgttggtgtggctacggctattaaatctggaggaccaggagctttgttttggatgtgggtagctgccttttttggaatggcaacaaaatacgcagaaggattattagctatcaaatatcgcacaaaagatactaatggagaaatttctggaggaccgatgtactacattatcaatggaatgggacaaaaatggaaaccattagcagtctttttttctgcagcaggtatcttagtagctcttttaggaatagggacattcactcaagtcaatgcaattgcttcttctcttgagcatactttcaaaatatcaactagatttaccagcctcattcttgctgttatagtattatttattatatttggaggtataaaatctatttcaaaagtttcagaaaaaatagtgccttttatggctataagctatattttagcaactctgattattattgcagttaattacaataagattccacatactttccaactcatctttagcggtgctttttctgggacagcagccattggtggtttttctggagctatcgttaaagaagcaattcaaaagggaattgctagaggagttttctcaaatgaatctggattgggttctgctccaatagccgcagcagcagctaaaacaaaagaacctgttgaacaaggccttatttcaatgacaggaaccttcattgacactattgttatttgtactttgacagggattgcaattttagttacaggaaaatggctagaatttgatttacagggtgctccgttaacacaagcatcttttaataccgtatttggctcactaggtagttttgccctaaccttttgccttgtcttatttgcttttactactattttaggatggagctattacggagagcgttgctttgaatatctatttgggactaaatttattaacgcttatcgcattatttttgtcattatggtcggcttaggtggtttcttacagctcgatctcatttgggttatcgctgatatcgttaatggtttaatggctttacccaatctaatagctctcctagctttgtcaccaattattgttaaagaaacacagaaatatttttcagagactaaaaatatcactaagccttgaacttactagttttatagtctgctcctaagtgatataatgtgtagatgaaaggaaattaggaaaatggcaacttctactgaaaacttacaacttgcaaaaagagggcccattattagtatcattgcctatataacactggcagtcgctaaattagctgcaggttattggtttgatgctacttcacttgtagcagatggatttaataacttatctgatatcttaggaaatgtagcactcttaattggtttacacttggctagtcaaccagccgactcaaaccatcgttttggtcactggaaaattgaagatttagcaagcctgattacctcttttatcatgtttgtcgtaggtattcaagtttttattcaaactgtcactaagattattaataatactgatactaacattgatcctctaggtgctatagtaggtgctatatctgctcttgttatgcttggcgtttatttctataataaacaattatctcaaagagtaaagtctagcgctctggttgcagcttctaaagataacctttctgatgctgtgacatctatcggcacatctattgctatcattgcggcttctctaaattttcctattattgatcgtttagctgctatcattattacttattttattcttaaaacagcttatgatatttttatagaatctgctttcagcttatcggatggtttcgatgattatcaattaaaacaatacgaaaaagctatattaacaattcctaaaatatccgctgtaaaatctcaacgtggacgtacttacggtagtaatatttaccttgatattgttctcgaaatgaaccctgatctctcagtctttgaaagtcatgccattaccgaaagagtggaaaaactactcagtgataaattttctgtatatgacatagatattcatgtagaacccgcttctatcccagaagacgaaattttcgataatgtttatcaaaaattatacaaaaacgaaaaaatcatcctagcaaaaattcccggttatgagacctttattagccctgacttttatatgattaatgaaaagggaaacattatcacttctgacatgctcactaatgctacaaatcattcattggcaagcaactttaaatatttcaatgtaaaatcaattagtcaaaaaacaaaacttgtgtcttatgaattggaaggtaaacgacatactagtatttggcgccgtaatgaaaaatggttcttaatctaccatcaaataactgccaagtcaagtccgtataaaacgagacgatatcaaatcacttcccttgattaatatactatttaatcagttactcttgataaaaatagcttacaaaaataaattaaaaagattgagaagaatctcggtctttttaatttgtttttatgtaaacgtttcatagccttgaaaattactttcagagtagtagactataatggaaggagtttttcatgaaattatacgttcaattaatggttattttaaccttttcattcgctggtgaggttctatctactatattcaacttacctgtaccaggcagtattattggattaatattactattcctagcgttaaaatacaaaatcatcaggctcaggcatattgatgccgtggggaattttctattagcaaatatgaccattttatttttaccaccagcagttggactgatggagcactttcaagacataaagccctatctttttgggatagctatcattatcttaggagcgctatttctcaatattctaactattggactggtatcccaatggatcaaaaagagatatgaaggagattatccagaaattggaggtaaaaatggcaactttaacgaataaccctatctttggtattatgttaaccgtatgggcgtattacattggcataaggatttttagaaaatatccttcccctgcaacaactccacttcttttggcgactattttattaattgcttttttaaaattaacacatatctcctataaagattactacaatggcggttcatttctaacgatgttaattacgccttcaacggttgtattggctattcctctctatagaacctttcatttaatgaagcatcacattaaaagcattagcattagcatcatcttagcttctgttatcaacacagtttttaccgcaatagttgctaagttttttggtatgaaatatttcttagcaatctcacttttcccaaagtccgtaactacagctatggccgttggaattacaagtaaagcaggtggattagctactatcactctggtcgtagttgttattacaggcatcttaacaagcgttttgggtcctatttttctaaaattattaaggatagaagatcctgttgctatagggctcgcgctaggaggaactgggcatgctataggaactggacaagccttaaaatatggccaagttcaaggcgccatggctggactagcaattggtatcacagggatttgctatgttattgtcagtcctttagttgcaggcttaatattgaaatgaggataaggaaagtaaacccaaaataattatgttataatatttaaaaatagaatttaggataaataattatgataccgttaaaaaaaataactgttggaacgattgtctgtctctcatttttgggtttaacagcatgctcttcttcaaatactcagcaaacctctacttcaaaatcaaatgtatcacaacataaaaatatcaaagctgaccacgaagaattacgtttgaaatttaataaagtaaagttaggggttaaagcaaataactttaaaggaggcactagtctcgctgaattaaaacaattatttggtggcgaaccaaatgaaaaatttgatacaccagcgggaaatgtcactcttaaaggctatcgttggaatgtcgatgatatctccatcactatacaattattaaacgatagtagcattgttcgttcaattagtaattttaagtttattcgtgatgccaacatcacaacaaaagattataatagtttaaaaaatggcatgtcatacaataaagtaaaagaacttctaggagaacctgatgatatttctcaagcagtttcttcagataaagaggaactacaggctgcatggattagtggcatccagtcgtcagacagtgatccgggaattaaccttacatttgaaaatgataaactcactaacaaacaacagcatggtttaaaataaaaaggcattaacgcctttttattaataccttaattacttattagaaatattttattacacaatggtttaatcttagtaccttaacttagccccttaatggtcatactaactaattatgatactaacttacacagatttcaaactaattcttccttatttgtcaaccctggttttacttatcagaaatgaggagaatcagtttgtgaggcaagattggagataaactaatataaagcctataacataaagctttatggagcatctattatccatcttaagggaatcgaacccctatcccaagaaccggaatcttgtgtgatatccattacactaaagatggtagtacatgttacattatagcatactttatcaacaaaaacaaaaagacttgctaaagcaagtcttttaattattataattcaatatcaccgaataagtcagccatagagaatccagtttgtgtttctggaagctcgtagtcgcgtttttcttgacgacgtggacgacgtggacgtgattgacgtttttcttctttttcaccttctgcttgcgctggacgctcttcaagagctttcattgaaagtgagacacgttctgcatctgaattaacttcaagaactttaacagtaacttcttgtcctgcagataatacgtctttaggattttcaacacgtttgtgtgaaatttgtgaaatgtgtacaagtccatcaatgccaggtaacacttcaacaaaagcaccaaagtcagtcaagcgttttactttaccttcaataacatcaccagcagcaagtttttgttcaacgccatcccatgggccaggtgtagttgctttaagtgaaagtgatacacgaccagcttcttcatcaattgaaagtactttaacttcaacttcttcaccaacagttacaactgatttaggtgaaacattgcgctcatgtgataattcagttacgtgtacaagtccatcaacaccaccaaggtcaatgaaagcaccaaagcttgttaaacgagcaactttaccagttacaactgaacctacttcaatgtttgagaaaacttctttacgtgctgcagctgctgattcttcaacaacttcacgacgtgaaaggatgaagcgattttctgctgcatcaacttctttgattttagcatcaaattcttgtccaacaaatttttcagtattacgtacaaaacgagtatcaatcattgaagctgggatgaaaccacgaagtccttcaaattcaactgaaagtccgcctttaacagcacgtgtacctttaacagtaacaacttcaccttcacgaccaacaagtttgtcccatgctttacgagcttccaagcgttttttagatacaaggaaagttactgtatcagtatctttacctacaacttgacgaagaacaagtacttcaactgtgtcgccagctttaacaaaatcattgatatcagcatcacgatcgttagtcaattcacgaagtgtcaagacaccttcaacaccagtaccatcgataacaacgtttgcttgaccgttatcaactgttaaaacttccgcagtgacaacgtcaccaggattcacttcgctaacactgtttagcaaatcttcaaattcattcattctaaaaaatcctccaacaaaagctagccgagctagcttttgataacaatatattttctcaaggtaacccgcaaggacaacaaatatctctttgacggtgtcaaacaaaagtttgatacctttgactggggtagctggattcgaaccaacgcatgagggagtcaaagtcccttgccttaccgcttggctataccccaaataatggaaagagagggattcgaacccccgaacccgaaggagcggatttacagtccgccgcgtttagcctcttcgctatctttccgtaacaacactgactattctaccacagatgttgttagcacgcaagctttttaaataaatattagcgattaagattatattcttcaataatatttcccatagcttgatctaaatttttatagaatccactcacttgctcacctttaatcacagcaaatttagaatctagctctgcaatttgacctacaattttttttccaataacgagttggtatccatcaaccttagttccattaactgttacttgagcgtctgaaatttgaatttcaattttcttatcttttttactcactattaactccaatatctctttttattgttttttattgtacacaaaatactaaaagcttgcaagagcaagcttttagtatagacttaatctactttataaatccacccttctggtgcttcaacatcaccaaactggatccctactaactcatcatatagtttgcgtgtcgctggaccaacttctgtctcactgtagaagacatggaagtcatctccgttttgaattcctccaattggtgaaataactgcggctgtaccacatgcgccagcttctgtgaatttatctaattcgtcgacaaagacatctccttcaatcgcttccataccaaacctttctttagcaaggtaaagcaatgaatatttagtaattgaaggtaaaattgaaggactcaaaggggtgataaactgattatctttagtaattccaaagaaattagctgctccaacctcttcaattttagtatgtgtcgctggatcaagatagataacatctgaaaattgtttctcatgagcatatttcccaggaagaagactagcagcatagttaccaccaacttttgcagctcctgtaccattcggtgctgctctatcatattctttggaaacaataaagttagttggtgttaaaccacctttaaaataactacctactggcattgcaaataccgtaaaaatatattcttcagcaggtttaactccaataatatctcccacaccaattaataagggacgaatgtataatgttgcccctgtaccatacggtggaacaaactcctcattagcgcgtacaacagatttaaccgctgcaataaatttgtctgtcggaacatgtggcattaaaagacgatctgctgttctttgaagtcgttctgcattttgatctggacgaaataactgaatagagccatctttagttctataagctttcaatccttcaaaagcttgttgcccataatggagagcaggtgaactttctgaaatatgtagcgttgcatcatctgtcaacttgccatcatcccatttcccatctttaaaatgcgaaatgtatcggaatggtaattttctgtaagcaaaacctaaattatcccaatctaaatttactgtcataaggtacctctttctttgggtttctaactattgtacgctattatcattattttttcaatattatttgtaaaattcagataaattaccaaactagtaaaaacacaaatgtgtttttacttaattttaactgagaatacttcttcgtcagaaatcttatcagatacaaaagagccattacttgtacgttcagaaaaactccattgacttaaatcaacatcgtaaacttttcctgttttagacataatctcaagtacgaaagtatctccttcatgattcgatactgaactaaataaatcaaattcaaaagatgaatcctctaaatatacaggtcctgctttaaaaacgcgatgcggtttggatttcaattcacgaagaacttgaagtcctcgattagcacgactagttgtggggataacatcaatggccattcgtttaagacttcctctatgagttaataaatataaacttgtggtgttagctataaatgcagatacgatgtgatcacgatcttttaaattcatcgcttttacacctgcggctttactaccgacgactggtacatcatttatactaaatctcaacgcataaccattataagtgacaagtataacatcctctaattggataggggcaacagtcacaacataatcctctacactttttaacttagcatatttagctgtttttgacttatatgtccgccatggactgatttcttgacgttcaaaacgctttatttgccctaagctagtgacagcaaaataagtttctttagtaaaatcatctactaattcagcataaataatttcttcatttgaagcaaagttaacaagattttgtgataaatgttcaccaacgtctttccatcgaatatcagctaattcatgaactggacgataagcaagattaccaaggttagtaaacatcaataaatgttgggtagtctttgcattgctcacaaatatcaattcgtcatcttctcgcttaccaagttcatcaacagttgatgcattgaaagagcgagggctggtgcgttttacatatccgcctctagtaacactgacgtatgtgtcctcttcgataattaaacttgcagtatcgatttcaatagtttcagctaattcttgaagttcagaacgtctagtattggcaaatttctttttgacctcacgtaactcacgtttcattacgttatacatcgtacgttcatcactaataattgccttaagcattgtgatttgttgacgaagttcttcttcttcttctctcaacgtcacaatatcagtatttgtgagacgatataattgcaatgtgacgatagcctctgcttgagcttctgaaaactcatagctgaccttcaaattctctttcgcatcagctttattctcagaagcacgaattaatgcaatcacttcatccaaaatagaaagaaccctaatcagtccctcaacaatatggagacgtttttcggctttttctttatcaaattttgaacgagcaataataatttctcttcggtgagcgatatagctagttaatattcttgatagacccacctgcttaggggtgtagtcatcaatagcaaccatattgaaattataattaacttgtaggtctgtatatttaaaaagataatttaagacaattgtttcatcggcttcttttttgagctcaatagcgatacgaagaccatctctatcagactcatcacgcacctctgctattcctggaactttattattaacacgaacatcatcgattcgttttactaaaactgacttattaacttcataaggaatttcagtaacaataatttgtttcttaccaccttttaaggtttcaatagcagttcgcgagcgaaccgctactctccccttaccagtctcatatgccttacgaatttcatcttttccttgaatgatagcgccagttggaaaatctggaccaggtagaaattccattaatttatctaatttagctttagggtgatcaatcatgtacacgacagcatcaatgacttctgctagattatgtggtggaatatctgtcgcatagcctgcagatattcctgttgctccgttgactaaaagattgggaaaggcagctggtaaaacagttggttctttctctgtatcatcaaaattccacgcaaagggtacggtattcttatcaatatcttgaagaagataaccagcaatttctgatagacgggcttccgtataacgcatagccgccgcaggatctccatccatagaaccattatttccgtgcatttcaatcaatgtctcacgatttttccaatcttgagacatacgaaccatcgcgtcatagatagaggaatccccatgaggatggaaattccccataacattaccgactgattttgcagatttgcgaaatcccttttcaaaagtattaccatctttattcattgaataaaggattcgacgttgaacaggttttaagccatcacgaatatccggcaacgcccgttcttgaatgatatacttagaatagcgcccaaaacgctctcccataatgtcctcaagggacatattttgaatattagacatatttttaattttctcctagttggagtggcttagtattatttttccacttatttgaaatgaatgattggctctcttgtctaacgcatacaatattacttgtacactataaaacatgaataaccaaggctctttattaaaatactgtattctcttctaaagtaaacttgacattatcttcaatccattggcgtcttggaggaactttatcacccatcaagacattaactcgacgttctgctcttgctaaatcttcaattgttacacgaattaatgtccttgtctcagggttcatagtggtttcccacaattgatcggcattcatttccccaagccctttatatcgttgtaatagtgagcctttaccaaatttttgtcgtaattcttctaactctatatccgtccaagcatactcaacaatttctttcttaccttttccttttgacattttatacaaaggtggcaaagcaatatagacatgtccctcttcaacaagaggtctcatatagcgataaaagaaagttaataatagtgtctgaatatgagctccgtcagtatcagcatcggtcataatgataattttatcataattaatatcgtcaagattaaaatcaggaccaacacctgcaccaatggtatggatcattgtattaatttcttcgttttttataatatcagccatctttgccttagctgtattcaatacttttcctcgcaacggtaaaatagcttgaaactttctatcacgaccttgcttagcagagccacctgcagagtctccttcgactaaatagagttcatttttcttagcattttttgattgtgcaggggttaattttccagaaagtagacctttatcttttttcgactttttcccattcctactttcatcacgtgctttacgtgcagcttcacgcgcatcacgtgcttttattgccttacggattaaattagatgctaaatctccattttccataagaaagtaagttaacttttcagaaacaataccatcaacaattggtcgtgctaagggacttcctagtttatctttagtttgaccttcaaattgcaagtgctcctcaggtacaagaatagataaaatggctgatagcccctcacgataatcagaaccttcaaggtttttatctttttctttaagaagtcctgttttacgtgcatagtcattcatagactttgtaatagctgatttcaagccagtttcatgtgttccaccatctttagtacgaacattattgacaaaagaaaggatattatctgaaaaaccatcattatactgcaaagcaacttcgatatgaaattcttgttcttcaccttcgaaaaacatgattggtgtcaacgtttctttatcttcatttaaatactctacaaaatcttgaacaccgttttcataatgaaattctagatgctctgcttcttctgaacgattatctgttaaggttaaagtaacattttttaagagaaaagcagattcctttaagcgctctgcaattgtattaaacttaaaatctatcgttgaaaatactgattgatctggcataaagctgacagaagttccagattttgattttggtgccgtgccaatttttttcagagttgtaacgggcttaccaccattttcaaaacgttgtctgtaaatagctccgtcgcgaatgatttcaacttctaaccaagaagacaaagcattaactacagatgatccaacaccatggagaccacctgatgttttataaccaccttgtccaaattttccacctgcatgaagcaccgtgaagatgacttcaacagtaggttttcccatagcatgcattccagttggcataccgcgtccatggtctgtaacagttatactcccatctttgttaataataacatcaatgcgatttccaaaacctgatagagcttcatcaactgcattatctacaatttcccacactaaatgatgtaaaccagttccatctgtggaaccgatatacatccctggacgcttacgaacagcatctaatccttctaagacttgaatagcatcgtcgccataattcgtcactgttatatcttgtttagccaaagtgacctccaaattttttcatcttttttatattacaagttttttgctgtttttgcaaaattatttttttaaaaatagcaaaaagacttttatgcttatgttataataagggtatgaatattataattatgattatcattgcctatctgttaggctctatccaaactggactttggattggtaaatatttttaccaagtcaatcttcgtcaacacggtagtggtaatactggcaccacgaataccttccgtattttaggtgtaaaagctggcattgtcactttgactattgacattttaaaagggactctagcaacacttattcctatcatattaggtataacgacagtatctccattttttatcggtttttttgctattataggtcacactttccctatttttgcacaattcaaaggtgggaaagccgttgctacaagcgctggggttttgctaggatttgcaccttcttttttcctttacttattagttatctttttattaacgctttatctttttagcatgatttccctatccagtattacagtagctgttgtaggtattcttagtgtcttaatttttccattagtaggctttatattaacggactacgactggatatttaccactgtggttatcttaatggccctaacgattattatccgacatcaggataatatcaaacgtattcgaaaaaggcaagaaaatttggttccgtttggcttaaacctaagtaaacaaaaaaataaataataaaaaaccgctagtagcggttttttattataaaactaacaatgtttcgagagtagatttcccttctaatttaaccaatcaatctcatttattccttcttcttctaagaaatgatttgttctagaaaaaggtctgctaccaaagaagccacgataagcagataagggactcggatgaggactctcaataatatgatgaataggattatcaattagcgactttttctttcgagcatagccaccccacagaataaagactactggtgtttccttttggttaaccactttgatgacagcatcagtaaaaggttcccatataagcccagcatgaccattagcttggtgttctggaactgttaaacaagcatttaatagcagcactccttgttgcgcccatgatgttaagtcatgatgtgaacgtgacccgatatcttctgctaattcttttagaatattttgaagtgaaggaggagctggtaaattgtctggaacagaaaatgagagtccttgagcttgttgaggtccatggtaaggatcttggccaataatcactacttttacgttttctagtggtgttatctgtatggcattgaacaccttatctcttggaggataaacgattccgctttcgtaaactgcatccataaatgtattaattttattgtagtaatgattgggtagttctctttttattaaatcatgccaactagaatgtttcatttataactccttacttttagatatctgtattactagtatagcaatattttataaaaaacgttactgctttattcattcaaagcagtaacgtttttttattaatcttcgtccttaagacctagagccaaatcagataaggacactggtctagaattttcttctttcaaagaagtatttataatgtttaaagaagtataaacatcaataaggattccaaatacatgtgcacgttcatcacctaaaattgcttgaaaaaccgtctgtgattgacagaattctaaaagattatctaagcccttaatccattcttctacaatagccagagccttattcataactttaaatgacgattcatcataccaataaatagaacgaatcagttttttttgcttactcaaagcttctattttagaaagtatctcacctagttcattctgcacaatagcaatagaaaaatgtttccccagtaaagatggggttttttctactaatataatttcatcacgaaacaaggttaaataatgaatactgactaacaatttttgaattagcgcttggtgatcgtgtgtttcagtttctctcatactcaaccatccttactatttctgactggtaaaactatacgtagcttactttaaatataccatatcactattgaaatcgcaaaaataagatgaataattttataaaataaatattataaggttttaacttcgtctacaaataattgatattgactttgtaacaaatcattagcctcttgagtaaaatgcaatccatcactagttaaatgataatttagattaccatcctttgataaaaatctattaatatctaacagtggaatctgattttgataacaaaattctgttagccattgattgattttctcaatatctgcattattgacagtttctctaaaaagggtgtaagcaatagttgtcaatctcatctttattttattctcagctaataatgagtagagtttttggaaattgctgaatatttcttccacactataacctgtaatgagatcatttacccctatagaaacaaaagcctctgttacattagctgtcaaaaagttaggtaagttttccaacatcgttgctaatgttacaccaccttgggaataattatggtaactttctagtgaggtagatatcgtttttgaatcacctaaaattatctttgaagcttctctattgaacaaacgactatagccttctttataaaaaactttattctctttttccctaatggcataatcgaaaaagaggtgaccgatgacgtggataaaatcatctctcgtatcaacatctaatgaaaattcctttgccatttgataagcatatgtcctagaggtgaaaaagcttttttcccttaagtaagtttctttattagaaataaaaatagcgccgttcggatagtataaaggttgtaaatcttggcgacgataacctttatctgctcccaccatatctatagcatagccttcatcagataatgttgtaaacagactagggtgtttctcaacttcagaaaaacttacaacattgtcaacatcatgtgaagaataatactccattgcttcctttatatgccatgattttcttagtggagaagttacttgaagtaacacaaactcctgattatcttcatagtcagataaaaaatcttttaacatatcatacgaagttgcctgatcagttgaaagttccggttttctcatcaccactgaaataccgcgttctaaacaaatctctctgtacaattctgaatctgtactaacaaaaatatctttcttatcaaacattccagattcaattgcagcatctatagtatggaaaatcatgggtttaccagataggaataacatattcttatctggtaatccttttgaccctgatcgcgcaggaataatacaaattggcttcataacatatcctttattttatttttttggctggaacccctacataggttccaggttctataatatcttttacaacaacagctcctgctccaattgtcgtacatgatgaaatatccaaggtttgaataataacactggcactacctacataaacttcttctctaatataacaaagaccatttatggtagcattaggtgctatattacagtgtgattctacaacagtatgatgttcaatgagcgctcctgtattaacaacattgttatcaaacagcttcactttagaacctataaaagccccaaaaccaataaagataccacgtccacaaatactatctggtgtcaatactaaagcattgggactaatgatgttaataataaagtcataataatcctttgctacatattcaaatagttctttccttttagcattatcacctattgtaataaatactgcatctattgagccatcttcaaggtaaggtagcacatcataaagttttccaagaacaggataaccatcatgctccgtaatatctttatcatcaaaaaaacctacgaaatcatacacaagaggatcaataaccggagcaatcgcatcagcatgacttcctgcgcctaaaaatgccaacttttttttcattttagattattctcctttaaatcataaaatggttgggaaattgaaggttcatctttcaaatacagctttattgcttcatatgcaatagatgaagcattctctttgtagtagggattgtcaaagttggtcacttcattcaattttgataatccctccaatacagaggaggtttcgactggtacacttactacactttctccatgtagcctacctttttggcgatcaccaatattaagagtaggtttcatcaaagaaggaacttctattaaaccagaagacgaattaccaatcagtcctagtgaatgacgaattaaggaatgataaagttgggttgataaagaagcaaagcaatgactattttcatgatttgtcaaataagtattgatagcctttgcaatatcatcagaaccagtatctgaattggatcctataaatagacactggacaccaaacttagaaagggctgatagtaccgctttcatctgctctccagcactttttccttgttcaaaagtaacaggatgatagagaacaacaaaataggattcctctagtgcaatacctaattgcttttctattgcttctttggttagagaagggattgatagagcattttccactccgagagctcctgtgttaattacaaattgaggttgttctcccatctgaatcacacgttgacgaaagtcctctgtagagactaagtgtaggtgactcatcttagtaattgcatggcgaatatactcatcaaaattgcctaatgaggtctcccctccatgaaggtggcatactgggacattataaatcaacgctacattcacaactggtaacatttcataacgatcccctaaaatgatgactagatcatagtcttccttgtcaaaaattttggtcaatcctagttgtaaatgcgccattgcagtagatacagttcttctgtcagtatcataaagatgtaagggaactttataagcaatatcaaaaccgtcttcttcaatttgacgataagtatagccgtacttttcttccagatgcattgctgttgcaataatttgtaagttgacttctttatcttttgacaatctttgaatcaatggcttcattattccgtattcagcacgcgatccggttactaaacaaatttttttcatcgtatcccttctatatatagtaattacataatcttagccgtgtaatacatctgttgccgattataattaggtgttattataactcgggcaattgattttcaaagcgtgaatcacgaataacttcatcctcttcgaaatcatcttgcgcttcttgtcccaagatgtcataccagttcataggagaaataccattacctgggcgcttcaccgtaatattttctattgaataaatatcgccttttttaattggttttaaagcaacgactgatttacgagcaacaatcttatttttttcttctactggatctgggattttttcaaatctacctaaggcttgttcaacaatgcgaacccctttaactaaagcagctaaaatatcaggtgttgcactggctttatgatccggaccttccatattagtatctaaagtaaagtgtttttcaataacttctgcacccattgctgctgctgcgataggtacttctgatccaattgaatgatccgaataacctatcgttaaatctttaaattcatctttcaaagtatgaataacgtttaaatttagagaggggtaaggtgttgggtactctgttgtacaatgtaaaatagaaatgtcggttgtaccattctgacgtaaaatattcaccgcttgatggatctcttccattaccgccatacccgtcgaaagaataactttcttttgttgcttgccaatcttttctaagtaaggtaaattagtgatttctcctgatggaattttgtaaattggcatatctgtagaaattaagaactctaatgactcttcatcaaaaggtgttgaaaaggtctccacaccttttgaaattgcataatcacgcatttctaagtattcttcaaagcttaactctaaacgtttcgtcatctcaagttgactgtctgctgttcctgtagttgctttttgatattcagctttgggagcaaatttagaaataagtttctcagctttaaaagtctgaaatttaacagcatcaacaccacaagacacggcaacatctaccatttttttcgcaagattaatatctccattatgattgcaaccaatctctgcaataatataaaccattatcttctccttctttttttacccaataagtctaaaatgactttttgaaaaacaatgctatatactataagaataattattcctaaactccatctaataacgatattacctaggaacatgttcattaacatagcataactaaatactataccacttaaaataatgtactgcctaactgagacatctgaataatggtatttaactttcgaaacaatatgatgaaaaatcaacaaggctaaataagatattattgtagccatagcagcgccataggctgcataatgaggaattaatacaaggtttagtaaccaatttacaccagcagctaataatgtcccaataggaatccatgtcgtattagcatagaagaattggatatttacaggaaatgtatagagaaagactaaaaaatagctgacaataattaaagaaataaattgaacactactactatacttgtctcctcccattatttgagctaactcaggaaaaacagtcaaataacctaatgttaagaaaactcctaaatagagataacggctaatataagttgaaagttgcagtaatttttcttttctagcatcaaaaaaccatggaatccaagccatattaatactattcaaaacaatctgaataatcattccaagcgaataaccgaaactatacattgcaacttctttagtactatataagcgagctagcataatcctatctaattgatttaataactgatgtcctaacaaatgaaaaatcaaaggaatagacacagtgacaatgaaccgaaaatacttaggattgtaaaaagatttgctatgataataaatataagcaaaggcaactattccagttattatagtaggaacaaaagctccaaaaaccctagataaaaagtcatcggaccaatgaaaaattaaaaatagagatagtgcaacagatgaaactgcattggctaaggatagtattaaattagccaagctcctctgttgttgtataaaatactgaccaaagaaagtcaccacatagttagcgtaactttgacacaccattaataaaaaaatagattcagaaaaaccaactaatggtgcaagaaaacttctaaatagaaaagctatcaaaagtacaataagaaaccatatattacctacagaaaaggcactcccagagtagcttttaaactcttctccatatttgactcgagccgaacttaaagaaccgctcgtctgaagaccaataaacagagtaataattcccatccaagcaacatataaactatattggccataaacttctgttgagatgactcgagtgtagatgggaagtgtgataaaggctaatccttgcaccaataaattcccgagtgtataaataaaaccagattgaagtaatttcttagtattcatttaatatccttcagatctactaaagttatttttttatcaacacaagttaaaaaatccagcgcggtggacgaatgtgttatcccaaattcgaaccgtcctgttaacatcaactctataatttccatagggatatttgatggtaatagctctaccggcaatttggaataatctactacatctctaggatgaacttttaaataaacattgtaccctaacgttctatattcctggacaatatcgtcaaaataatcgtattgctcttgaatactttgaaacctctctgtaggtgttttataacatttatcttgtgcaagtggctgtgtcaacaataatactgactttggagttatagttaatggttttgttttaaatattttgaaaatcagtgatttttgctctttgttaagactatcaaataatttttttctcggtagttctttatatttcttactccttatgtcatgaggtagccccactaaagaattaacctcaattgagagacaatattttgaaaaaccatacggaacatactttttaaataagtaagttttaattactcgttttacgacagaaccacccaagaataacttggcttgaaaacagttataaccatcttcaattagatgataatttttacccaaatacaccatatagcgacctattaaagtatcatcattaaatagatagacttgtgtatctactctctcaaagtagtgatttaagtctgaatctacaagctccatcacttcttcaatatttttactttgtaactgctcccgataagcaaactctttaactgcttccgtccttattccctgttcatttaatgtttttacccaagtttcataattcgtgatagtgtcacaaataaatattctagtattttctttatcttttaactttattatagtaatcagtaaatggtataaagtatgacacacaaaattattcatttatttatctttttctttcttttacaatttaatattttaaaatgcactacacaatactttaaataatactttatttttagtagcatacgttgtttttttataaaatcaaaaatagtttttttatattcagttttcagagtatgaaattccttataaaaattatttttatataactctatcaaatttacttccatagttttaattaaagctctctcactttgaaatactaagtctggatacttttctaataaataaattctttccttaagtgcttctacagcatgtagccttttaatattgtaggaaccagtcattatgctattttctctaatacgatatgcataagtattatatctaaagaaaattatatttttggctttcaaatataatttataggttaaaaattcatcttcgtgtaacttccctactggatagcacagcgtagaaaataattctctcttatataatttattatgtgctacagtaaaaatagctctataggcatcataattataaatattttgtattgcttgtactggactaatagtttctatcatttcatcttctaaaacgatatttataatatgttgttctcttttttcaacataacaccctaaaacaatttctgaattatatttctcgctaaattcaaccattctctcgattgcatcttctttatatagataatcatccgaatcaagtaaataaatataatcgccagtagctctactaattccataattacgagcatctgataaaccaccattatttttgtgaaaaacgaatatacgcccatctatttctgaataataatcacagatatccccggaattatctgtagagccatcgttaactagaataatttctaaatttgaataagtttgagctaaaacactttctatacactcgtttaggaaagattgaacgttataaactgggataatgatactaactttatccattccttgataacctcaaattatatatttttcttacaatagtgaaatatcttatagaggaaataaataatatatatttaaccttctccttcacactaatcctattattaaagagaatagtcttaaaatattttctatatttttttctgtaataatcaactgtatcatataatttaaaatcaatcatcttcccacatatatctattccaccaaatacttcattatatattacagcagagattaaagatgtattatgtggaaaatttagatttataaatacaatattattttgaattgcctcaaaaaaatacaacattctctcattgaattttgtcctagtagtactattatcgctaaaatacaccactgcagtgacaatatcacaaactgctatttttgaagcgcaagatataagcttaaaagttgtatccatatcttcatgaatttttccttctggatatggattactcaataaattacttctcggatataattttgctaacggggaaactccataagttttcccataatacatttcttccaacgccacctctaaagtataaagtttaatctcttttaaatactgtgaattaatactagtattgtaagtattgttgaagttaccaatactagttaaaacaatatcggcattggtagctttctgtatgttgtacataacctcaattgaataaggaagataaacatcatcactgtctaaaaaagcaatccaatctcctgtacacctaagtactccgttgttacgtgcaactgattggcctctgttttcttgatagaaatattttattcgcctgtcttccaaaaaatacttttcgcaaatatcccctgtgcgatcactagagccatcatcaattatgataatctctaaattctgataagtttgctcaagaatactatctagacatctcccaatatatatttctccattatatacaggcactattattgaaattaattccattctttactcgctctttttaaaccttgctaccttccaaagatagctaaaacccaacaaaattttccacccagcctcttcactctttagtgtaggtattacccctaaagtagtcattttcaaagcctgtatgttcatttttatctttatagctgaccaccagcgatcaaatatattaggaaaagacattacatacatatatgaattttctaatgaaaaaatagtccctttgaaattttttctccataatttaaaaatattagaagtcaaaccatcttctaagtagtcaaaacaatagattttcctattttggggacaaaagtatcccttttttgataaatatatatacattatttcttctgataagaaattctccccttcgaaacaaggaaattcgaaatctactaaataagcattattaataacaatacaagtttcaatttttaagtgatatttatattttaaatcaggaatattaacttctaatattttgggattcaaccaattattaccttggtttaatgaatatcgaggataaacaaggcctacatatctattagacaacgttaggctctctaaatctttaaaaataatttcaactgcatcttctaataaccaatcatcactatctacacatacatgataatcacttggttgcatatatctcattgctagattataggctgaatgcttaccgccattacgtttatacagatatacaatactaactttattctcttttatataattacttacaatttccttagtactgtcctcagaaccatcatcaacaatcaaccatataaaatttttatttgtctgattacatagagaatcatacagataggataatcggtagcctctgttaaatgtaggagtaaaaatatataacatttcgtcctttctattacaataataactatttctttaactttagaaaccttagaagcattctataagtaccatatccaaataaaaaatcaattatgagccttactctaatctttagagaatctgaaataaatgaagaacttttccaacttccttcgtaatgatgtatagaataggtaacactagtcagacaatcaaccttacctgttaataaattctttggattaaaataatttctcggatatattgttatatcatcaatcttttgaataatattcttattcttaagccctctgtttatcaataaattagttgtaacctctacacatgtcttattaagagaagttaaatcacttttgtcatatatagacatatttgattttaaaaagtgatgtcctttaacagcgccaattattaatcctgtattcacatcacaactaatctcccttgctagaaaacactcatgaatcctcaaaggatctaaactttttaaaagctccacatcagtatctagatagaaccccccataagtataaataatatccaatcttgcatagtcagaaacataagcaaaattcttcttagtatatgcttctctcataaaaacatttttactaacatcataattatgctcattccattcaataatttcataatccggacattgttctctccaagtttttatatatttctttaaattatctggtaagggatttcctccaaaccaacaataatgtataactttaggtatcattttccttccttacctcctgccatatcagagcaaatatgtcatatattattcacaatagtaaattccttttttataggttcgataccatcacaaaatattttaccaaaaactagccaactaatattcattaccacactgggataaaaactttcagtaaataatattatagacattataaataggagtagttgaagttcaattatgattatctttttactatagatataatagattatcatacaaaacatggtaagtactacaccatacatactcaataacatagagtagctattatcaaataggacacttgtttccttaaaactatttccaaaaggagttaaaccatctacaagttgtaaatgagcatagtgtaatctacctgttaaaagaacatctaatttttgaacaaaatttgaattaaaaaaaattgtagaactcaaaaaggtaaatactaataaaaaaaattgtacatagggtgctaatttcataaatactctttttattaagctattctttgtcacataaatgagtacaataaataaaattacgatataataccctgtccttgaaaaagtatattggtacaataaataatttaatgttaaaaataaaaccatcacaacaggctttagtcgtttataattgagtacaatatacaagaaaatagttagagcaaaaaaattatgaataaagttaggatgaccaaaacctaagtcacttctcagaataaattgtccatccctataaaaattgacatacttaatttctattaaatctaatttcacaaaaatttgatttaatagaactcccaaaatacgcgatcctattattatagagaaagctttttttagagagatgtcctttaatgctagaaaaaaaattaaagttaatataaaagtaaccttatgaacaaagaataaattcaaaatggtcgcgataaataataaaaagatgatcacgagttttcttctttcaaaataaaggctatctaataaaaattttattccacacagtaaaattgcaactaacatcactattttgtaagctgagtttccctcgcctaaacccagtgatttaaaaaaattaactaaaaatattgcaatataaaataaagagtttttattgattttcatcgcacaactcctttaatattaccttaaattcttcaataaaattactactattagtttctaaaaacggacgattcatcattccctcatagactacattttgtaacctttcaatatctacaacgatatcaaaattatacattgtttttaccttattaacaaagtccacctgatgattattcacatgctctccaaactgttcttgtctaggaaccacaatagttttttttcctttagaaactgcattcataaacgtcgctgggccgccatgtgtgataacaatctcagcttctttcatgtaagagttcatatcatcatatgagagaaattttgaccactgacaattctgaggttcaaagtctgagtaacccgtttgaatgaacacttcttgatcaatagcacctgtcccttttaatctatcaacttctttaataagacggttgaactgctgttcatgtgtccccactgtgacaaaaatcattaaaaaattcctcctaaattaattgccttaggataaacttttttcatttcttcccactgaacaataaatttatctgttacaggatacactaattttcctgtcaaagttggtttatccatcctgtcgaaaacctctatgtaaacggtcttacaaccaaataacttaccaatataaaagaatggtactgctacagcggcaccagatgatatgataacatctggtctttcttttctaaggaccttaaaagctagaatagtattttttaccaagtttttgacattacggtttgttggaaagaagcaatgatatacaatctcttctcttagaatactcctagcatcttctttatcaaaggttacccaaaacctatcttctttttcccaaatgggtttcaaaaggttcaagtgtgctagatgaccaccacttgaaccaaccagacaaattttcattatattcctttcaaaccttacctttacttagctcctgtcccgagtaaaactacctttagtgttaggagaataatcttaatatctgaccaaatagaccattcattgatatattgaacatctaactttacgatttcatcaaaatcagtaatattatttctaccagatatttgccacaaaccagtgattcctggcttaaaactaaggcgtcgcttctgcgttgaattatacttttcatattcatcaactgtgggagggcgtgttcctactaaactcatatcaccctttaaaacattatagaattgaggcaactcatctatgcttgtttttcgaataaattttcctattttagtaattctaggatcatcgtctaacttaaacattagccctgtcatttgattgtgaactaataaatctttcttaatttgttctgcatctactcgcattgatctgaatttatagaatctaaaaatcctaccattacgacctactctattttgagaaaagatagccggtccaccatcttttctgatttgtggaactagaaaaattgccacaatgccacatatgagcaaacctataatagcacccgtgatatccaaaaatcgttttgctataaggtgactatatttatagaatttcatagaatatgtaataacactatatccttcaaaagtttggattcgcttttctcctatattatcaaagctaagtgcctctacattaacattgacaatcactcccattgcttcaatgtcattaataatatcttgtatttggtatttaccaaataattcaatgggtatgttaataaaagcttgatcaacagttaagcaggttaactctgaagtaagagcatctttgtttattatccttaacgagttatgtttcaaatcataacaatccttttcagaggaatccaagatacagacagcgatataattatggtcgtatttattcctaaaggtcatttttgataaagaatccttattcgttatcaaaacaactttggtatctcgtgaaaacttagcgtaagaatattttcgataatattttaaaaatgaattcaatagatataataaaatcgaattcatagcaataaaagtaaaaaaggaaagtcgtgtcgttgtaaaagagtttttaaaaataaaaaataatgaacttgatatgaaaatatagtaaaagctgtatttcaataccattttaaactcttcaagatagccacgactccaaaagtctctgtaaaaatcagaaagataaaagacaatataatgtatcaatagaacaaacaataaatctttattgcttttaaaattgggagtaattaatgttaatgtcaaacttgcagaaaaataaaccacaactgtttgaatcatcgctataataatcttttgtatattttctttttctttcaatacaagagccccttacttcctttttctatccctttttccgtaatttccataatcgccgtaagtagcaacagattcattaactttattaagaataatacctaagaactttgaaccactttgttccatctgttcttttgctttttcaacataattacgttttattctgcctgcttgggttactaaaataaaaccatcgcaagcattagcgattattgcggcatcaacaactaaaccaataggtggagtatcgatgataatataatcaaatatatttttaatagcttcaatcatcttattaaaataagcgttctgaagtaatgctgttggatttggtggtactttccctgaaggaacgaccatcagtctaggaacattggtttcacagataatatctccaagatctgcattacctgataaataattcgtcaagcctttaatagttccagttgctttaaaggttccagacataacagagttcctagtatccgcatcaattaataatgttttaaatcctgcttgagctaaagataaagctaaacttgttgaagcagtggattttccttccccttccctaacagaggtaattgcaagaattttattttcctttccactaaactgtatgtttgtacggatcgcattgaagtattcttctgttttttttgcttgtcttaacttgctatcaactatttctaaacgagtcattatattctccttaaagtttattcaaatctggtactatacctaaagaagtaagtcctaggaccttttcaatatcttcttcagtattaacacgatcatccaaaatacccataataactaaaacaatagttgataatcctgcaccaacaataaacccgattagtacattctttttaatattaggagaagatggtgctttaggtaaatttcccttctcaagagtagtgatatcctctacttgagtaactgccttgatttttgaaactgctgcttctctaactgaatttgctaatttttgagacatttttggattagcatcttcgaccgatattgaaataacacgtgtatcttttaaaatagaaactgttattttttgcaacaactgagacgaaggataattcaatttttcagaagaaataactttttctagaacgtcagtagacgtaataatctccttatagtcatttgcaagaaaactccccgcttgtagatcttgtgcagtaatactattattaggggtattagggttaatgacatatatccttgttgaagaagtatattgtggcgtaacaataaaaagactatagaaaagtccagctgttgcaaatgcaatggcaacaaatgtgattaaaaatttctttttccacaatttttttaaaaggttgaatatatttatttcaacttctgtattagctattttattcatgaaatctcctaaatgtaatggttttttaatatagattgagcattttcaataaaaagttggttagcacgttctttaccgaaatctctacagataatcttataagcttctgctaaaaatggcggtctaacatcaaggttatgcatatcactcgctacaaaatgcactaaattttcctctaaaaaataacgggctcttttcttaaagcgtttatgcttatcattaaaaagtttttgtttcaaaatatgggaactatttatttgtgtgtaacaccccatattaataatttccttcacccgttctttttgattctctaaagcgttatacctctctatatgcgcaacgactggtgtaataccaagcattaaaacatttgacaaagctgtatgaatatctttccaagaagtttgcatagaaaattcaattaaagcaaatttcgtattgtttaaagttggaatttgctttaacttcagtttttctaacatatcacttgtatagtacaattctccaccatataagatttgaagatgttcaaatcttttttccgcttcgtgtttaactatagaaaagtttttgaagataatatcttcaggtgtttcaaacataccttttcttctatgtgatgtcgaaacaattattctaacaccttgtcgataactttcttctattaaagataaactctcttcaagcgttttaggcccatcatctacatcaaaaacgatatgagaatgaatatcaatcattcttgttattcctccattgtgttcttaatttttgattttgcattagataagctagattgatcaattgacatcatataaagttgagctcctggcattgcatatgaagggagttcacccgttgaaccatgaccagttaatgcttgtgactcgacagtgaagcgttgtccagttgacaattgattgttaatcaaatcattaatgttatcaatagtcatattagtttgaacggacgtttggagctgtgaggtaatgctatttaattttgttactgactgactagaagctaacttatttataatagctgcaatcactttttcttgatttctacctctatcgttatcgcctccttgtagagaataacgttctctaacaaagcccaaagcctgctcagaattcaatgttacttgaccaacagggaagtcaaaattaccatgtttacttgtaaaagcttgatcgttataaactgtcactcctcccaagaggtctattaattttaaaaatgatgaaaaattaattctagcataataatcaaggttgatgtcgtaaaggttttcaagtgttttcattgatgtctcaacgccatacaaacctgcatgggttaatttatcatattgattgcccccaccatctggaatttttacataggcatctcgtggtgttgtcgttaacaatactttgtgggtattggtattaaccgtcataataatatttacatcagatcttgatactgttgatatagagccaaaagtatcaataccgctaatatagatattaaataccccttctttatgattagtatttttacgattaatttttttcttaattttgtaagtataaatcgtttttatctgcgatttaaaatcaggggtgctaagttcaattaagctaacataagcattatttaaaaccatagcctgactatcaccacttttaattctattgtatgcatcctggtaagaatctgttttttgtggtgtaatagagattcctttttctgattttatatgttctatcaaatcagtaatatttgaagtatcgtttttaactggtgcggctaatttgctgacagcttctatattggttattttagaatcttttggtacaactacactcatctcaatttcagagtatgaagcagttttatttagattatttgtcaaatcaatggttgacttaaatccatataaagtagtagcaacgaaaatagaagctaatactaaaattatagttgtaaaaattctagctttattcttaatacaaagaaataaacttactaaaatgattaaaacaattacaactccataaatgacgttcaggtgtctaaatgccaaaaaatggtgacgatacataagaaataatgagactacacttaacaaaataaaaatcaccaaaagaaataaattaatcacccgtagaggtgtatgtgagtgtttcttttggtgacggcgcgaatgattagacattgtaattctccaatacttaaaaaaaccttaattttacttggatattatatcatttttcaatacaatattcaacgaaagtaatatggaataatctgattatattagctaaataacattttcaattgatctatattgataatttagctgatctaattgaatttatttacattctagtttaaactagagttatgagaattcaacaattacaatatgttattaagattgtagaaactggtagcatgaatgaagccgctaaacaactctacattacccaaccttcactttcaaacgctgttaggaaccttgagactgagatgggtatccaaatttttattcgaaatccaaaaggaataacgttaacaaaagatggtatggaatttctgtcatatgcgcgacaaattctagaacaaacagcacttcttgaagagcgttataagggtgataatacaagtcgtgagctgttcagcgtttcttcacaacactatgcatttgtggttaacgcttttgtagctctctttaatggcacagacatgacccaatacgaactttttttacgtgaaactaggacttgggaaattattgatgatgttaaaaatttccgttcagagattggtgttctgtttcttaatagctataatagagatgtattaaccaaattattcgacgataattccttaattgccacaactctttttactactacacctcatattttcgtgagcaaatccaatcccttagctaatagaaaaaaattaaatatgaaagatttagaagattatccttatctgagttatgatcaaggcctgcataattctttctacttttctgaggaaatgatgtctcaaattcctcacccaaaatccattgttgtcagtgatagagcaactctgtttaatttaatgattggattagatggttatacagtggcaactggtatcctcaactcaaaattgaacggtgacgaaattgtcgcaatccctcttgacgtggatgatgttattgatattgtctatatccgacacgacaaagcaaacctttcaaaaatgggacaaaaatttattgactatttattagaggaagtttcgtttaatcataaaaataaacagtcctgagattgtctcagaactgtttttaaattactcaagtatatttataataagcttgttaaccgtatcgtagtgaaaattaacagtatcatactcaacaccaattacctttgccaagaagataatctggtctaaaaatgcttgagaagaaaattgagttgtacgatatagttcttgctcatcaaaaggtttaatcaggtgagccaaaggatttctgactgatttttcgaactgtcttaattgaatgatggtcgatttcacttcttcatcaaggtcggttaattgtaaacattctgccaggcttttagaagtcaagcgactatcgtgccacctttcagagaatgccaaaaggactgggtggtttgactcctttaattctttaaacttccaagtatcgtagtgatcatctcttgcattatggatgtaatcatgcaagtgaggtacttcttgtgcaagtaaaatcataaatagacgatataaaataggactaacactacggacaaaatctatgattaatccgttttttacttttgcttctaaatccatgatgtaatttgccagcaactctaaatcatacgggttatgcaaaagctttatattgtatttttcttgtaatataacaacttgttcttgatgagcaaaaagaaaatcaatgtttaactctcgacgctctttcatcatttccaataaaaataataaatctgagtttaaaggaccatgtttttgtaataataagaaagcattatgataagaatactgatccactaatactttaagagcagttgaaaaatctgtcatttctatcctcattcagaaataagtgtttcgagcccaactttcatcatatcagtaaatgttgtttgacgctcttctgcacttgtatcttcttctggattattcaagttatctgaaatcgtcatcatagcaagagcattaacattgtgttgagctgcaagatagtagagagctgctgcttccatctcaatagcatgaacacctagtttacccaaggccatattacgatctggttggtttgaataaaacacgtctgaagataatacactgcctacatgagttgtaatatccatttcctttgcgatgtgataagctttatccaaaagtttaaaatcagcaatttgcggaaaatcaaattcaggccaatcattacggataatattagaatttgttgctgctgcttgtgccaaaacaagttcacgaacatggatatcaggattaatagcacctgctgttcctacgcgaatcaatgttttaaccccataatcaacaattagttcgcgagcataaattgaaattgaaggcatacccataccagttcccataacagaaacacgatgtcctttataggtacctgtataaccaaacatattgcgaactgtgttaaaacacaccgcatcttctaaaaaattctcggcaataaatttcgcacggagtggatctcctggaagtaaaattttatctgcaatttcaccttgttttgcttcaatatggattgacatataaactcctcatttttcttataaaataatcataggcagtagcaaaaagtactgctatagttaggggaacaatagttataacagattgaccagtaaaagatatgactaaaccgacagctgtcagtggcgctctcattgtaatagctaaaaaaatagctgcaccaaccaacatactggttactatcgatatgtggggaagtaaaggaatagaaatactagctaacaaaaaacctaaacaagcaccaatggaaaaagatggtgtcagtataccgccataagcaccagcgtaaagagtggataatgttgctatcatcttgagaacaactaaaatagcgattaagctaactgtggtccctttaaagacttcttgaactagggcattaccatttcctaaaatctggggatagacgattgataaaacagatactatcaatgacactactggcaaacttaacaatatttttatatttttaatacgtctctctgtcactttttgatttaaatatctaaagctaatcgcaatcggagttacacataaaacgatcaagaacataaaagctaatgactgtgaattcagactcatctttgaaatatgataaagaggggctgtcgaaataactaattgagcaatactagctgcaccaaaagtagaggctagcaatgtcacaatatttttcagtgagattcctaaagctaaagtttcaaaagcaaagaatacactagctagggggacttgataaactgctgacaaacctgcagctgcaccactaatgattaataaacgtttatccagcactttaagtgctaataaatccgatattttcccagcatttatggctccaaactctcgtggcgctccttcttttccaatagggccaccagttcctacataaatcaattgcaaaaatgcgtgacctatatgtagccagtaaggtgatttttttacagaaaaatccttaaaaacaacctgttgtttaatactagttatttgctttggtttgatttgtaagtaataccaactaagggatgctaaaaaggagactaaagtaagtgataacactcttttaattggtgtgacactatttaacaaagacagagtattttctctactatcaccaaatgctaaccactctgtaaacattaatacatagtgcattaagatagctccaactcctgccataactgtcataaatagaacggctatcataaacttgacagcatagtataatcgagaaaccattttaaagttcagcaactaatgatttaactaatcccttgaaatcttctttaatacgctgagtaacttcaacgacctcctcatgattgagctcagattggaagccagcggcaaagttagtaattgctgaaattcctaacactttaagccctgagtgagctgcaacgatcacctctggaaccgtggacatacctaccgcctgtgcgcccattgtttggaatgcacgaatttctgcaggtgtttcataagtgggtcctgatacacccaagtacacaccttcttcgagtttgatattctgtttttcagcaatttggtgagctttttgtcgatatgttgctgtataagcatccgacatgtctgggaaacgtggtccaaattcttcaaggttctcacctatgagagggttagtcccaatcatattgatgtggtctttgatcagcattaaagttcctggtccgtatccaatcccacccgctgcattagtcacaagcacactgtggcaagccaatgctctcatgatacgtactgggaaagtaacgacttccattgtatttccttcataaaagtgaaaacgaccttgaagtgctaataccttacggcctgataaatccccatacactaattttccagcatgaccaactactgttgactgtccccaatttgggatgtctgcataatccacaacaatgggattttcgatttcttcagctaattctcctaaaccagagcctaaaataaggccaaattctggtgctgtgacgccttttgcttgcaaaaagtctctagtctcattaattttttctaataatgtcatttacttacctcctaaaccattattcactatacaatatgctataaactttggataatctgtccatcttctttaacaaaatctttttccatctttacaggtaaaatggttaaaattgcttcacagggtcggcagagttttgcacctttactcgtaacaactatgggacgattgataagaataggatcttgtatcatcgcatcaatcatttcttcatctgtaacgctagaagattccaaattgaatttctcataagcaggaacatctgttcttagaagttccctcgcagaaagtttcatttctaacaacagttcaaccagttccatcctgctaggtggtgttttcagataataaataatttctggttcaataccacaatgacgaataatggcaagtacgttccttgatgtcccacaatttgggttatggtaaatcctaattttttccatcatcttcctctcaatttttaatgctacaagtgtcttaaggaaataaaaatttataccaagtcctgcaagaagctctctccaatcatcgcagtatcaacaccaaagttatccgcaactgttgctgaaatatctgcgaaatgccctactgggataaggccgtttcctgtgaaagatgggctataggctaagagaggaatgtattctcttgtatggtctgtacctgcataagttgggtcattaccatgatcggcagtgatcaaaagtaagtctttgtcacgcatcgctgaaatgatctctggaagacgctcatcaaactcatgaagacaatcacgataaccatgaggatcacgacggtgaccatagagagcatcaaagtcaaccaaattagtaaaggagaagcctttttcaaactctgataaccccattgtttttatcaaagtatcaataccatgactatttgatttgttatgtcccatatcatgattaatgcctgaaccattgaaaatatcattgattttaccaacagcataagtatcgatgccagcttgatctagtttatttaatacggtatcttcaaatggtgatactgcatagtcgtgacggttggctgtacgcgtaaagttgcctggttcacctacatatggacgagcgataatacgaccaaggagagctggacgctccattgtgatactacgagcatattcacaaatacggtagagttcttctagaggaatgatatcctcatgagctgcaatttgtaggactggatcagctgaggtatagatgatgagctcaccagtttccatttggcgtggtccgaagtcatcaataacagctgtccctgaataaggtttattcgcttcacgaataactttacgtcctgaaaaatcctcaatctttgtaataatatcttctggaaaaccattccagaaagtatcaaatggctctgtaatatttaagcccatgatctcccaatgccctgtcattgtatctttaccaagtgatacttcttgtaacttcgtcgcgtagccacttggattttcttctgcagggacggtcttaagcgcttggggacgaggaatattaccaagtccgattttagccatgtttggcaccgcaagtccaactgtttttgaaatgtggccaagcgtgtctgaagcaccatcaggaactcctgcattgacaaaatcattggcatctggtgccgctccaatccccactgaatctaagacaactaagtgaatgcgatcaaattgtgacattatatcttctttctaaggaggttacggttagctcctaaaaccgattatttaaataactatttttcaagtatgtcaagaccgtttttgcctgctactataactttattaaccataccattaaataaaccatgttcaacaacaccaactgtatggtcaagttcattcgctaactgctttggatcctctatttttttcaaatctaggtcgataatgtagttccccatatcagtgataaagcggtcaccttctgtttcacggaaagaaggacaataaccttttgatttaaaaacccgaaaaagacgctcagaaccatatctaacaacctcaacaggcaatttaaatgcacctaacgtttcaacaagtttgctctcatcgacaacccagatatattctttagttggagtagctactattttttccatgagcagcgcaccaccgccacccttgataccattaaaatcagggtctacttcatctgctccatccacagtgacatcaatgacatcaatatcatctgctgatttcaacggaatacctaatcctcttgcctgctcagtcgtacggtttgacgttgtaacgcctacgacttgcaatccctcttctttgacacggcgtccaatttcttcaacaaaaaaatatgctgtagaacctgtccctaaacctacaatcataccgtttttaacgtattttgcagcggtcactccagcaagtttttttagttcgtccatattttccccttttaagttaatgttgtctaatatttttgataagtctattcaaaacactatctcaagacacattataccattttttaagtgatttttgaaaacattttctttgttctttatgcattttagttagtagcgatagtcaaattctttatttttaataatctattgctaacgcacttatatcacctaaaataagtattcaaacaaaaaagatgagtttcttagctcatctttttatgcatataagttttttagcgtttgaatatcaacttcttgaatgccataatgcgaaccttttgactgcataacggaatgttgttgatcattatgtcctagacctaacgcatgtcctaattcatgttcggccgtattaacaatcctagtatggtcataaccaaactgtttattcttaaggtaaaatgtgtttaattcaactgttacctttgaaatacgattagttaaagcatttttctcggtttcagctacacccgcagcttgtgttttagcatctgagtaatccttagcaataatatcagcattaggattatctgttgtttgtaacacaaaagcacctgttgcattccaattggagattgcttgcttgtaagcagagaccaactcagaatctctagttgctatatagatagttgcctgatttttatcccatctggtattttctgaatgatgaacattatccgtagctagattagtaaaggaatttttgagctgattagtgtcagcaaaatttaaaaatgtttttcctgtctgaataatgtcactaagttgattagcaaattctgattgactgtgattcgcatagtaatacaagccaaataaaataatcgcaataacaagaactgtcttgaatattccccaaatgatattccaaatcaatctaaagataaactttggaatagcaaatatcattctaaatagtgttctcattttttatctcaccttctgtgtctaatttcccaaaacttaatgatttagtataacaagactttacttggatttcaacgatttagctaatactaagaaaggcgctcttctttgacataatcaacagggagccattctaagactttttctaattgttgattccagtaataccattcatgtttaccatgatcattgaaatagtcaatagttaaacctaattgacgaagttcatcaattgcgacttcattagcttcaaaaagaaaatcttcataaccacaccatgcataaaatttagtcttcatatcaaaagactcaacgtaacgccttagtgaatgacgctctatgttatcagtgttattcaaatcgccaaaaattcccgaccaatagttaatgttattgttgccattattgaataataaatcaaagtcaaaagaaagtgcacctgacaaagaggcagcatgagaaaaacgattagtcagtagagctattttatatgctccatatccccccatagataatccggcaatgaaatttttctctctcttatcagacatattaggaaagaaacgtttcaaaacttttggtaactcgatagctattgcatcaaaataatccaacccatactttgtgttggtataccatgctaagtctgttgatggcatcacgacgataagattagtatgacgtaaaagacgctctatatttgtgcgtttttgccaagaattctcatttccccccattccatggagaagatacaaaacaggaatgtcacaatcatcaattttatcatcagacatctcaaaagcatctgggtaaataacattgacttgacgttccgttcctagtaccttagagtgatattcaatattaaaaaatgccataaaaacctccattctagcaagaaaggctaccaaaatttggtaacctcttaacactatcaacgaacttccataaccacaggaaggattgctgggcgacgtttcgtttggtcaaataagaacttgctgacctcatcacgcactttccctttaagttcaccccagtcaaatgtatctttacttaagtaatcttctaccgttgtattaactaattctgcgctctcacgcaaaatatctctgctttttttcacatacacaaaaccacgcgtattaacacgagctttagaaataattttcttttcttttttgctgacagttataacaacaataaaaattccatcttcagataataccttgcggtcacgaagtacaatattaccaacgtcaccaatagcatttccatcaatcataacatctccagcaggaacagatccactatggaagaagccatctttttcaagaaccatgatgtcaccacgcttcacaatataaatatcatctgctgacattcctacctcttgagctaagcccgcatgtgctgacaaatccctatactctccttgaattgggaaaaggtatttaggtttcaatagattcattaataattgtaattcgcgaccatttgcatgacctgatacgcgcaaattctgtgttatcaatttaactgagccaccagctttataaatcagattttcaacacgcgctacaactgcctcttttgcaatacttggtgttgttacgataaatactaaatcaccatctttaatttgaacataacgatgacgtccgatcgccattttttggagaccatttatcggctctcccatacgtccagtttcaaggattaataattcgttatcttcgtaacgtgtcatatctttaggtttgataatcatattttcatcagcaatatgaatgcgtttcatacgaatggccgtacgaacaatattttcaatatcaaaacccgttaaaactactcgacgaccgttttctgccgctgcatcaaagacttgttgaatacgaatgagattacttgcaactgccgctacgatgactctaccttctgcgtcttcaataacgctcttaatttcatcaccgacctcatattcgctagcaacttgctcattgcttgtagcatttgcagaatctgataaaagtgctaaaacaccatcacgaccaatttcagctaaacgcgccagatctgtttggtaatatttccttgcagcttgatcaaatttaaagtcacctgtgtaaacgatatttccctcttttgtcccaataacaattcccattgactctggaattgaatgagtcgttttaaagaacgaaatcaccgcatcttgaaattcaatttccgtttcactatcaatcacatggaaattattgaatttcttgactgctgtactatttttaacgaataacttagctaattcaattgtgagaggtgagccaaacacaggtgctttgacttcggcgataatataaggcaatgcaccaatagcatccgcatgtccatgggttaagaaaatcccctgaacacgttttttattttcaattaagtaatcaagatttggaataacaacatcaacacccagttgttcattttcaggatatttgagtccagcatccaaaacaaagatagaatcattgacttctactacatataggttttttccgttttcacgaacacctccaagagccatgatttttatgtcgctcataatgagttttctccttaaattttgttaattctttttataaagcagacaagaaattgtccaattattatcattagtaattgatttatcggtaacttttcttgggtttgaagaaaaaccttattaatcaataataggaatatgaattaaagagtgtgtccttattttcatcccatttgtacttacggtccttgtctctacaagtcgatttacagcattattagtatatcatattttgaaaataatttcttgcaaagtgtatagaaaaagaagtgaaacacttccatttcacttctttttaatcaaataattgataatagtcagctatagccatcttgtttttttgtgcctgatttaaatctctgacaatcttgccatctttcattactaatacacgatttccatatttgagagcatcttccatatgatgtgtaatcattaaggcagtcaacgaatcttgtttgataaactcatcagtcaagcccataagcgaaacacttgttctaggatcaagcgctgctgtgtgttcgtccaataataacagatttggttttttcaaagttgccattaataaactaagcgcttgtctttgtccacctgataataaacctgtaggtgtctctaaatggcgatcaagtccattaccagttctagcaatcaatttttgaaattcttccgtatagttaataatctttctaggaactagcggtctcttttcacctcgaaatttagcaactaataaattttcagcaactgtcatcctaggtgctgttcccattttcggatcttgaaatacccgtgataaatatttagctcgtttttctgctgataaattagtaacatcttgtcccatgatgtaaatatttccactgcttaacatcaaggtacctgcaattacattaaaaagcgttgattttccagctccatttccacccaatattgtaatgaagtcatgttcataaatactcaaattaacatgatctaatatcgttttcatttctgctaaaccattactgacttgtacggttgcttcttttaactctatgattttcatcaccattataagcgtactcctttcaaaatcttcgtttttaggacaggaaccattaaacaaattccaagcactattgcactaaataattttaggtaattcgtattaaatcctaaggcgattactgccgttattaaaaattgataaagaatagaacccaccactatagcaattaaacgttcaaagagagttaaaccagtagagtaaagtacctctccaataataatactagctaacccaataacaataacacctataccttttgatacatcagcatatccatcttgttgacttactaaagctcctgataaagcaattaagccatttgatacaattaagccaagcatttccattttgtcggtatcaatgccgaagctctttgccatatcagggttatctcctgttgcaatataagcttgccccaagcgtgtatagagaaaataaattaaggcagaaatcaccaagagaatagctatcaagcctaatacgagaagatttaaatcatttgaaaacggaagaaaatctttcaatgtttgaatctcatttaaacctagatttgctcttttcataaccattagcataatagagtggcatgaggtcattactaaaatccctgctaaaatcgtcggtatctttcctttagtataaagtaaaccagtaacaaatcccgctaacatccctgatagcatgcctagaatcgtcgccaaaataggattaaccccttgattcattaaggtaacacaaaccgctccccctagagggaaggagccctctgttgtcatgtctggaaattttaagattctaaaggttaagtatatccctaatcctaatatcccccataataaaccttgtgaaactgatgaaataatcataaaaccctctttctaatcgtcaaccttaacggtaatttctgcctgtttcataatcttcttaggaattttaattcctaagtgtttggctgctttcaaattgaggcttggcttccctgtatcaataactttgactggtacatctttaaccggcttccctcttaggactttaatggcctgttttgcagtttctaaccctaagccatattgactctgcgctactgatgctatacttccttgttcaaccatggtatcaacactggaatacacaggtatattagcttggtttgctgctacgataactgttctaaaagcactcgcaatagtattatcttgtggaacaaagacagcgtctacttttttggtcatgactgacatacttgtcttaatttcatttgtagatggtacagaatatttaagaacttctagccctgctttttgagcatattttgtaaactcagttacttgtgatacagaattatcttcgctactagcataaagaattcctatacgtttaatattgggagttatatccttgattaattgcacagtttgcttggtcggaacaacgtttgataatcctgtaacattagttgttggtttcttcatattcgttactaacttggcccctaaaggatcagaaacagctcccatgattataggagtgtccttagtcgaagctgctaaaccttgtgctgatggtgtcgcaattccaatcaaaatatcattgtgatgattaactaattgtttactcatcgcttgaattttactttgatcagcttcggcgtttaaaacggttaatttaacttttttccctttatatccttcttgagctagaccatcttcaactcccttttcaatagcatccaaagcatcatgggttacatactgtaaaataccaattttaacaacttgcttttctgataaattaagacgtttttctgatttgttataaaataattctccaaccactaatatagtcaatagaattagcgtagctatcagccctttatttttcatattttctcctcactttaataataccttgactttctggagtttagcgcaaaagaaaaagcgcctgataaataacttaccttgcgctctctattgttagactagaccagcgcatagatacttttttgaagtactccaaaaagtcgtatctatgcacccataaacacaactttatctacgccagttttgccaattggtaaataatgttttagtcatttactagtcatcttttctcatgaatttttctataattatatactatattctgaaaattgcaagccttttgcattataaaaaaatatttttagctcagcctatggtataataaataagctataatttttagaataagggggacgccatgtcttttgatggattttttttacatcacctcacaaatgaattacaagaacagattgaaaaaggacgtatccaaaaagttaaccaaccttttgaccatgaattggtattaacaatacgcaacaatcgtcgcaactataaactactcctatctgctcatcctgtatttggacgtatccaaactaccgaagcaaatttccaaaatcctcaaaatccaaatacttttacaatgatcatgagaaagtatttgcaaggtgcagtgattgaaaccattcaacaaattgaaaatgaccgtatattagaaatcgtcgtgtctaataaaaacgaaatcggtgatcacattaaagcaacacttgttgttgaaatcatgggaaaacacagtaacattatcttgattgataaaaatgaacataaaattattgaatcaattaagcatgttggtttctcacaaaactcctatcgtactatccttcctggttcgacttacattgccccacccaaaacaaaagcaatcaatccttttgatatttctgatcaaaccctatttgagctgcttcaaaccaatgatctaagccctaaaaacctccaacagctcctccaaggtttaggacgcgatactgcgctagaattatctcactgtttgaaagacaataaacttaacgattttcgtcaattcttttcgagagaatattatcccagcctaacagaaaaatccttttccgctgtccaattctcaagcagtcacgaaacatttcagtctcttggacaattgttagattattactaccaagagaaggctgaaaaagatcgcatagcacagcaagctagtgacctcatccaccgtgttcaaagtgagttagagaaaaatatcaaaaaactagctaagcaacaagacgaacttctagctactgaaaatgcagaggagtttcgccaaaaaggagagcttctaactacctatctctctatggtaccaaataatcaagatgtcgttgtgcttgataattattacaccaaccaaaccattgagatttcacttgatcgagctttaacacccaaccaaaatgcccaacgctactttaaaaaatatcaaaaattaaaagaagctgtaaaacatttaaaaggaattatttcagatacggaaaatacaatcacctaccttgaatctgttgaaacatcgctaaatcatgcttctatggaagatatcaatgatattcgtgaagaacttgttgaaactggatttattaagcgacgcgcacatgataaacaacataagcgtaaaaaacctgaacaatatttagcatccgatggcaagactattattatggtgggacgtaataatctccaaaatgacgagttaacatttaaaatggctcgtaaaggggagttgtggtttcatgccaaggatatccccggaagccatgtgttaattcgggataacctcaatccaagtgacgaggttaagacagatgccgccgagttagctgcttattactctaaagctcgtctctccaatcttgttcaagtagacatgattgaagcaaaaaaactcaataaaccaagtggtactaagccaggttttgtaacttacactggtcaaaaaaccttacgagtcactcccacacaagaaaaaatagatagccttaaactaaaaaaatagactgggacatatccctgtctatttttagtgttattaattatttataggtattcttattcacttaaatcaatatcttctctaagcttttgtaggtcaaagttagctttcaaaaattcttgatcttgagttgggaaacattggtcaagttggtcaacctttccaatttcaacttttccttgtgtgagcgagtaatccataacatgcccaccgaaagttaaatcgtctgaaataaagtggacatggaacccttttacccccacaccatgaaataattccggcgtccaaatcccaaccaacgtaccagatacattctctctggtaaattctggctgattagatgcaatatctgcaaaacgtttatgttgtggagattttggaatcatacgaacgtgcattcttgaaaacgttcctttgatttttaaagacttaaagagattttgaccttcaaagttttttagaatcatctcttccaaatccttattatctatctcagcattgatatcaaattgtttttggatatggtgtggtaaaaccgctgcatagggtactgtcacatcatctgataattggataatctctgctttaccatctgtaccaatagcttgataagctttcccatccaatacaatcaattcaccatcaatcatatgaacagtaccgattcctaagtcaccgtgagttaataattctccgatagttagactgcctttgtacaatcctgccatcagtgaactcaaggtactgtattgaaataatttaactgtttctgacatattagacctcgtcttagtagaactcgtcaggtaagattgtttcacctagtgtcacgttatctttatagtcaataggcacatcaatcaacactggtccattttcagcatcgattagagcttgtttgagtgtttcttcaaaactgtctttgctgtctacacggtaacctttagcaccgaaactttcagcgtattttacaaaatcaactggtccaaagtcaacacctgaagaacgcccatacttcatttcttcttggaattcaaccatgttatattttccatcgttccaaataatgtgaacaattggtagatgaagacgaactgcagtttctaactcttgagctgagaataagaagccaccatcaccagaaactgaaataacttttgtgttgggacgcaaaagagccgcagaaattgcccaaggtagagcaactcctaatgtttgcattccgtttgagaaaagcaagtgacgcgcttcatatgatttaaagtagcgagccatccaaatataatggcttcccacatcaactgtaacagtcatgtcatcggtggtattttcttggagtacatcaatgagatcaagaggatgaacaagtccatgagctgagtcacgatcaaatttaacatcgctaacgttttcaatattattacgaagacctttcaaatactcttttgaaccttctggcaattcatatcctttaatagctggtaaaagtaaatcaagtgtatgtgccatgtctccaatcagttctcgctcgggttggaaatacgtatcaatttctgcttgttcaacgtcaataacaataatacgagcagaaatttcagcattccagttacgcgcctcatattcaatagggtcatacccgatagcaataactaggtctgcacgcttcaaaagcatatctccaggttgattacggaagaggcctacacgaccaaagaatgtttcatcctcgagctcacgtgacacaatacccgcaccttggaaagtttctactactggtagtttaacagcatcaagaagtcgacgtacggcagcagttactccctctgaagatgcgccatttcctaataacagtaccggtaaaacagcattgttaatagcttgcgctaaataattaatatctaaaacagatgccgaacccaatttaggtgcactaagaggtttgattgcttttactgagactggactgtctgtaacgtcttgaggaatagagataaaacttgctcctggtttaccagatttagcaagacgataggcgtttgcaacagtttctgacaaagtattagggtcatgaacctcagcagaatattttgtaataggttccagcatagcaacgttattcattgattgatgagcacgtttcaataaatctcctcgcttaacctgtccaccaattgctagaacagcatcaccttcatctgtcgcagtaactaaccctgttgccaagttcgagatcccaggtccactagttgcaataacaactcctggttctcccgtaatacgcccgacagcctgagccataaaagtcgcgttctgctcatgacgagcaacaattaactctggacctttatcttctagagtgtcaaatacgcggtcaatcttagctcctgggataccaaaaacatatttgacatcatgattaatgaggctatcgacaattaagtcagccccatattgattatgtgattctgtcattttatctccctcttttcacaagaatggttcaattatatcacagtttttacatcagattgtgaaaatttacttgtgaattatttatttttttctgtaagtgttttcctatttaaatgttattcacccattctgacatctctatatcatctggaactaattttaaataagcctttcctacttcttgtgccttatcaaggtaaccaaattctctcaaaatgtaagcataatcttgtaaaaattctggattatcttttaaatcattatacaaagattgataatagtctacactatcatccatttctaaagccttgtgtgctttagcgatattccattttgcaaggatattttctaaattatcattgtctaattccaagacttcctcaaaccgctcttcttcaagatacaaatttgacaatctcataacaatttcatcttgattttcagaaactttttcagcttgtttcaaataagactccgacgaatgaacatcatgtaattcatacgataattgtgaggctagtaagagaagttgaccatcaaaactatttttacgaataccttgctgaactagacgtaaagcttcttcagatttatgctcctcacgaagagataaaccatagatatattcatagccagcaaagtctggattaatagtatccaactgtttaaaataaaggttagctttttgatattcttcttgatcataaaggattgttgctaactcaaaaactgttaaatcatcatactcaatgtcaacggctttttctaaaaattcgatagctgcatcaaatttccccataatagcgtaggatttaccaatacgctgataagttgaaactccagtcgtttctaagatttctcgattgtcaagtgaggcatatccttctatcgcttcttgataatgttccaaactaaggttcatttcagctaaaccaaatgtaaccaatgggtcatcgctaagtttgctggctagcaaaagcttttcacgcgcaacatcagtcaagccttccatatcatataagtcagccataacaaggagggctgaaacatactcttgactatcttctgagatataatctaagtataagaatgcttgttcaatatctccatcttcggcaacaatttgagctaaattgatagcaacttctggataatttggtcggatttgatcatagagacgttttgcttggggtaaaaaaccaatactctccaaataagctcctagttccaacaagacttcctcaggatcatttttcaacgctttttcgaaatacttgttagcatgttctaaatcctgattttggatagaaacaatcattttttcactattcaacatttttaacttcttcacttctttcttcagtaacaacatctactgtatatagcccactgacagctttgtaccaatcaaacaattctttaacaacaactttgatagatgcataaatcggaatactgaggaatactccccaaacaccaaacatcgctccagaggttaataaaataaacataattgtaattggatgaatgctaagtttattacctaaaaccaagggtgagacaaagcgtccttctagagtttgctcaataacaaaaacaatcgcaactttaacaaccataacaggtcctgcgacaagcgctaagataaacactggaatttgggcgacaaaacttcccaaatagggaaccatatttaacacaccggcaataatccctaatgtcacgccatatctaaggcctataatactatacattattgaaaaaataacaccaacagtaatagcaacaatgatttgtccttgcacataccctgacatttgactattcatttctcgcaaaatacgatcagttggttggcgtagtttggttggtaaaaccattaagaaaccattcttcatgttgcgactatctcttaaaagataaaacaaaataaagggagccatgattgttgctactgtcacacgtgcaactgtactagctaaatttcctgcccaatctaaaatattctttgaaaatttttcagcataagagaccgcttggctactgatattagataacatgctcgatatttcccctttataagattttaaccaagggttgtgatctataaacgaacttgtttccatttgcactttattcacatatgaagggagatcttccataaaatggcgtaattgattactcatcatgggaataaaactagacattgcccaaattaacagaaggattataatagtaaaaactgataatatcgctgttacacgcttaattccccgcttctctaaaaatgtaaccataggttttaataggtaataaagcaagccagaaattacaagcggcaatatcagcacagcaagaaaatcaaacacaggtttaaacataaaagagattttggtaaaaataaaaatcgttaaaaataccaaaaaggtaatcatgagagcaataactgcttgattatttaagatccatttaaaaaacaaactatttttaaattctttttctgatggtcgattcattcacatatcctttcaagatgaattctaattttaattctcatttattataacacgttaaattaaattaaactcaaaacaagagagtaaaaagttaattttgaacaattttatgcacaacatgacctggccattctatcaaatcctgtgctaaaaaattaggattacaatcaatttttgttaattcttttattggaagccatacaaaatgtcgcttatgcgttccttctttgatagattctggcgcctgacccaagagattaacaaaatataaaaattcaactgagtgataatgatgtctcttaatattaaactgattctcaataatataggctaaatcaccaacttggctgtgaagacctatttcctcaagtacttctctcgcaacagccttattgctatcttctccaacttgaagcgccccacctggcaaatagtatttatcgagatgaggagcatatattaatagcagtttttgattttctatgattaaagcagaaactctgactccgaatgtttcgagctgttctctaaccctaaaatctctatttttcataaaaattaaccgtcttttcaattaaattttggtgttcatcataaacaaacttagcagaaaagaaaggaacatcttctaaaatccatttaaaaatttcgtaatctccttgccacgttggcttagaaagaacttgatcatatggtacccattctaaagttccttctcgtgattcatcatctgaaattaactctccttcataatctgttactttaaagacataggtataccaatcatgacctggcgtaaattcaggaaaagtgatgactcctttaaaatccattttttttaccgttaaatgggtttcttctagaatttcacgcttagcacattcatcaggagtttcacctgcctccagtttaccacctaccgagatccactttccctcatgaacatcattctcttttttgttgcggtgcaatagaagtaattccttgccattgtcaatgtaacaaattgttgctaatttagtcatttcaaactcctctcattctcatattataacaaaaaatagcctttatttaggcaatttactatcaaagtagcacacaaatgattaaacaaattattttgtttaccagttatttacttttcactttgatgacattttaaaggttctttatcataaacctttaaagcatgctataattaggaaaaaccggtttacaattttaaaacctaaggagtaaaaaatggaaatcaaaaagaaacatcgtattatgctttattcagcccttattttaggaacaatattggttaacaatagttaccaagctaaagctgaagagcttaccaaaactacctcaacgtcacaaataagagatactcaaactaataatgttgaagctccccagactgaaagtaccactgtcaaagagactagcaccacaaccacacaacaagatttgtctaactccacagcttcaaccgcaactgcaacagccactcctagcacaatgaaacaagtagtagataatcaaactcaaaataaggagctggtgaaaaacggagattttaatcaaactaaccctgtatctggaagctggtcacatacaggcgctagggaatggtctgcttggattgataaagaaaatactgctgataaatcacctattatccaacgtaccgaacaaggccaagtaagtctatccagcgacaaaggctttagaggtgctgtaacacaaaaagtgaacattgatcccactaaaaaatatgaggtcaagtttgatattgaaacaagtaacaaggctggacaagctttccttcgtattatggagaaaaaagataacaatacgcgactttggctttctgagatgaccagcggtactactaacaaacataccttaacaaagatatataacccaaagttagatgtctccgaggtgacacttgaactttattatgaaaaaggaacaggttctgttacttttgataatatatcaatgaaagcaaaaggccctaaagactcagagcatccacaacccgtcacaacacaaattgaaaaaagcgttaatacggctttaaacaaaaattacgtttttaataaagctgactaccaatacactctaaccaatccgtctcttgggaaaattgttggtggaatattgtatccaaacgctactggttcaacaactgttaaaatatctgataaatctggcaaaataattaaagaagtaccgttatcagttacagcttcaacagaagataactttacaaaactcctcgacaaatggaacgacgtgactattggtaatcatgtttacgatactaatgattcgaacatgcaaaagcttaatcagaaattagatgaaactaacgccaaaaacatcgaagctatcaaactggattctaatcgcactttcctttggaaagatttagataatctcaataattcagcacagttaaccgctacttatcgtcgtttggaagatttagctaaacaaatcaccaatccacactctactatttacaaaaatgaaaaagctattcgtactgtaaaagagagtctggcttggcttcatcaaaacttctacaatgttaataaagatatagaaggctctgccaattggtgggattttgaaatcggtgttcctcgctcaattacaggtaccctagctctcatgtataactacttcactgacgctgaaataaaaacttataccgacccaattgaacattttgttcctgatgcaggatttttccgtaaaacgcttgtcaatccatttaaagcccttggtggtaatctagtcgatatggggcgcgttaaaatcattgaaggtttacttcgtaaagacaatactattatcgaaaaaacttctcattctctaaaaaatctttttactactgctactaaagctgaaggcttctatgctgacggttcttacatcgaccatacgaatgttgcttatactggcgcctatggtaatgttctgatagatggtttgacacaattgctgcctatcattcaagaaactgactataaaatctctaatcaagaacttgatatggtttataaatggattaatcaatcatttttacctttaattgtaaaaggtgagttaatggatatgagtcgtggacgctcaattagtagagaggctgcttcttctcatgcggctgcagttgaagttctcagaggtttcctcagattggctaacatgtctaatgaagagcgaaacttagacctcaaatcaactattaaaacgattatcacttcaaataaattctacaacgtcttcaataacctcaaatcgtattccgatattgccaacatgaataagctgcttaatgacagtacagtcgctactaaacctttaaaaagtaatttatcaacctttaatagcatggaccgcttagcttattataatgccgagaaagactttggtttcgcactttcattacattctaaacgtaccctcaactatgaaggaatgaatgatgaaaatacacgtggttggtataccggagatggtatgttctatctttataatagtgatcaatctcattatagtaatcatttttggccaaccgtcaatccttataaaatggctggaacaactgaaaaagatgctaagcgtgaagatacgactaaggatttcatgagcaaacatagcaaagacgctaaagaaaaaaccggtcaagttacaggagcatctgactttgttggttccgtcaaacttaatgatcactttgctcttgccgctatggactttactaactgggatcgcaccttaacagcacaaaaaggttgggttatcttaaatgataagattgtctttttaggtagcaacatcaagaatactaacggcattggaaatgtttctacaacaattgatcaacgaaaagacgattctaaaacaccttatactacatacgtcaatggaaaaactgttgatttaaagcaagcaagttctcaacaatttacagatacaaagagtgtctttttagaatcaaaagaacctggtcgcaatattggttatatcttctttaaaaatagcactattgatattgaacgcaaagagcaaacaggtacttggaacagcattaatcgtacttctaaaaatacctcaatcgttagcaatccttttatcactataagccaaaagcatgacaacaaaggtgatagctatgattacatgatggttccaaacattgatcgcacaagttttgataaattagccaatagcaaagaagtagaattactagaaaacagttcaaaacaacaagttatctatgataaaaacagtcaaacttgggctgttatcaaacacgataatcaagagagtctcattaacaatcaattcaaaatgaataaagcgggactttacctagtacaaaaagttggtaatgactatcaaaatgtctattaccaacctcaaagcatgacaaaaacagaccaattagctatctaactagccgtacataaaaaacctatcatcaaaatgataggttttttggttcaattagttaatgacttcttgcgttttagcgtagttagcttcaactgcttctttctctgctttccaccaatcttggttttcagtgtaccagttgattgtttcttccaaaccttctgagaagtttgtgaattgtggttcccaaccaagttcttcacgcaattttgtagaatcgatagcgtaacgaaggtcgtgtccagcacggtcagttacgtgatcgtaagcgtcttttggttgacccattttctcaaggataagttcaagaacttccttgttgtttttctcaccgtcggcaccaataaggtatgtttcaccaatacgacccttagtcaaaatagcccagacacctgttgaatgatcatttgtgtggatccagtcacggacgtttttaccttcaccataaagtttcggtttgattcctgccaagatatttgtaatttgacgtggaatgaatttttcgatgtgttggtatggtccatagttatttgaacagttcgaaatggtcgcttttacgccgaaggaacgtacccatgccttaacgataaggtcagaagctgccttagttgatgagtaaggtgatgatggattgtattttgtttcagcagtgaatttttcacctggtccttcaccatttcctggaaggtcttcacgaagtggcagatctccataaacttcatcagttgacacgtggtggaaacggatatcgtatttacgagctgcttcaagcaaagtgtaagttccgataaagtttgtatggataaatggacttggatcgttaagtgagttgtcattgtggctctcagccgcatagtgaacaatagcatctgctttggcagccaacttgtctaccaattcagcgtcagcgatgtcaccaacaactaactcaacacgatcaccaagaatggcttcaatgttagcacggttacctgcatatgtcaatttatcaaggacagttacatgaacatctgggtggttattgtaaacatagtgtacaaagtttgatccgatgaaaccagctccaccagttacgataatgtttttaaattcagtcattttttctccgaaaaattttttctttttgctatttgaaggatactgttctgttagaagtagttctatggaatgtcatgcctaagaaatcaatatttcaaatccctgagggaacaggccttttgcatgtttcctttcacccttgcgtcaaacaacattgctaattcgtttttacttgctaaggttaatgccttttaagaagttgaaaattacaaatcttccttcttcaaaggttttacatctttgagaagtgggtgattcttatctgcttctgagacttctgcttcttcaaggttttcccactgaatgcctagatttggatctgcataattaacgaaagcatattttggtttgagttcaagtgcccaataatcgttaacgagataagtataagctgctttatctgaaagaacttggaaaccattagcaacaccgcgtggaacaaagataccttttgaggcatcgataatcgtttggtaaacgttaccaaaactgtcaccttcacggaggtcaacccaagtaccgatcacacgtccttcatcagcgatcgaaacatatttatcccaaggctctgcatggagacctcgcaaagtatttttcttgttaaacgaaatattattttgtagtttgtctgcctcaaagaagctttctgggaaaccaagcggtatcattttttctttttgaaagttctctttgaaccatcctcggttgtctccacgaacgggaatatcgaattccaacaatccaggaatagcttcaattgggcgacaagttaattctttatcaaaaaattgttcagtcattaggcttctccaatcaaacgaagtaggtattgaccatactcatttttcttaagtggttgtgccaactcaaggacttgttcacgagtgatgtagcccatgcggtaagcaatttcctcaaggttagcaacttgaacgttttgcatgcgttgtactgtttcaatatattgtgctgcttcaagaagactttcgtgagttccagtgtctaaccacgcaaatccacgtcccattaactcaactgataagtcacctctatcaaggtaggctttgttaacatcagtaatttcaagttctccacgagggcttggcttaatatttttagcgatttcaaccacatcgttatcatagaaataaagacctgtgacagcataattagacttaggttgcgctggtttttcttcaatagaaatggcattcatatcagtatcaaactcgacaacaccaaaacgttctggatcttttacttgatagccaaagacggttgctccactttctttactagctgcacgttgtagcattgcagataaacctggtccatggtaaatattatcacctaatactaaagcaacgtgatcatcaccaataaaatcttcaccgataatgaaggcctgtgctaacccatctgggcttggttgttcagcataagaaagagagattcctagttctgaaccatctccaagcatatcttcaaagcgaggcaaatcttgtggagtagaaataatcagtatttcttttattcctgctaacatcaaaactgacaatggataataaatcattggtttatcataaattggcatcaattgttttgatgcagcacgagttaatgggtacaagcgagtacctgaacctcccgctaaaataatacctttcatagtaaggtctccttatttatattaatcctacatattataacactttttttaaacgctatcatctactaatctttttcacgtattttgtaatatcgtaatcctctaaatttagctgattttctttatttaagattaattgacataattcataaccaattaatgggcccactgttaagccagttgatcctaatccacttgcagcatatgcaccctccatacaagggacagggccaaaaaatggagaaaaatcacttgtataggcacgaattccaacacgttcagaagtcgtatctgctttttttaattgcggaaaatagccaatagcttgctcttcaaacttgtctaagactttaaaatcaatgtttaaatcaaaagccatatcattttcgtgacttgcacctacagagactttaccattatcaaatgggataatatctagctcaccttctggcattacaacaggatattttcctgtattaatattgctaaaataatagtctcgcaattgccctttttgagggcgaacatctacctgatagttgtgctcatctaatatcttagctagccaggctccactcgctaaaacaagtttatcaaaatcaattccttgaacacgaaagccattatcagttatcgtaaagtgaacttcatccttgatgacattaacaccacttgcttctaacaatattcgtgttaagtccgccccttctactcgtgctcctccgctcgcataaagtaactgttcatagccatctaactcaggaaagtgagtatttgcttcacttttatttagtatttgtaaatcacctattagaggagattctagtcgacgtttatctgctagtgcaaacaatgactctaactgactctcgtccttttttaataagaaaacaccagtttgctgataaaattttgtttcaaaaccatctttttgtaaatccgtgactagctttgaataaaaatcagcccccaacctcgccatacgataccaggctttattacgacgttttgaaaaccatgggctaataatccccgcagcagccttagttgcttgtccaactccataatcaaaaacagtaacctgaatatccttttcttttgataagtaataggctagtgtcgctccgactgctcctgcaccaataattgctatctttttcataatagctcctacatatggtaaaagggatttgttggagctttactctctaaaactgaaatatcccagcctttttcaagtttccactgctcaatcatagtagctattttagaaacaaataaaacctcaatatgatgacctgggtcaatcgcaagcaaaccatttgtgatcatttcttgtgcagtatgataataaatatctcccgttacaaaaacatctgctccttttgcaatagcttctttgtagaaactttgcccactacccccacaaatagcaactcgttgaatttcaggattagatttatcatatgaaactaaacgaacgctatctaaaccaaacacatctttaattttccatgcaaaaaattcaaaactctggggtctaatatcaccaatgcgaccaataccataaccattacttgtctcagataatatatcgggatattgaatatctaataattcacaaaaccagtcgttaagtccattaggaacgatatctatattagtatggctcacataaacagcaatgtctgatttaagaaggtctatataaatcttattttgcggcgttgctaccaaatcctttaatggacgaaaaataggagcatgctttacaataagaagatctacttgacgttcaattgcttcagctactgtagtctctcgaacatctaaagctaccatgactgtctttatttctttatctaaagatccaatttgaagacctgaaatatctccttccatagataattcctgtggacaataagtttcatatacatcaataagttctctagctttcatcaagaacctcctttatatcctgtattttatcttccaaaatagcgcgttcttccattttactattgggaatagagtttaaagcaaaagttaatttattaagctcattttgccatttttctttaaaaaccgttgtgttattggataataaaaatggaccaaatcgcaattctttagcagttaaattcatatgaccatgcttaacaactaaaatttcatagcgtttgtcattttcagtcaagatatcttctgctactatttcaaaatcatttgcagctaaccattttcttaaatcatcttcccgattattaggttgtaagactagtgttttaacgtgctgaagtttgtctatatcgttattcaaaatatcagcaatcaaacgaccacccattccacagatagttatcgtatcaatattatctgcttcttcaaaagctgacaaaccatttgctaagcgaacatctatctttgaagtgagaccatgttctgaaacgtttttcaacgcagactgatacggtccattcaccacttcaccagcaatggcaaaatcacagtatcccatctgcaacaaaaaaataggtaagtaagcatgatcacttcctacatctaataaccgagctccttttggaacgtagtttgcaactttttgtaatcgttttgataattgtaaatccattgtatttccttcagtttttctctgttaaaagtataacatcattaacatcaaaagaaaaggagcagacctaatgtatcaaccattctgtctcctcctagtaaacttattcccataaattcattgcatttttaaaatcatccgaaatcgctaaatctttcatttggttatcttcacgtgcttgttttctctcttcaatttgtcgaagtgtcgtcaatccttcacgccgccagttgcgaaggatagcattgatataattccaacttgttttcccattgaaaaccgcttctctaagagctgccctaacaatatcaggatctgtctgatcttcttgcagtgtcttttgtaaatcttctaattcaaaaggacttaataagcgacctaattcacgttcgaagtctcctactaaatctttcagacgattcgaatcagaggttttattgtctattattacttgattatcctcttcgaaaagtttatctaatttagcaaacacagggcttgtatcaaagataatctcgatttcatgattcaactcaattgttttgacatctagtaaaccttgacttgttaaattcgatatagaacgattgatatctgccactgttttatcaagtgatgtcgcaatacggctcggtgttagatcggataaattagttgtattttgtaaatagaaaaattgccaaactaaaaaatcgtctgctgtcttaaaaatagatttaaagtgaaaaaataaagcacttggtagagtcaattgccctgactgatattgttccaaataagtcataacctttcaaatcctctctatcgtcctaaaattatgaaatgtgtaacaaaaagcacctctcaactattatcatagcacttagaggcgcccttatcattcatctatcttgaataggccttatcctggaaagttcatcaataccttagtatcataaccttcaatagctttacgaccatttaatccatcaagttcaactaggaaagcacagcctgcgacaacgccaccaagtttttcaatcatttcaattgtcgcttttactgttccaccagtagctaaaaggtcatcaacaattaaaacacgttggcctggtttaatagcatctgcgtgcattgtcaatgtatcaagaccatattctttttcatagtcagctgaaataacttcgcgtggtaatttacctggtttacggactggagcaaaaccaataccaagagcataagcaactgggcaaccaacaataaagccacgagcttctggtccaacaatcatatcaatatctttatcagcagcatattgtacaatttcacgaacagcatagctgtatgctttaccatcagccattaatggggagatatcacggaaagtaattccttcttgaggatagttttcaattgaagcgatgtaattatttaaatccatttcacttgtctttctaaggggaaacccctaaaatgttttactcttcattatatcataaaattaaataaaatagtactggaaactttaaaaccatatgctagttttgcatatggttttaaaaattaggcatctgttaccttgacaaaaggtgctccaatatcaattctatcctcactataatagctctgttctttccaaagttgtgaaattggataccaaccagacaaggacggtgtgtaagggtcagagacatgtgtcagtccgttattatatcctttgagaacgatttcatgacttccatgaagaacaaaaacattattttgtactgccgctaggacatgataaccatccttcaacgcttgtacaaggttagcttgagttcctaatgcagttgcagttacaccccattctttggctgcttttaaaattcctctagaagttgttccttgaacaccacgattaaattcaactgtcttatggtaaaggtaatctgcaatttgcgttggtaaaacagtttctcctttcaaagaagacaaaatcatagctagagaagttggtacacaaccagtttctcctaaagttgccataccatatcttcgacttgcccaccttccatcacgttggctaaagtaaggagtattataatttgaatgtgcgacttgtagagaagtttttaccaataattgtttttgattagaagcattttcctgataaacatggataaagtatttaccattgtctctatgatttgtaacattaaatgtcaatgtagcttcatgatttttgggtgcgacggtataccacttaaggtcatcctgattgtttttatctgaccaaatagcaatttttaaatccccaggactaataacatttgtcactcgtacattatagtttccagttcccttataagtcgtttggacagttaccggtattttagcagtctcaactaatttaatttcgattgcttcaattcgttttccttggttagtactaccagcgatgtcattgttataagtccaatcctgccaaccataatcttgcatgtgaactcgatacatcacactataggttttcgatagcagacctgtcaatcgcatctgaatagcttctacttgttgagattcatttggtacattactttctctccctgaattaacaacagtttgccaacctgaaccattaagaaaagttctatattctatatttcctagagctgtactacctaagttaagtttgatggcttttatagattttgaaagtccaatactacctcctaattggccttccaaaaccgttggtttccaaccatctttttgaagataagtttgataacttaatccaggatgcttcatttctaagaatgaatgatttgtttgggaactaaaatctgaagctttagctactagttttacctccaaagcctctaaacgtttcgattctccgactgtacctgctacactattatttttttgccaagccatccaacctttatcttggacgtgagcgcgataataaatatcataattttgttttaaattcccacttaagtccaattgaatagcttctagtctttttccttgataatccttacttgtttgactacctaaaatttctccccaacctttatcttgtacatgagtacgatagagaatgtccccatacttcaaggtgctaagagtgaattttactccatctagggctttggattctcctaaagttcccgccatttgtccttcaagtttattagattgccaaccattttggcctaccttaacctgataatttaagacaggtctctcttccttaggtatagttggtgttaaaacagattgtcctttaagggtaaattttacttcgtaagcttcaaggcgctttgacattcccaaagtcccagcgtaagctccatttttagcccaagccatccacccgatatcttgaacatgaacacgataatagacatcatataatttttgtaaattatcagtaaggttaatgcttagtgcttcaataggtctactctgaccaacagtaccactaacttgaccactctctactgaaggttgccaaccttgtcctttaacataagttttatagctaagttttcctgttattccttcaggtgctttaatagacaattttattgcctcaacctgcttttcttgtcctactgttcctgaaactgttgcattatcaaccgacttttgccatccaatatcttgaacatgagcagagtaagtcactgttggtaattgctttgttgaattttgttgagtaataacttcactatcattagctacttgattaacattagaatttgtttgatttgctgagtgctcagcagtactagcttttacaacaacttttgagctagcatcaaaggttttgactggggtagctgctatctctctaggattagatgaaacagatgtagcaaaggctgtttttattaaaggctctgcactatttttcatagcctccgaggaattaacaggtaacgttaacttggaagtatccgaaatagtctgactgctatcagttttctctgagatcgttgaagttactgcttctgcctgttctgccttgacatcttgaccaagaattgcactaccacctaaaatggtaacgatacctgcaacgacccaaaatttgccttttttgtacatcttttttctaacgataggtctcatagattttatcctcgcctttaatattctttatcaaaaattccattattttcttaattttattatattttaataatatttgcaatattattattgaaataacttatttatataccaaaaaaaccacttaaaaagtggtttctttagtatattatcaactcatcataaaatcatatatttctttaggtgtccctaaagccattaattcttgaaacttaactgtctcttttaattcttgataaatttgactctcagagatatctcgcttttctgcttctttattgactgtcataatcccttctgtaatcgtaacaaaatgtagttcttcaaaaatttgaatcattttaattaataaaatatcagggatatgaaggtaggaactgagctcttttaacttataacgaacgtcaaattctgggaattgatatattgttttatataaactagcaaactgatcacgtgtaccataaccagatataaaataattttttggtatctcatttttaaaatagatggcatcaaactgtttaccttgagtcatttgttttaattcttgtggatgatcgggaacagtcaaaagaataacttctttgctctgctcttcttgagacaggattggcactccatgaggtaaactacttgctttgcttctaatatcaaataattgaataccgtctacacgcgcatcctccaacattaattgtagggttgtggcaccattccattgattaacagataaagtgacagctaactccaaatgttgtgcttgttggaactcttgtagttgactccccatattaaatgctaccaaatcaagtgcttgtccatcttgttctagttttaatttcagatgagcaccgttttgccccatgactctggcttgactcactttaaaatcttttaacaaaaagactggttttttattatccattccaaatggcgctaacttttcaaaatctctaacagtgtctaaactaagttcgtcaaaacgtagctcactatcaattgtcagagtttttttctgactcatgtccaattgttttttagagatatagtcacataaaacttgagaaagatcacctactttactttcctctaaagtcatgcctgctgctccgctgtgacctccaaaagcaatgaataattctcgatgctggtcaaaagcttgaaaaatatcaagtgcttctacacttctggcacttcctttagcaataccatcttcaatattcaaaacaataacaggttgtccagttctctctaaaatacgacccgccacaatacctaaaacccctggatgccaattttcttttgctaaaacttgtacaggctttgtttgatcaagcatttgcatagcttggtcaaagatagtttgaacgatttctttgcgctcttcatttttttgatcaatcatttgggctattgcttgagattcttcatcatcaaaccctgttagtaattcaatagctggattagggtcatcaagtcttcctaaagcgtttaattgtggagcaattttaaatccaatagtttcttcatttagtgtttttaaatcaatatttgataaagatattagctcctgtaagcctattctttcactatctttcataacttcaagtccagcttttaccatgatacgattttcatcagttaggctaaccatatctgcaatcgtcccaatagcaaccaaatccaacatttctgtcgggattgtttctaagagagcacaagctactttgaaagcaacaccacaccctgctaaataaggaaatggataattagcatcaggatgttctgggtgaataatagcataagcacaaggtaaatctgctggcatactgtgatgatcagtaactaccacgtccacaccttgattttgagcatatgtaattgcttcatgccctgccacaccattatcaaccgtaatgattaatgaaacatcttgttgttcaataaaatatttataaacactttgattgggaccgtaaccatctgtaaagcgatttgggagataaacctggacttcagctcccatcatatctaatgcttctttcatgattgatgctgatgtcattccatcagcatcatagtctccataaactaaaatagtttcattattttcaatagctcgtctaatacgattaacagctttatccatatcatttaacaaataaggatcatggagattttccaaattagtttgtaaaaaatgatgtaattccgctgatgtcttaatacctcgcgaataaattaaggaagccaccgcttcacttatcttttctttttttgaagcctcaaaaaagccagcgtctggcttttggttattgaggacccaactatacttagcagatatcatttataattgaatacctttctggcaaaataatcagctgtttttggaaataaactataatatttatgcgcaaaagctaatataaaaggaagatttaattctctcttattttttccaagaatagaaactacttttttagatactttttctggtgttagagcaaaacgacctatacttgctaaataatcaccacttggatcagcctgagcaaaaaatcctgttttgattggtccagggtttacacttgtcacataaacatttttttctgctaattctaaacgaagagcattcgaaaatccaacgacagcaaacttactagccccataaacgctagctttacttgttgctatgaggccagccatgcttgcaatattaacgatatgaccagattttacaagagacatcttatgtcctatctgacgagctatagacatcgttgcaaatgtattcacagcaaacatgtctttgacttcttcatcactataatcccaaaattctttaaaagaaccaaatccagcattattaattaaaatatcaatttgaccaaattcaccataaattttttcaatcatattcgttacagcattgtcattagttatatctagtgataaacataaggtgtttggtctctttccataaagcttttcaagtttttctcttgatctccctgtgacaattaaatggtcgtcttggggtaattggttaataattgcctgtgctaaaccaccagaagctcctgtaatcagtatcgttcttgccattttatatacctacttcttccaaatctctaacaagatgggtatttgaaaaaatcgtctttgcatcttcttccatttgccaacaatctcgccccataaaacgagcactaacatgatttaataatagtcgtttagcatttgcttgtttagcgatatcagctgcttgcatattggttgaatgcccatgcgatttagcaattcgctcatcacccttaccataagtagattcgtgaactaaaacatcagcgcccaaagctaacctaatacttgcatctgtttttctagtatctcccaaaatagtgattactttaccctttttcggttcagaaatataatctttagcaataatttctctaccatcttctaaggtaacattctcaccatttttgactttcccaaaaagaggaccaaatggaacacctgctagtttcaatgcttcagcatctaaagtgccctcaagatctttttgcacaacacgatatcccatacaaaagatagtatgatctagcttttctgcataaacggtaaatttatctgtttccataatttttccgagtgatgattcatcaaactcgtgaaaatggattcgataaggtaaacgtgaacctgatgtccttaaggcagtcataacaaaactttttataccaaccggtccataaatatctaaatctgtctgctcttcattggcttgaaaagcccgactggataaaaaacctggaagaccaaaaacatggtctccgtgcatgtgcgtgataaaaatttttttaactttacgaggtttaatcgtagtttctaaaatttgacgctgtgtaccctctccacaatcaaacatccaaacctcgttaatttcatctaataatttcaagactaaacttgaaacattacgagctttcgctggttgaccagctccagttcctaaaaattgaatttccatacttgttgacttttttataatccttccataacttaataaatttaattagtagatttagtatcaatataaataactgactcacgtccttgactagaataatagtatttacctgactttgttttaaccaactctaatagctcttcttgattgaaactagttattttaataatatcttttttaagttgtaagacattccctagtaaacttgtttctggtgtaatattttgagattctgtttcgtcaaaatctatttttgccattctgataccagaccgatctcgatagactttatattgaggaaaaatctgtgcaatttctaagagtaactgcggtgtaatgacttctttaacttcagaaaaaacactcgcttcttcttgatcatttaggtaagcaaaaccaaatgattttcctgataaattcaaacgaataaaaggtttttcttcatcaaacgataaatgttttggaaacaagcccaaggctttggaaagatcaaaatagtaatcagttgcagcttctggcccttgcttttgatatatttcagcaaaataagcattaatcacactaggaggtggggtgataaaatcaagtcgttgctgcttagagaggccatctagttttttctctagataaactttatctaagctcgtaaaaccaccataagtcaaagctaaatcaatataatcaatcataaaattcttccagcttccatttttgtttaggagaaatatagcctgtaatattctcgtattcttcttcaaaggtgtaggtatcaagcaatgctattttattgagatcatagagcttatatgcttgattttgatgcactctaatcgaaaattcgtcaaagatatgtcgtatttcatccacaataagacggcgtaataaatccttactcccttgttttttggctgcaattctcacatttggaaaagttgttgcattcagctgctcagtgacatccatcttgttgtatatcgctaaacgaggaatatctatcatatctaagtctttaagaatctccataacaactttttcgtgttcttcatgattagggtcactagcatcaataacatgaaataataaatcgacatgtcgactttcttctaaggtagacttgaaagccgcaactaactctgtaggtaaatcttgaataaaaccaacagtatctgttaaagtgacttgaaattgattttgtaaatagatctgcttggttgtagcgtctaacgttgcaaataattcattggcttcatattgcttatcatcggttaaaacattcataatagttgacttgccagcatttgtatatccaattaatccaattttaaaggttgtcgaatcaacacgtctttctcgaactgtctcgcgatttttttctacaatcttcaattgtctttcgatatcagaaatttgatgacgaatggaacgacgattcaactctaactgagattctcctggacctcggcttccgattcctcctgcttgacgactaagcataataccttgtccaactaagcgtggtaacatatatttcaattgcgctagatgaacctgtaattttccttcatgacttctagcacgcatagcaaagatatctaaaataagttgcatacggtcaataactttaacaccaagttcagcttccaaattagagttttgtcgcggagtcaaacgattattaaccacaacggtatcaatctcatctgcttctacaatagcttttatctcctctaatttaccagatccgataaatgatttactatcatatttatctcttttttgataataatgattaacaacatttgctcctgctgtcttagctaagctagcaagttcttccatggacatttcaaaattctcagtatcttgaagttctaccccaactaaaataacacgttcttgctcttctttagtttctatcacctataatctcctttcaatatttttttcttgttctaaatacgtaatctttattataacataatgccctttaaatgcgagaaacggctttatttactttgatgataaaaaatcactgacttttcgcttgattttttgttgataattttcctcaccaaccataataaattcgacattcatacggtttctaaaccatgttaattggcgttttgcaaaacgtctggtattttgttttagtttatcaacagcttcttctaatggtatttgctttgaaaagtaaggaaataattctttatagccaattcctttacttgcttgaacactcgggtagttatcgtatagccatttagcttcatctaagagaccattgtccatcatcaaatcaactcgtctattgatacgatcataaagcacctgacgatcatcattcaatccaattaataaaacatcatacggactttcactattttgcaaatcattcccaaacttcgccaattctaatgcacgaatggcacgtcgacgattaacttgtggtataataatggattgttctgtcaacttttcaaataaatcttcatcacttagagactctaatttttcacgataggccataagagtttcttgattgacttcgcctcctaaatgatagccctcaaacaaactctgtaaatataggccagtacctccaacaataataggaattttccccttagaaataatcgtatcaatagctacttttgcctctttgacgaaatcataaaccgaatagttctcatttacttcacgaacatcaatcaagtgatgataagcttgttcttgctcttctttactagctttagccgttccgatatctaacttctgataaacttgctgactatcaccactaatgatttcgccattgaaagttttagctaattcaattcctaatgctgtcttcccaaccgcagttggaccaacaactgctataagtttgatttttctcatgatacttctcaattctataaaggtttttacttgaaatttaactagtatttcgttaccataattatatcatagatagaagcagagtcttcatcatagattggagaattattatggttaaaaaattcgcatttgctaaaggaatagcaacaggagtcgttgcaacagctgctactcttgcaggtgctgcatttgctatcaaaaaaacaattattgaacctgaggaagaaaaaatagcttttatcgaagaaaatcgtaaaaaagctgcacgtaaacgtgtctctcattaaataataactcccttactagctagtaagggagttattttatattaaattgttcgccttaaaaagaaaatataacgtaccattactatcataacaataagagttgttgtcccaatttcaaagtggactagcccctgtatatcaactggtaatgatagatgctgaatacttaatttaagtgaggtagctgagataacaagggggaaagtaaaggctgagaaacctggtgtaaaatcaccaatcagtaatttaggcacctgaaaaagaatgaaaaaataaagaaattgtgccattacgattaatagcagtaataaacctctatttggtgacacaaaactattgacatatcccgctgtgattagcgacattggagcgcaaatagtagttatattaggcttaactgccgaaggtagcccgattttatatgctttaatgaatagaaatggtaataatactaaagttgcaataaaaccataccaaaagactattttcccaatagtaaattgtccactaattggtgctgtcaggctagctacccctataccaacatagaggacagaccaagaaggaaaaagattagccatcgaaaagtgtctcaaatatttccatgaaaaaatagccatatgaatgattaacgcaataaatgacaaccaccatacaccttttgacagaactgctacccatattcctaaacttctaaataataagatataggttgataaaatcatacctgccataaaaaaagtagtaaagacagaagcaatcaaaggattgcttaactccttcctgctttcttttttattttttaatattcctttgattaaaaaaatccaaaaaacaagtgctactagccctaaacaatagcgaacataggtgccatatccctctagaaggttccccaaagctaatagccctaatactaatcccgccatcactaatggtggtttttcccaatttttcatcatatacctcataaaaaaacgtttacatctattataacacaattagattttgctgataagtgattttattaacttaatgaaaagaagctagtccattgactaacttcttttttaagctcttctaaagtttgcttttattttaagtgacgattcctctttaaagagagacctactagagcaagtagacttgctagaatgcttattcctactacacttagtatttttgatgacttatctccagtttttggcaaattagcttcatttgtcagatatgaatcggccttcttagaaactacaggagttattgaggtcttattagctattctatttactttttctaccgttttagattccttgaaagattgtgttttgggataatctgcttgcaattcctccttagggctaggagcaactttgccaactttaatcacaattgctgttaatggatcaatcagcaaactatctttttcaaaatgaacacctctaggagttgagattggtttaatccccgcttgatcagcatcaacaattacttgcccttttaaaaggtgtttatatttttcacctagtaaaacgtttctagctttactatcagcattaacaaatactgcgtaaatatcacctttagaatctattgtttggtaagcaataaccaaatctttttctttaatatcaccttgacctacctctgtaatcaagctaacctcacgatcaatttctgctttgctcaattttcggaaagcatctgttgaacgccttaatgtgattaaacctgctgtataggcctgtgttttcgttgaaattgggtgtttgttattatctgtggctgctgcccaatcaaaatgattaatggcatctgaagaatcatatgaatcatgaataaaatatgggtattctttaacagcttcaataagtgttgctttattaggcaatttgtcatctgaaacttttgtcatgtaatcagggttaagtaaacgcttcgtacgaccatactcttgaccagaatgaatgaatgctgtcccttgagatgttaaaatcattacatttcctaaacgcagacgtctatgaatctcttcttcagctaccttagggtctttattaattgattttgcaatcacatcatgcaaggtaaggttatcatgtgcagcaatatactgcaccacatctcctggcgaatctgcttcaaaattcccaggttgtgctttgatatttttaaaaataccttgtaaagattgtgggccacctgtgatgaaagctggagtaccttcatttggaaaaccagatttcaagctattacgaatatcatctgaaaagacgccaactgtatcggttgacttcatccaatcttggtcagctggtttaaccggctgaccttgatcgccttggaatgttctccagccctcaccaatcataatcatattaggattaatagctttagcttctttataagctaattcaatcgcagccgcatcatgatctcccatcatatcaaaacggaaaccatcaactttaaattcacttgtaagatatttaatggaatcaaccaaaacacgacgactcattgcatgagtggttcctaaacgtccccctccaaaactttctcttggtgaaccatcttcattcataaagtgataataattaggttctatatcctcaaagagataagtttttgcagtgtgattatagacgacatcaagtataacccccatgccacgtttatgaatatcatgtattaattgttttaattcggcgatacgtgctgatggatcttttggtttctctgaatacatcccagaaagagcaaaatagctctgtgggtcatagccccaattgtaattattgtctgaggaagtgtaagctgttgagcgtgacttatccatttcattaacataaaaataactcaataccggtaaaagctgaatgtgtgtaactcctaatttctgtaaataatctagtttctctgaaaaggctgcaaaggtaccaaattgattttttaattttccatccaaagatcgatcagaagtgaagtctcttacatgtgcttcgtatataacagcatcttgtcttcctttaaaattagcaattttagcaaaacttaaattttgaggtccaagttgacttggatttacaaaagctgctttagccgttttaatatcatcattaacagtattactatcccactctgctaatgactttgcataaggatctaaaatcttaaccttatccttacctctttttatttcgtaaagataatagtaaccagtatagtttttaatacctaatttagtatcaagtatcgtctgccaaacacctttattatttttcataaggggggtagtcgctacaaccctgttttggttatctttgtcataaataatcatagtgacactatcagcactcggtgaccagaggctggcttcaacttttgaaccatcttgattgagaactgcacctaaatttccactataagcataaagttggtctttaaattcccaagattgccttgtcatgacattgttaccattataagatatgttgaaatgaccttgtttaggattaaagtcgcctttgattattaaaagagatttactagtatcgagagtgatatcagaaatttgtatagcattttgatttttatcagtcactttcaattcttttaaaatttcagttttatctaccccatctagagttgtaaaacttgcttgaatacttgttaaatcaatttgttgggcatcctttagctgcacttgatcaatgtaataaggattattataaacctttggatccttatcttttacaaaaatttggttatggttagctaaatctctaaaaacatagtcgttgggttgaactttcactgcatctcctgtcttactttcatctaagattagaaaaccaatctctttggcgttagtttttagtgatacatcaatataccttccatatagtccttgattcacaaaattactaccatctggccaagttgttgagggggttgcaacatctttaaagagccatgctgataagtggtcatagttactagaggaactcaaatagttaatacggacatacccttctttgaggggttgataagtatgtgtaccgtacttttcatcaatccaaacttggttcatctcaggtcgtaataatggaatatgatgatcgccgcttaaatttgtccctgctttgttattaattaaaaaagatatttgttttcgttgtttttcagataatttaaaatcaacataataaccgtaatcatctttcttagcatcagtcatagggatagcaccatttggccaattactagacggttgatcaacatctccccatatccaaagtccagtgctttctacaggatgaccttgaggcaattctttaagatgtagcctaaagtaaccattttcaatccgtggagcttgattagctactttcaaggtagggcttggagcacctatagcttgagaagttttgtcgggagtattttgcaatgtagatggtgctacttttaaatctaaggtatttttatctgaaacaggacctttattttcttcaagcaggcttgtcgccttatccggctctgtcactcccttttgagtgtcagtttcatctgatactaattgcttggtatccggcatatctgagggtgtcacaaccgtctcagagtttgagtttatgtcatcttttaaattagtagattgttggttgtcaacctgattaatattcgactctgcaatcgctgtatttgcaggagaagcacttacttcttcagcaaatacctgtggactatgaagaaaaatacatacccctgttgcaactgaagctactccaacacttaactttctaatcgtgtattgagtttgtttatcaccaaataagtcttttcttttcatatcattctccttttttaatgaattgttaccaataaaatcataacaatttacgcaagcgcttgcaacaagtaaatgatttctttatttttttgaaattttcactaaaactatcaatagcattacaaaaaagctaagcaatattgcctagcttttttatcaaaaatttcctcatatcaaatgattttcatcaatttgatagtcctttagcagaccttgaagtctatcaaattcataacaaaaatgttcaggaatatgaccgtcagagcctatagagtattgtttacaaccaagctgtttgagtatctctaaagcatagcgataaagtttttcattcccatatagataaagggatttggtatttagttcaaaagctaaccccttagataacatctttatgaaaatgcgcttcaattgcgtttcaaacggttttaaatcttctacatctaagtttaacttacgaaaaccataatcaaagtgagctaaaacgtgcgcttccacacggcctatggcaaattccatacgattaaagtaatctgctaaaagctcctttgttggtactttcagagcttcttcttgcagataatcatacctaccattatgatggattgacaatagttttaaatcaaattctttattttttaaataatctaaaatatctgattccctatctttaaaataaccgatttcaattcctttttaaatcgatttccatatttctgattaagataatctattttttgacaataagcactataatcaggaacatcgtcttgaccggtgtaaggatttgataaatcaaaatgttctgttgtgataaattcacctgtaaaaccattaatatagtcctcaaatgccgtttgacaatcataggaaaaatacgtgtgtagatgattatctctcataccaactcctatccttaatcttttaaaatatctgctactatcttttgtaaatcaacgattagatctttttcaaaccatggattcttctttagccaaatttgatttcgcggtgatgggtgaaccaggggtaaataatcgggtagatagtctttgtaagctttaactgtttctgttagatttttatgtgcggagcttccaagataatatttctgagtatactgaccaactagcaaggtcaattgaacattaggcatttcttttaaaataagagggtgccatttctccgcaaaaccttttctaggggataaatctcctgattttcctttgcctgggtaataaaaatctaaaggtaaaacagcaaattttccagaatggtaaaatgtctcttcatcaactccaagccactggcgtagacgatctccagatttatctttccaatagagtcttgcttcttgagtttttaaaccaggtgcttggccaacaatattgatcctagctgttttaggagcagcaaacaaaggatcaataccattttctgtataattttgattctgtgaatcactttttattgctttaataattttttccaagtcagtcataaagtctccaaatctaaccttatgaaaagaggcaaagacactttcatgtcttcaccaccctttatcattgatcacatatttagtttaaggattattttatttgattaattcatagatagcttctgcgtagatagcagccgaacggaaaatattttctaaaggcatgtactcattagcttgatgcatagtgttttcatctcctgggaacatggcaccgtatgcaacaccccgttcaagtaagcgaccaaatgtcccaccaccaataacctgttcatgtcctttaagaccagtttgcttttcatagacagctagtaaggttgatactaattcatcgtccataggtacatagtgtggtgtgtgttcatggtcagaaagagtcactttttcaactccgttaagtttctcaagcttagtttggatagttttagcatctgtcccttgtgggtaacggaaattaagagcgatagtattatcatcattagtttcatcaaactggaagacacctgcattcatgctcaatggtcccatacagtcatcttcataagctactccaagtttttcacctgagaagtcttcgtgaataatgttggctgtaacatctaagaaagcacgagcaggaccttcaaaatcaaattgacttagataaagagctaaataagtcgccccattaacaccttcttgtggtgttgaaccatgagcagatttaccataaactgttgctgtatattgctcatcttctacagataattctgctttcaaattatgtttacttgcaaaatcagctagactagccccaagtgttgtctgatctaaatgacttgtgaaacgtgctgtggctgattctggaaccatgttttcgcgaagtccgccagaaaagctatgcagtctaacagctcccttattttctcctgaaaaatgtaaatattcagtaatattacctttttcaccatttataattggaaattctgcatctggagagaaaccaaaatcaggttttggaagaccaacatgttcgaagtagtaatccatatctccccatccagattcttcatcagttcctacaacaaaacgaactttcttagatgttggtagcccaagctctttaataatttttagagcataataacatgccattgttggtcccttatcgtctgatgagcctcgagcatataaacggttatccttgataactggttcataagggtctgtatcccaaccgctgcctgcaggaacaacatctaaatgcccaaaaatacctagttcttcttcgccttgaccaaatgtaaagtgtcccgcataattatctacgttttttgtttcgtagccatctcgctcagccatctcaaggaaaaattccaaggcttttacaggtccaggaccaaatggatgctctgcatcagcttgtgaatcatcacgctccgagttaatgcgaagaagatttattaaatcgtccatcaaagcgtctttgcgtttgtctacttctgctctaaaatcaattgtcattacggcaactccttctataaaatattatgtagtttgtgcttaaaaattaacgtttttcaataatatgatcaactggcaaacgataactaggttcaaccttttcatcactataaccaacagtaattaatatttctggtctaaaacgtttatctatctctaagacatcattagtaatcgctttatcgaaccctaaaatcatattagaactaataccttgatctgtcaaggcaagtactaaattcatagcaacgatacctgcatttaaagagagatactctccagtttgtttttcactatataaagcatagcgtggtggtagagtttccatgtaataaccaattaaatcatcaggaagagatctacgaccaatacgagctattttccgtgatctctgtcctaaatctgtatctgtaaataaagcaataacatactgcgcttgattaatttggttacaattactttccggtaaaccttctgctagagcagattttttttcttggacaacgacaaacttccaaggctgaatattattagcagatggcgctaatgtcgcaatttcaatagcagttctaacatctttaaagtcgactggtttatcattaaaatgtttcacagcatggcgcttcttatttaattctagaaatttcataaaaacctcctattctatttgattttccctactattctatcactttttaaaatgcgtttcagcttttgaaggcaaaattgataaaaaagtgaaaccggtttgaaaactaccataaaaaacaaacaaacttgtggtacaatatctaatgactataaaaaaggagctattcatgctacgagcattaaaagaagatttttttctaaccttaacctctttaaaaaatcaattttgggtttacattggaactggtatcttaatccaaactttagttgcttatttagtaaaaggaattctgagttttatctttcgtcggatattgatattgtcaaatactcccgcagtgactaaagacaattggactttactttttaatcatcccttagctttattactctttatactttatatcgtaatcctaattgggttcatctatactgagttcgctatctatactattgccatactgaaaactgaattttctctcagtatcaaaaaatggctaacaatctttcctaaaaaaataaaatcacttttaggaccacagctaatttgggtatcaatctacttacttttgacaattcctctagctaaccttggtctaaggtcaagtatactagagcatcttaaaattcctgactttatttctggcgagttaacaaagacagtctttggaaagataggttactctacccttttactgcttatttgttacttaaacctttgattaatttattttctcccgctgaccattttaactgactacaatgctaaagaagcacttttagagagttggaaacttagccgcggaaagcatcagtggcgtcttctaagtaaaattattttaaccagtttatttatatctgtaattggaacagttgcactagctgttgttgctggtacattttcattcattgatcattctggaaacaattttcctcttcaagccactttctataaccttttaaaatcaatactttttgccgtaacacttcttattaaatgtttaatcataagtcacctattagcagatattaaacaaaataaaagtattgttcaacaatggagagcttggaaaggcgtccaacataagcaaaaatttaaacacattgcttgtgttatcctagctctagctattggtaccactgccttaaaaaatgctatagctctggctctcctacaagataacatttcaattaaaaaagaattaatagcccatcgtggtgatacatcacatggcgttgaaaattctattgaagcattaaaagcagcccataaagcaaaagcagattattcagagatggatgttatcatgacaaaagatcataaattagtagtcatccatgatgataatctcaaacgactctctggtatgaacaaagatgtttctaaactaactttagatcaagttacaaaaatcccaattcaccaagggcgttttgctagtcacattccatcatttacagaatttatgaagaccgctcagtcactagatcaaaaaatcatgattgaattgaaaccgtataatcaaaacctcgatatctatgcggatgaatttatcaaagaatttaaagagcttcgtctctcaaccaagcataaagtaatgtctctcaacttgacactcattgaaaaagttgagaaaaaattgccacaacttgatacaggttacctaatcccactacattggggaacgcttcaaaatcataacgttgacttttatgggattgaggaattttcatacaatgattggattgcatatctcgcccaagaatataataaacagctctatgtttggactattaaccgtgataaccttatgatacgttatttacaaagcccagttaatggaatcatcacagatgaactcaaccttttcaaggtcattaataaagatatcaaaaatagccctaattattatcaaagagctctccaacttattgatagcgagggttaaattaaataaaaagcttagtagaacagtatctactaagttttttatttaggaggatcattaagagaatctcggagactttctgcaacagtcctaggaataccacacataataatgtcctcaatctcagctttttggatattaggtaagcttttaaaatgtttcattagcaattgtttacgttttggtcccaacccagtgataccatctaattttgaagaaaaggaatttttggagcgtaattgacgatgaaaagtaatagcaaaacgatgtacctcatcttgaatacggtgaagtaagaaaaattcttctgaattacgcggtagctctactacttctaaaggatctccaaaaagtaattcatgtgtttggtgtttatcattcttttgcaaacctgcaataggtatggctaaaccaaattggttctcaataacatcacgcgctatatttacttgcccctgaccaccatcaattacaatcaagtccggaggtgtcaagccatcttttaaaaccctactataacgccgatgaatgacttctctcatactagcataatcatctggtccgataacagtcttaattttaaactttcgatagtcttttttacttggctttccattcacaaataccaccatagcagctactggacttgtcccttgaatattggaattatcaaatgcttctatgcgtactggtttagggatattaagaagattacctaaattttcaattgccccatgagttttacgaatatctttttccagtaagtcaaacttctgttgtaaactgacacgagcattttttattgccagatttactaactgtttcttttcaccacgttgtggtttaacaatcttacagcctacaattgtttcaaccgacttagcatcaatatcctgtggaataaagacttctttgggtagaaaatgttttgtatcttgataaaattgccctatgtaagttagaaaatcttcctctggttcattataataaggaaacatattcacgtcacgctgaatcaattttccatttcgaacaaaaaagacctgtacacacatccaacccttatcaacgaaataaccaaaaacatctctatccttcatatcttgatgaataacacgctgcttagtacgcaacaaactaattgcttcgatcaaatctcgatattcagccgcacgctcaaattccatagtcatagcagcgctcttcattttttcagttaatccgttaacaattttattatctttaccattaagaaactgttttacatcttctctcagactatcccaataagctttattagtttgacaaactgtatgtgcattgcattgccctaaatgataataaaagcatactttatttgctggattagtacatttcttaaaaggaaagagcctatctagtaaccgcttaatctcagttgctgccccagaatccggataaggtccaaaataagtgccatctgatttttttacttgacgtgtaatcataagacgaggataacgttcatttgttattttgatatatgggtaagacttatcatctttcaatcgaatattatacttcggcatattttcttggattaaattaatttccaataatagagcttcggtattagatgttgtcacaatgtattcaaagtcttcaatctcagagaccaaaagttctgtcttagtattatgactcccatgaaaataacttttcacacgattcttaagatttttagccttacctacataaataattgtcccattcttatctttatgaaggtaacaaccaggactgtctggtaacaattctagcttatgtttaatcagttcattcatagaactattataacaaaatgtactgtaatctttacgaaataaatactattccccaacatctattgtatcttccaatacttgaataaaaccccaatactcctagtctaagcaattattttatgttacactttaaacaagtgaattattgaggagtttttatgatagacgttgagaatattcttgaaaaaatgaaacctaaccaaaaaatcaattacgattgggtcatgcaacaaatggttaagcagtggcaagctagtgatatccgtccgaaaattctgatgcatgtttgctgtgctccttgtagtacatatacccttgaatacttatcacaatgggcagatgttaccatctattttgctaattcaaatatccatcctaaagatgaatattatcgccgcgaatatgttactcaaaaatttgttcatgatttcaacaaaaatactggatattctgtacaattcttatcagcaccatatgaaccaaatgaatttttcaaaattgttcatgggttagaagaagaacctgaaggtggggatcgttgtaaagtttgctatgatttccgtcttgataagacagcggaaaaagccgttgaactaggttttgattactttggcagtgccctaactattagtcctcacaaaaactctcaaacaatcaatactattggtattgatgtccaaaaaatttatgatactcagtatcttcctagcgaccttaaaaaaaataaaggttaccaacgttccgttgagatgtgtaaagattatgatatctaccgacaatgttactgtgggtgtatcttcggtgctaaagatcaagggataaatcttctccaaatcaaaaaagatgcgaaagctttcgtgagtgataaagacggcaaagaagaatttcctaatatacgcttcacatttaatggcaagtcaatgtaaatgataaaaaaagacttagtaaagaactaagcctttttggtataaatcttgtcaaactttaataatacaacttcttaatcttttgcagacgttggtttagaaatagaccacaaacaaaaatacctgtgattaaaccaatccaataggcaaaaggacctaactggctatttttttctaagataaccgctaatggcaaagcacataaccaataagagcccgcaccgatcataaatggttttgttgtatccttatagcctcgtaaaatcccctgtacaggagctgcataagcatctgcaaactggaaaaagagactataagttaggaattgagctgtaatagcgacaaagtgagggtcactattatacattgctgctacattctcacgaaatagaaataaaaatagtaaggttcctgatgtaatccctaccgctgttaagcgtcctatcctactataagtgtttgcgtcctgaaagcgctctgcccctacttcaaacgatattgtaatagctagagcagtggaaatacttaaaggaaaggcatacattaatgatgaaaaattcatagcagcctgatgtgctgcaataatgattgaagaaaattttgccatgaataagcctactactgcaaaaattgcaacttctgcaaaaatttgtaaaccaatcggtaatcccaatcgaatatcttcaataatcaaaggagcttttattctttccagagtccatatatgatatgttttaatttgaggatgaagtgacatcacaataataataacaataaaaatagcccaataagttaaagaagttccaagacctgcccccgcacctcctagtctaggcataccaaatttaccgtagataagcatataattaaaaaatgaattaaagggtagaattaaaagcatcagatacatagataaccttgttaaccccaatgcatcaaagaatgaacggcaaatgctaaacaacaccagcggcatgattccaatcaacatataatttaaataaccacgaccaactgctagaacttcatcttctaaacccaaactccccaagacaggttgagcaataaattgcatgattaaaaataatattaaggacagtatcaaacctaaatatagaaattgatgaaattctgtgcgaatttgttctttatttcctctacccaaatgttgaccaactactggtactaatgctgaaatcatacctactaataaagcgaaaaacggagtccataaattactagcagttgacacacctgccaaatgtagctgactatactgtccagtcataaccgaatcaataaaagtagctgaaaaattagcaaattgataaatcaatactgggataaataatttcaaaaataaaacaaatttttccttatttgtctgagtttgatacatcttttttctccttttcaccttaatcaatttattttagcttagctaggatactctgtcaatgctatttaaaaaggttgagaaataatcctcaaccccattttagctaagctcagtattgatttgccatgtcataccatatttgtcagtcacatttccataagctggactccacggaactgcttgtagaggcattttaatgttcattgcatctcgagaaagcttattgaataactcttgcgcttcttctacagattccacaattaaagctgctgtcatattttgtccaatttgaaaatcaaaaataggattattgtcagaaagttgcattcgaataccatcaatattaaattgagcgttcataattaaatgttcaagttctggcggacaatctggccaaccctgtgcaaaagttgtgacgtgttctgcttttgtattaaaagcctcttcataaaatgtaatagcttcggccccacgaccattaatattcatataaatttcaattgctttcattaccatacctcacttcatattatccaaccaacgctgcatcagagtttcattttccccttttagggtaaaataagaaccacgtattatacctgcgagttttgacttttgacgagcaaacttaaacttgtccgctaattcaataggaatatccattccatctgataattttaaacctacagctctctttttaggattatctaattcatataaaatattaatggctaaaccatcctcatagaaaacatgtgtccataaaatacgattctctaaaaaaagctgtgaaatctctaaaggctttgcagcaaaaacaaggttacgttcattttttagaaggtgattaatatctgccatcaattctggatagtctgatactggaaatgtttcgtaggctactttgaatttattccagaaatagcgagcttcatttgcacgcaaaccagccaaggcttctgccactggagaagtctccaaacctttagttgaaacggttttaaagtcgataatcatgttctttcctttttgattaaaatcttcgataatttagtatactcttttttgaagaaaaagtacattctaatcacttataaaaagtagtacatttagaacactaccacctcagtaatttcttgacctttctctacttaatacttataattaatctagacttaatgtcaaagcatcaatcaaggtgtaaacctgattcacctaaaaagctgatggagctaaacatgaccaaaaagatattcttatttatctgcgctactcttttagtaggaatagccttatatacaccaacaacttctatttttaatcataacaacgtttatgctgccaccaagaaagcaaaaattaaatttaataaaactcaaaaaaaaattgtcaaaaaagcaagagaatatgctaagtctggccatatgtctaaagatagtatcattgaaaaattaaaaaaggattctaagaaatatcgtcaagaagacatcaactttgtgattaataacctcaaggttgattacaaaaaaaatgccttgatttctgccaaaatttattcaaagaccatgaatttatctaaacaatctatctttgaacagctctattcggagtctccagataaggcaacccactctgataaatttacaaaagaagaatcccaatatgctatagaccatctcaaagtagatttcaaagaaaatgctcttgagactgctaaaagttatcaaagtagttcttctttatccaaagaagaaatctataaacaattgacatctacgctgggcgataaattcacaaatgatgaagcccaatatgctgtagatcatttgaaatgatgacataccaatagtctatccttatgtaatagaattgatagcttatgctaatattccagctgtaaaatagcaagaaccctcctaagtcttaatgaacttaggagggtttttatcaatatgaataggttacactaaactagacagaaattataaagtgttctacacttaagaaaaactggagaaaaaccatgtctagaaaagtacgtcgtcacttcaccgatgattttaagcaacaaattgttgacctttacaatgttggtagaaagcgtagcagtctcatcaaggtatatgagctaaccccttccaccttcgataagtgggttagacaagccaaaacaactggttcattcaagtctattgataatctgacagatgaacagcgggagctaattgaactcagaaaacacaataaagaactcgaaatgcaattagatatcctaaagcaagcagcggtgattatggcacaaaaagggaaataatcactgctaataaggataaatacagcatttcaaagatgtgtcgctggctgaatatgccacactcaagttattactatcaagccgtggagtcagtatctgaaacggagtttgaagaaactattaaaagaattttcctcgatagcgagtccagatacggatccagaaaaatcaaaatatgcttgaataacgaaggtatcacactttcacgtcgtcggattcgacgcattatgaagcgactcaatttggtttctgtttatcagaaagccaccttcaaaccacattctagaggcaagaatgaagcccctattcccaaccacttagacaggcaatttaagcaagaaagaccactacaggccttagtcactgacttaacctatgttcgtgtaggcaatcgttgggcttatgtttgcctcatcattgacctatacaaccgtgaaatcatcggcctgtctcttggttggcacaagaccgctgaactcgttaagcaagccatacaaagcatcccttacgccctgaccaaagtcaagatgttccattcagatcgtggcaaagagtttgataatcagttaattgatgaaatattggaagcctttggaatcacacgttcgcttagtcaggctggttgtccttatgacaatgccgtagctgaaagtacgtatcgtgctttcaaaattgaatttgtttatcaagaaacctttcaattgctggaagaactagctcttaagactaaagactatgttcattggtggaattaccaccgcattcatggtagtctcaactaccaaacaccaatgactaaaagattaattgcctagaaaaacactttataaatgttgtacagaaaagtgttgccttttcacttaataaaagaaagattgaaggaacacttctctttcattccgaccaagggtcacaatttaagtccggggaatttagaaaaataattgatgacaacaataggcactgaatccctaaaatgagacaaaagaaaaacactcctgttgaaatttagtaaactagaaacaggagtgttttattatggttaaaaaagcatattcatgggaaactaagctggcttgcatcgatatgaagaaagcaggcaagtctaacagagttattatggagactttaggcatcaaaaataatagtcaaatctatacttggatgaaatggtacgaaaacgaggagctttatcgttttcatcaaggtgttggcaagcaatatacctacggtaaaggcttggaacatctgtctgaagtggaacaattacaattacaggttgacctcttaaaaaagtatcgaggcttgataaggaaatcgataaagtaagtcttatcaagcttgtggaagactataaaaacaactacccgatagttttcattctagactgttttaaggtcaagcggtcgacctattaccgttggaaaaaggagtatgagaagccgcaaaaaaagatgaccttattgaattaattgaacagctctgtatggagaatcactttatttatggctatcgtaccattacacgattgctcaaaaaaatccacggattgactgttaatacaaagaaagtctatcgtatcatgaaaaataatggctggctttgtcggacacgtaccaagaaagttcccaatttgggtaaagcttattatttaacagataataaattgagtcgggatttccatgccgataagcctaaggaaaagctcgtaacagatattacctacctatatttcggtaactgtaaattgtatctctcatcaattatggatctctataaccgagaaattatagcttacactatctcagattgtcaggacacggattttgtactagacacccttaatcagttaaaattgcctaaataaaggagcaatcttacacagtgaccaaggctcagtgtatacttctatggcttactaccaggcttgcacggaaaaagacattatccgctcaatgtctcgaaaaggaacacctgcagataatgcctgtattgaatggtttcacaccgtcctaaagactgaaaccttttatttccataataggagaaaatacaacaaagatagtataacaaatattgttaaaaattacattacattttataatgaaactagaattcaacagagattaaacgaccagtcgcctgtacagtacagaaaactgattgcctaaaagtgtttttcttgcgtctcactattagggtgcagtgccaatatcatgcattctttttctaatcctggatatccttatgataatgccgtaactgaagcatttttcaagtatttaaagcatagacaaatcaaccgaaaacattatcaaaatatcaaacaggttcaattagactgctttgaatacattgagaatttttataacaattacaacccacatacggctaatctaggactaacccctaatcagaaagaagaaaattattttaacgcaataaaataacacagttttctgtctacttatttgacattagtccaagaatcctcctctttttttactattctaacatggataccatttctttgcaaaagaaaaccgctattatccaacttttatcactactcgttacatagaatgacttcaaaatcaccgtaacttgctttgacaaagcagtgctttaacaatgagatcttcttttggttaagggtttatttgttgaagtgtcttgatatcataagttaccaattcaccatttttattataaaattggacaccttctggttggaaaatgagatacttaggatcgatattagctttttgtgctaattgattgatatgatcttctagggttgctctatctagaccatagtctggtaaactgtctataaagtcatctgattctttttcttctttactggcttcacttggctgttggttttcattgctcttatctgcctgttgcttttcttcaggtttatccgtatcagtagcatcaccagcatttttctttgccaataactcttgagcttgttgccactcagcttgggatagatcagatttattaatggttctcaatgaactgccatctgctcttgggatgctaaaggagccatctttccatacaaaagtttcttttgccaaaacatctcgtggatcgaaaatatagccgtctggtgctgcaaaacgaccttctgctagggctttttgaacttcttcagcagaatggataatttgccagtttggcataccagcacgtttatcaagaggcgtaacatttggaatgaccgaacctgactcttcatgccctggcttagaccatacatccggacgaacttcggggtgttgcatcacatacttgattgttgcaatctgattgcgcgtcaaccatgaatacggaacgacatggatatgatcaatatgtgggataacaaacgaacttccagtatcgtaagtagcattaccagcatgcatcggcagacttgacaaatctacagcaagtcgtggctcaatgcctgtatcaacaatgtcataacggtaatgcttcttatctttaagcattagttcttgttcggcaaaggcaatctgagtcaaatcaagttgataacgagcatagaaatagtccttgccatcttttggcataatatagcccactttaccatcttttgttactttgcgactcacttttttagtgtcaaagagtggtttttctttgccttgttcctgatccaaagcagcaacaagctcatcagcttgaccttttgctttcacccagttagcgacctcatccaactcatattgttcaagttctccaaatcctatataatggaaatgatctccgtgtttagctgtaactcctgatttatccactgaatgaatggattctttactaaaaacataagcatcactcgtatcatatggtttaccatctaagccttttccgtaagctttgatgcgatgaccaagaaaggtatgtgtcacttctttatctgatggttttgagtgatctgaacctgagtcgttgtcatcagtttggccggctaagtatcgatctgctaattccatttcaagaggtgataactgacttcttgggataatatgataatgatctccatgaggcaccacatacccaaaagcgtttgatttgatcacttgagtcggttcaaaaatcaacccatcttcttccacatgacggtatttcaaatcaagacggtgtagttgatctaaaagttccttaaaggtttttcctttaaactcatctctttggtgtttgttttgtgacgcatcatttggcctaggaggcgctggatgataaccaccgttatctggctgatgaccttgtccagggttaggcgtcacatcaggaattggggctttcctacgacctggggctggtgtcgggcggtaatcagacggtctagcacctcgaccttgtttttgactccagtaggcttgtgcagcagctagctcacttggagacaaatcttttttaggaatataatgatagtgattaccatgaggtactaaataagcatctcctaaatcatcaatgatatctgtcggactaaaaatatagccatcgtctgtagtatagcgtccttgtctttttgcttcattgactgccgcaacttcttctttactgagatgggccacttgagctaaacctttttctttagcttctttagttcctttggctacttgctcagcaatttgttgtttggttcgaatgtttttgcgcttactacctggcttgaggtaaacataatagttgccattgactttaataacgtaaccgtctaagatttcattgataacgtctgattgtttaaaatggtaattaggatccgtcatcaacaactcttcactaataatcgcatcataaggaactttcccattgtaaaaatgataatggtcaccgtgtgaggtaacataaccttggtcagtaattttgactacgatctgttcagcagagatgccttcttcagcactgatttgatccatcgttttgtttgttttaggggcttttaccttacctttgctatcatcaatataggcaatctgattgtcctttgttgctagacccatatgatgcttaccaagctggtaacttccaatatgagtagctagtaaaatagcagcaactgagccgatataaccatatgttttcttcactaataatctcctttacttcaactgttgatagagcacttccaaatttgctctaagattttctagatatgtcttgtttccgcttggagcagcttcaagtggacttaatgtctttactttagctcctgttgatttcgcaatagcatgagcaattttggggttgacgttgtcttctgcaaaaatagtcttgacgttgtattctttaacaaagtcttgaatttctttcaattggcgaggagagggctcttgctctggagaaatacccgagataccaagttgtttcaagccgaatcgtttagccagataagaaaatgccgtgtgttgcgtcacaaatgtttttgagcgcacctttttaaatttttgagtgtattcttcagttagttgctctgcttcttttttgaaagccttagcctttttagtgtaactgtctttgtgtttaggatccaaatgtcctagctctttagcgatattaacagcttcctcaccagctaaaacgggatccgtccaggtatgtgggtcataaagtgtcgcagggtcaatgccttgtgtgacttccatatcttctagccctttgactctatctagtgtcagaggttttgacgcttcaaacacattaacctttgatttttttaaattagggtctagatcccttgcccaagcttctaaggtatgtgaatggtaaacaaacaaatccgcgtcataaatagctgccacatcatttacagacggttcaaaggaatgaatgcctgcacctgattggatcatcctcacatcatttaggtctccagatacttcttttgtcatcgcatacattgggtaaaagctggttacaactgacatgccttgcgtaggctgtttggggtttgctgacttatcacaccctgctatcattactaaactcacaaccatagccatgagaaaaaaaacttttttcatagtacctcctcaattataatttaaccagttattaaccagttaattttactcctttatcaatgctttgtcaatgacaactaccatcttttatcacatcaactgaagggataagcaaaaggcaattgttgacagctatttgtcctaacttctttttgatgaggtagcacaatcgagtagaggctaatctctagcccctctcacaccaccgtacgtgccgttcggcatacggcggttcaactaacttttaacgcatgtcgttcaagatagtaatctaagcaactgaccagtcctcgctttgcgagggctggttttgatatagcacgtttgagtaccgacttctgagctaccaactgatagtggtcaccccatccagaaactttatcggctatccatctagcaactcctagttttaagagtccccataggcgctttgctttcttcttccattgcttccagataatcactcgaatacgggttcgcagacgctcatctatttgtgtcatgatactcttcatattgccaagcgagaaatagtttatccatcctcgaatgacccagttcaatcgttcaatgcgagttatcaggtcaatgctccatttcctcatcgtcagttgcttcagttttcgcttaaagctctgaacgctgtcttggtgaggacgacacttccaaccttttggagatttccagaaaccaaatccgaggtatttgagtttgttcggtctgacaatcttggtcttagtcatgttgactttcaaccctaatcgcttctcaatatagctactgaccgaatgcatgacccgcttagcagctgcttcgcttccgacagtgatgacacagtcatcggcgtaacggacaaagcgaagacctcgcttttccaaccctttgtctaactcattaagcataatattagataggaggggtgatagattcccgccttgaggtgtcccgactaaagtcttatgtcgctgtccgttaataacaactcccgaatggaggtacttacgaatcagtgactccgtatcgccatcttgaatgatattatgaaccagggacatcaatctgtcttgcggaacagtatcgaagaacttttccaagtcaatgtccacaatccactcgtagccatcgtttaaatactcaagtagctgaacaatggctgtttcgcaggagcgattgggtctgaacccatagctatactctgaaaaatgtttttcgcagagtggactcaaaacttgaacgatggcctgctgaatcattctatccatagccgtcgggatacctaggttacgaactcctccgtttggttttgggatttcaaccctgagaaccggttgaggtttatagctcctctctttgatgagttgcttggtttctcgccaattttggtgaagatagtcatccatctgctcgatagtgaccccattgataccagcagaacctttgtttgatttcacttgcttgtaagcttcgagcatattgttccgagataatatcttatctagcaattctgacatgtgcgtattcctttcttttttcgttgtctgcatgatatcttacattggtgaaccttcctctagtcaatacgtaaccgcatctagttctatcagaccgtttgttttacagacacaagtgaagtaggattacttcgattagttgttcaccccttcgttccatttccattacagaaacttcatcactactatgggttcggctgacttcttgtcgttcgttgttattaggttttaccctcgacaggacctcacgggataagtcggacatctttcctcgtttactctcgtgatttacgtatataggttacgactacctatttggactttagagtttatagccccctcatccgctatatacgccttcatatcacgtttctgttcgtagagccacgatttcgctatcccttcctctccccgctacctcacgatagtcaggcttgggagtcgctattgggttcaccggtagcgggtgcccacagaggacttgcatctcagatgtacgacatgcccgtcgtactataaaaaaatagagagaaccaaattggttctctctattaaataagctcttatcagtttaagtaatactattttttagtttctttttggcgttttgttttaaatatatgagctgctaatcccaagaagaaagtggtcataactaacttaaggagatgtaaacgatttgtatccttgtcattagtcgttggtaactgatctcttgttgatgcttttgtagctaaagcacgcttagaagatcgtttctctagagtacgagaagattgacctttttgaggagttttacctggtgtttgacctgaactatctttttctggtttagtttcttttttttatctggtgtttgacctgaaccgtcttgttctggtttagcttctggttttttgtctggtgcttgatctgaaccgtcttgttctggcttattagagtggccctccaatagcttagtcactggtgtataagtgatgttaccagccatatcttcaacaacataagtaaagtctgacattttcaatggaacagtagcgccttccattgtttcagcctcttcaggaagagtaaaggtaccatcttcatttggagaaatatactctgttgttggcagatcctcatccatataagtgtaagcaatacgctcacggtaaaccggttggctggtttttggtttagatgcaagtgtcaaacgactatcttctgttgagaatgttgccgatgttgcgacttcaggtgtcgtattgtctacaatcacatcaaaatcagtgtgttgttcttttgcacctgagctaatcggcgtgtagcgaacacgataggtgtaggttccgttagcaacaactttgccgtctttatttttaccgtcccaacgcgttttttcaaaacgggttgaaccaagtgtgcttgccaagtcattgttgtagtttttaacaacttgctcggttacctcacttgtccaaacaacatttccttctttgtccaagacttcagccacaaggtttttagcattacgcaagaaagtaccttggaattggacataatctctgttaccgtccccatttggagagatcgcagcatatggtttgccattagcgtgacggtggatatagtagtggctatcatcgtcttgttttgcaaaagtacctgcaaaaatggtttctgtgatctctgaagattcgatatcctctatgttttcaaccccttctttgacagctttaataatcgtccatgggttagactctgtggtaagtgctgtaaagttatttttcagagcgtaaaactgtaatccatcaccatctaattggtctttggcatcactatttgcttcatgatagtagctgctaccgtctttgctatcatagattggtttttctaaggctgacagattgccaaaatcacctcggaaaccaatatatggaatgctcataagctcttcttttgtaggatcttgtttgaaacgaacaaaaccttctaagaaatagccatttttcatttgggcaagcaagtccttgctaaatcgactagcatcgattggaacggtgacttgtttgctgctattggctggaattgtgattttttgccatgatgtctcatacaatgctttaggagccaaggcaaagtgttttccatctactttatctgtttgaacagttacttggtaatacaactcttgaggtttatcagatttgttgtgaactgttactgttacttcaaatttatcagaaacattgttcaggtgaaccttgcttgaggtattgtccttatctgttacatacatcgttgctgctgaagcttttttagcatcgactgctcctgctccctgttggcgaggagaaaaataagctttttcatcttcatcatatagggcagttgctgagctcatcaatactttcttagctaaatcaagacgctctgatggtgtcatatcaggatactgtgtctcatattgcttttgcaacagtcccatgatacccgctaccaatggtgcagacatactagttccagaaagtttggcatacttgttgttagccactgatgacaaaatatcttggccgggtgctgcaatatccggcttaatattgccgtcagctgtcagaccccagcttgagaagcggcttagtttggtgccacttgctgttggcaataccttaggtgtcgcattgaaggtaatggttttttggggattgtcttttaataagagaccgtctcttcgactgataaaggccgcaggcatctggtcaacatttggcaattcaatcgggaagcccttgtcttgattgtcatagatcaagacccctacagcaccagcttttttagcgtttgcaatcttatctttgaaatcaatatcgccacgttcaataagggcaatcttaccttcgacatccttaaaatcatcctctttcgtaccacgattagcataagcatagtcgtaagccttgtttggctcaaaacggtttgttgaaagaacaggcatttctttatcttgatgatcgtctgttttgaccgtagcagtttcagtgagctgtttatctgggctgtaagaagcaactgtcaatgttgaatctgccgctgcaggtgtcccaaccaccccataatcaggatgatctgctagaggtagacggggcttgcccccaaagctactatcattaccagctgaggtcacaatgctaacaccttttgatttggcatagtcaaaggcttttttggtttcgtctggaaggttggcgtaagctagtgcagcattaccaaagctcatattaatcaccttagctcccaagttgacagcatctctgatagcttgagcgtagttacgagcatagtctgctagtccatttacaatttcgacacgcatcaaaagcaattgagcctcaggcatcgcaccttctaggcggtaaggttctttcatttcagatggagcatttcctgacaagatccctgacacgtgtgtgccgtgttcttgatcaacagcgtttttaccatctttactatagtcgtggtaataagcaaccttatcattgacccactcgccataggtaataccgtgctcttttttagctttttcaagattttcttttgattggtaacgtgctttagttttgtctgttaagcgccacgcttcatgatttttatcaaaaccagcatcaatcactgcaacaacggtcccaactcccttgcctgctttttcctgcagggttttgacatgagaagggtcgttcaaatccctaatagtcgcttttgaggttgctggtgtatcagcagttttagcaggagcttgaggggctagatcattagcgtcatctgctactgtttctcctacatcactaggagtttgtgaggttttagtttcctttgatgatggtgattcctcagaaactgctattggttgtgggggttctacggcttgttcggtagcaggagtgtcttctgtcacagtatttgctttaatgtctgattgtgcattgagcaagatgctcgtagatataagcgcaatggcaagtttatcaaatggtagtttttgttttttacgcaatgtgtcgtcctttcatgatgagagactttgtctttatgaccattaagaaaagagagaatcaaacgattctctcctagctatccgtctgtgtgtagagaaataaggataacgtcttttttaaagagcaaacaggggttatttgcatatgacacagctatttttcttgcttttgccataatgattaaatgtatctcatttatcaattatattactaacatctttattataaaacaaagacgattattagtaaaggtcatctttttaagagttgtttagtttgtgacctccttaacctcattcttttagacataaaagagagaaccgatcggttctctcttgatgttcactcaggtatgtgtctgaaattttgagattagtcgatacctcataaatttaagaaaacttgaattattcttaaaaagaccaaaacaagtattttttgcttgttcagtcttgacggtattgttttagttatgctacaataaggttcgactgattaagcaagtggtatttgtcttaatcggtttggtgtaggagttcgcgctccttcaccttttttgcttttctttaatataattatactactttagaagatttaatgcaagttaaaacatgcaaaaaaacgctagaaataaaggtatctttagactttttctattttgttttgattcctgttatactccattttctgccattttttagaaggggcttagaaaatttatctaattcatctgtctttttaaaaagtcgccctgcactaaatgaaccttctttatactcactgtatacctttctccaagaaccgaaaaataattctcgtaaaccgttagctctttcaagtataatcatatttgccattgtggagattccccactttgaccaatacatgccacgtcgcttcattctatacgttatctttctgtgttgtgattccatgataccaataccacgatttgaaagatttctaagatgagctggttttatatatttgaaattatttaatacttttttcttaaacttctgaaattcttgatcttcaagttcatcacaaatcagtgattcaacagtatcaaaaactaattcaagcttatcagaattatatttttttaccgcatctaaagcaaaatcggttaattcaattggatattttctaaggtatgaacttaacttttctttaacatgatagatatcccaaaaatgctcatgtttctttaccttaagtgcttttcctaattccttaaaaactctactagtatagcctttacccatatcagagttagtgattaaaatagtatcgtcatctacttcatagttattataaatataatctaaaagattatatttagctttatcataattaagctgtaatatttcgtgcttgtcccgcaattcatatcttttagtagaaactttttttgagcctgtatgaataacaaaatgtgttaaatctaaataccttctttcctctctagaatctgtgcttttaatcatgactccatcaccctcaacatacagttttttcacttttttacgttcgggtggctcttccaaataaaaacgatagcgttctttttcttttaacaatttttctacaaattttactgcttttaaaacacagtcttttgttatgattgtttgcaaagtgctatctattactttgcaaacttgacgataaggcatcattgtagccaattttgcaacatgatataagaattctattgaatatctcttatatttttcaagacctaaccactcatctactggtattctagtttcaaagccatttgtccagcgactcctactaaatgttatttctccaaaagagaaaacaaccgtacgttcagactgattgatcctcttatagcctttcgttctcatttgaggagcgatatagctttcatactgttcaatttgacttaaaaattgtttctgttttattttatttatttcatttacaaaatctttttccgagaattttttaacttccatgataatattttacaatttttgttacaggattagaatattattgctattttttattcgaaaagttaaagtaaaagaccacatttaataacgtgatctttctatttatcctactgtgcaggctcaaatccatctaatccaatgaatgactgaaacttgccagtacctgaatttgaagccgtgccacttaaactttgaacatcatattcatcttttggctcagaccattctgcatgaatataattagaatcatctgtgtcatcttttttccagtacaaatcagtattgtactgattgtcaacgtaattaacccaaattgtatcaggctttccaaaaatttcaataatatcttttaaagatttatcacctttttcaaaagtttgattgatgttttcaacagtaaaattattataattacctgatactgatgataaatcccccctaaaatcaacctttgaataatccatttcttttatataatcactcgggtttaatcctaacgtttttatataatcttctgctcgttcttcatcagtttttttgtgtttaacgacttttgcacttgtcgcaccactaggatttgtcttattctttttagaagtattactgctttcagaacctgtaaataaatttataacactactaacaataattatcactattattaaacttaaacatccaccacaaccactttttttctttacttttttcttaaccatttttcccatctaataatgatttccataataaatataattcaaactttgtttacaaatttttaaaaaagtcatttataaaagatgatgctgaacgatagcctttttcttttgatagcctatcaattttttttcggactgaaggttgaagtgtaaattgatattgttttgtacgttcaaagtccctaatattcatttcagatgagaaaatttctttcttttcttcatctaaactttcttttagaacttttgttagttccgaattttttggttcaaatgccatattcatcctctttcttataaacatagtcatatttatgtatataactatgtttatatttgtaattatatttatagtttatcagtaattttcctaaatgtaaaatcaatttctttgaagaatttactatctcttgaatataattctttatcagacatcatataagatagagactttttgtccaatgttgagcggttaaataactctttatgaggaatcattgcaagaactgatttatcattctttagtgatcttattaattcttttgaagagttggtattatgctttatcatattacctaaaaagaataattttgctgtgacataacttgctcgagttttaaagtcaaatgcctctgttttaaattcttcaagtctttcagaaagatggatgtatactataaaagtagacaaaactttgtgtgttacaatctgttttaaaagacacaaaaacgaaaggacaacctatgtcaacatttaaacgctatgatgaagaattcaaacaatctcttgttaacctttatcaaactggaaaaactcagtctgaactctgtaaagactatggggtatccacttctacgcttgcaaaatggatcaaacagtattcccaagtcaaactcgaagataattctgtacttactgccaagcaaatacaagagttacaaaaacgtaatgcgcagcttgaagaggagaaccttatcctaaaaaaagcaagtgccatattcatgcaaaacttaaagtaagactcctcgctgtctatcggttacgctttgaacacgccacaacaaccttgtgtcgtgttttacgtgtcaatcgctccacttactataaatttctaaaacataagccctcaaaaagagaattggataatcaaatttatagaaaacaaatacttgagatttataccaaagcgaacaaaagacttggtgtgaagtctatcaaggtcattcttcaaagagactatgacacaaaaatctctgaaggaagaatttgaataggttacactaaactagacagaaattataaagtgttctacacttaagaaaaactggagaaaaaccatgtctagaaaagtacgtcgtcacttcaccgatgattttaagcaacaaattgttgacctttacaatgttggtagaaagcgtagcagtctcatcaaggtatatgagctaaccccttccaccttcgataagtgggttagacaagccaaaacaactggttcattcaagtctattgataatctgacagatgaacagcgggagctaattgaactcagaaaacacaataaagaactcgaaatgcaattagatatcctaaagcaagcagtggtgattatggcacaaaaagggaaataatcactgctaataaggataaatacagcatttcaaagatgtgtcgctggctgaatatgccacactcaagttattactatcaagccgtggagtcagtatctgaaacggagtttgaagaaactattaaaagaattttcctcgatagcgagtccagatacggatccagaaaaatcaaaatatgcttgaataacgaaggtatcacactttcacgtcgtcggattcgacgcattatgaagcgactcaatttggtttctgtttatcagaaagccaccttcaaaccacattctagaggcaagaatgaagcccctattcccaaccacttagacaggcaatttaagcaagaaagaccactacaggccttagtcactgacttaacctatgttcgtgtaggcaatcgttgggcttatgtttgcctcatcattgacctatacaaccgtgaaatcatcggcctgtctcttggttggcacaagaccgctgaactcgttaagcaagccatacaaagcatcccttacgccctgaccaaagtcaagatgttccattcagatcgtagcaaagagtttgataatcagttaattgatgaaatattggaagcctttggaatcacacgttcgcttagtcaggctggttgtccttatgacaatgccgtagctgaaagtacgtatcgtgctttcaaaattgaatttgtttatcaagaaacctttcaattgctggaagaactagctcttaagactaaagactatgttcattggtggaattaccaccgcattcatggtagtctcaactaccaaacaccaatgactaaaagattaattgcctagaaaaacactttataaatgttgtacagaaaagtgttgccttttcaatctttttaaataaattttctataacaaataatctaataatgaattataatatatttagattatttaggagacttaagaaatggtaaaccaattaataattttaggaaatggatttgatagagcttcggatttgatagagcttcggatttaaagtcaggatatatggattttttcaattttagatttaaagattcagacagtactagtagtttttggtattatattttgagatcatgttataataaaaaattgtctagcgatttatggagtgatattgagaaattaatttcagtacatctaaaaaacattataacactatataataacgaaacaattttaagtggcaaagatattgagagtatatatatcgaaacattaagcactgattactcaagaaatgattactctaccagtgaggagctaacgcaaaaagcactccataattttttgtggaatcataatggtatacctattgttccagaactagataatttattattactaattcaaaaagatttaaaaatagtcgaagatgagttttgttcttatttaactaatcaaatagagatccaggaacaatcaaaagatgattattttaaagatataactaatttgggaaataattacttattaaaatctcgaattatttttgaactcttgtataaaagtaatatttctagtgcattcacatgtaattcttttgttgcactacatgattttcataacgaaaattgtttcaattcctatgaaggatttcttagctacatttatgacttagaaagtaataatgaatttaatgttgaaacatcaatattgaattttaattatacattacctagaatagataaattacaacgtaatattcatggaaccctgaatgataaaaatattatttttggaatagattatgattctttaattgatatacaaaaagataaaaatgttaccctgcctgttgaatttaccaaatcatacaggatattacagaacggaaatatatttcaatatccaattccctctgaactaacttttataaaattttatggtcatggtctgggtgaagcagactattcttattttcaatcaatttttgactcaattaatctttattccagtgacactgtactaattttctattggagttgttataacgagaatattagggaacaaattaaatctcaacaagttcatgcagtacataaattaattgaaaaatatggagatacttttaataataagaatcatggcagaaatttattcacaaaacttcaattagaaaatcgtttaattattcaagaaatactttataatgatattctaaatccatattaaacaaaacacccccacaaaatattgtgggggtgtttgtggggaagattcaattgaatctttccttttttaatcgccttaactttaacgaaaagactttaaaactaggctttcacctttaaacaaccaatagatgattatttaagagtaacaattgcacaacctgttaaatgtgcaatatcaaggggtttgagttcttaatttgaagtttggcaggaattttggcataaaattgaatccaatcctgcacttttgatattttgtgtgatttcttcagaaactgttttatctaaagcattaaaccagtgactgtaagtattcaaagttgttgatttatcggcatgtcccatacgtctggctacatataaaatatcttttttcaagacattgattagataggatgcatggctatgtctgagaccttttcctgtaattactggaactcctacctgttgagctttccgtttgatgatgcgacaaatggttgatttgcaaaaaggatctccaaatcttgaaatgataaaatctgtatcttgatttgcaaactgattttttcgccaaacttgaagtacttcaatagtaatatcatccaattcaataagtcgttcacctgctggagtctttgtttggtctttacgataccaattaccattttcatctttctctaaggttgtatgtacctttagaaattttttatcaaaatcaatatcctcccaacataaagataaaccttcgctcactcgtacacctgtcatataatataaccagatggcagtaaatcgttgcaattcttcataatcatgtaagtcaaatgatttgataaatgtctgaaactccgcataggtccaaaatggagtttctggatgtttacctctaggattatctaatgctttacaaggcatatttgaaatatagccaagtctttctgcataacccatacaagctttaaaccttgaccataaatttttcgcatagttttcagaataattctctatgatatgcaatctaaaagcttcgcaatctctaggagttattgcttttaatggctttaaaccaaaatattgaataaaaagtttatgatgaggaagagccgtcttatatgtcacagactgaaccttttgcttatatgctcttaaataaattttgttcatatagttttcaaaagtcatattgtaattttctaaactgactttgttggcaaattcatattttatacgaactaattcgtcatatgcttctttcattgtttcaaaggttttaccatattgattttttctagctttcttttgtacccttttgccagttactgggtcgattccaagatcaatctgataaaatatctttcccttattatcacaataaacacctttgtattttttactactttttgttgccatttggattctcactttctaaatgttatttagatagtggaatccctattaattgttccacaatttctgctggtgcgatacctagtcttcgattgtcaaagggcgatttacttaattgtaccgcattatggtcaactttgcgagcttcttcaaacttttttacagcaatttttttagcttcacgaataatgtctctagaggtatgttcaggaaatcctaagttcattaaatctttatatgtagcagttctcatacactttcctccttcaaatcactaagttattttacacgctagatgggatttgaatggttagttcaatcatgggaatttcacccgctgtcctttttcgatggcagcctgaacggtcagaagtatcattatcattatttgtgttatggcagataggtcaccatcctatttttgaataaatgattttcgctcatttcctggcgcattacattctattgctcaacaaataaataaagtcccacctagaattattcaattgtcaatgaacaaatcaggagggactattttaaattattctttattcggtggggaaagtcagtttgccccaacaaataatctgtactaacgttatatagatttgaaagttttattattacatctgccgataaaatacgttctcctctctcaatttttgaataagcagagtgggtaaacgaaagcttttcggcaacgtatttttgagtgaaatcattgtcttctctcaaatcccttaaacgtcggtacatcaatctttctcctaaggaaaagtatagaggataactaggagaaatttgatatattgtcctaattggacaatagaaataaaactcccaaaccgtttatttctttacaaattagacggtttgagagtagctttattatacattatacaaaaataaacaagaatatgttggaaatttgaacatttattcaatatgaatggaaaaatcgtctgtcttgtatttatccatatttaaaactcttacatattcatccaactttctaaccgcattttcgtattcttcgattttattgtctagctgattctgtatcatttcaatctcagattcaatctgtccaattgttacattctgcgataaattcatcttggaacattcatacttagctaattgcttggtatcttgattatcactttgtaggttaacaactacttctgccatcttgtttaaggtggtgtttttgtcttgaagatttgtcaattcaatatctagctgtgcgatgtctccaaccaattcatcttttaattctagaaaggatttattttgaatgtttaatgtcatcaataaattgatttcttcaattttttgttgaagactgaccagacttattcgtctcttataaggtaaagacttattgtcaaacgttagttggcgaatcaagtcccttcctttcataaatcgattcatttctgagtcctctttatgataaatgaaataagaagatgtttctcgaataaacacctgatactgcttcttattttcttgttctaagatattaagttgatgatttggaatgaagattagtccttcttgtccaatacccatccaaactttaacaaatagaccatctagcacaattttttcaatttgctcctccgtgatctcaacttcaaactcatgtacagcatctctcttagttttatacgtttcataagcttcggttatttcttctacagtcaatatttctgaaagctgttgtgtctcaaacttttcaaattctatttttacttcattattatgaagcacttcaaacacatcatgttccttgaaataactatcaaaatacgtagtatcataaagatttttctttcttaatgacttatttggtatggaaatgcagctttttccatcagaaagaacaaaatctatcgtttttttcttgctcttcaattctaatcccagtaaccgagctttctcaactaaatcatcaaatgagttggatcttagcaataaaaattctaaaatcagttcaatctttttcttggcaaagtaacgttgaaaatattcttttgaatagggttctctcttattcagcttatctccttggatgacttgcttcatatttctatctgtcataaaaaatcggctatgtttccttgagaaatctattttgacatttagttgctcagctttttgcataaaatcattgaaatcaattgaatgttccatgagaaaaaataaccgctgcttcaattcgtatttgtgattagaacgtcgatagacctcataatctctatgagaataacgtttaggtggaatgattttagcacccgctactttagaaattctatccgaaatcatttgtaaatttctttcaagagcgtagtcccacttcaactttttttgagattggctattgattgagttgataataatgtgattatgacaatggtcctgatcaacatgagtggcaacaatgaatttatattgaccacctatcaactcttttatcgtttcatagccaatacgattgatttcctctgggcttaatttatcttcaggtgagaaagactgaataatatgatgagcatgtattttctgttgctttttctcttgtctatcaaaccgtgagtcgtagagttggtcatttgaaagaaaattattttgatacatcttcaccagttccacatagtcaggaaaatcaagataattactcatcccaaaatctgaaatcaatgataaattcctggttttcttaggatcaagaatatacttaatcaattgacggcggtattttttcccatgaacagcataatgcttagtgatgaccataaaattctctcaatcgctgacactttatgtcaaaatcttgttgtaactgtgtttctaactctgctataccgagctgcaattctttgacttgttgaagactaagtaggtggctttgatttaccgaacgtgcaatctggtttatattatttccaatcctacgaatttcaaaaatcaggtcttgaaaacctcttgtatcgattgtgataaaattcatacgaggattgagtaaggtttttctggcataatgcgaaaagtttggacactgactctgagcaagatttttattgaggataattaattcttgatcactcaaatacacctttttcaaattggttcgataacgattttccataataacttaccccatgtacttgtctttgaatgaatagcttaatggaatagttacctcaatttccttcatcaagtctttgatacaagtcaggatgatttcaagatgttccatagtaactgattgagacaactttgccagaacaagtatttcatgtacatcccggtaaatctgttctactttttggtgctgtaaatattttatccattcttcaagctgctgagatggttggtggtctattttcaataatttacctctagcaaaaggggaaaattgttcatatccctcctgttccataaaattttgtatctgttgatactcttctattgagaaattgacttccttacgtatctctctaactagatttcccatcctgtatcctcctcattctttaatatcggtatatccccgccctcgtattagacacggcactgcataatatcttcctttcaggtctttgcgagctcagatattgtgtccacaatatcccaaaaatcatatcgccagctgaccaaaaccttccagttttgacagccaacgataagataacttgatggctccgcccccaaacccccagtgaaaaatcaaggattgattttcttaggaatggtattaggataacagggatgatttggaaaaggtatcacaaaattgatataatacttttataggaatattttcaaagaggtgcattatgtccaaatcatctaaacaaattgaagaagatgctgtcgattatttaaaaatggcgttaaaaaaatcgggtattcggattttatggtggaaaagggcttataaatcacccttctccaaattcttaataagtgtggaaaaatcgacacctaagttgtctgtaatgtcgtgatcattcacttcataccaattgaaagtatcgtataacatagctttattgaaagcacttgaattaaatcgtggcttacgctttttatggagcttctcattgaaaaggattttggctcgtaaggcatcaaacgagtaacctctacccattcgctctacctgcctaataatgctgttaattgactccgtataagcattagtgagccttttatcaaagtagttgaatatttcaacatgccagttgtctacggctctcacgaggtctttatatgcgtctttagagttgctggacatacaacggtgtctccattgactataacgaagatgaccttcatctggatcaggagtatcccatatccagtaaaactcttctttgagttcataggcttcttttaaagcaggaagattacctaaccaagtatctaagaggaatgattcacgttcatttagatcgtgtttacgctttagaaggataaacctttcacgcataagggtacgtctttctttttggctcatatgggctttcaaagactttctgacgttatctaaggcttgattagccattctaactacatgaaacttatctacgacaactttagcttgtggaaggatagtgttcactgcgtctttgtagggcttccacatatccattgtgacgtactcaatgtaagtcctgtcactgatttctgaaagacgttggatgactgtttccttgttacggttaggcttgatgtcataaatagtcctgcgttcaatattagtcaatacaagccgaggtctacggataatatgtatctcgtctatcccaagccacttaggagtttcaaactggtattcacgttctttgagtgccacatagtccttaaaaacgttcctaatggttttctcgtcaacaccaacgctttctgcgacttctacaaaggtcttagacatggattgctcttgaatggactttaaaagccttttggtcatactacgcttttcatctacagatatggtagatccgcattcacgacacttgtatcgtctacggttcaaatgtaagcccactcgctttaaacgaatgggcaaatccataattagttgatttcttgaactgtgtttgtacaacttgtcaaaaccacattcaggacaacgttcaggtggtccgactgcttcaactttaaacatcatatcggtttcattttcttgtggcggttctattgttttaatgtctggtagggataataagtctgacatattattcatcctttattactctgcggtgttaaggtatcaattatagatttgatgtcgaaatcatcagtgttaaattatttttgtgaccacaaatgcacttagaaaatcccttaaagcattagctggttcacttgaatagggagttgtaaaaaagttcccttagcctgcacaacaagataatttcgaaatatctttatcgaacgtaagtgcaactaattttagcccttcagccattgttaaatatggtgctagggtttctgttaaatcttctatcgttaagccaaatttaacagctaatgatgctgcatagatgacatctcctgcattttcagatacaatatgaacccctaatacttttagtgtttctgcatctgctactagtttaaatacaccggttgtttcacggtttacaattgctcttggaacagcatctaaaggtaatacagatgtcttcacatcataccctttctcttttgcttgttcttctgttaaaccaaccgttgcaaccgtcggattcgtaaacgtaacagcaggaactaccgataaatctatttttttgtttaatccaccaatagcattatcagtaataattccaccttcataggctgctacatatacaaattgtggtcctaaagtcacatctcctgctgcataaatcttttcattacttgtttgaccaaaatcattgatcaggatttcattattttttccagtttcaacacctgctgcacttaaatttaaagaatccgtatttggttttcttccagtggcaacaagtaactgatctgattcaatgacttctctactgccatttactgttacgtaaaccctttttatctctccactttgttcaacacgctcaaaagttgcccctttgacaaggtttataccctgttcaattaacgctttttcaactgactctgaaatctcaggatcatactcctttaaaagtcgctcacttctttgcataagcgttatttctgaacctaaatgatgaaatagttgtccaagctccattccaatgtatcctgaaccaattacagttaatcgttttggtattttctttaactcaagaagtgttgtactagttaaatagtccattttttcaagtcctgaaatttggggcaacgaaggcgatgcacctgttgcaattaaaaagcgttttgcagataactttgtcccattgacctcaaccgtactagcatcaacgaattttgcttcacctttaattaaatcaaaattatattcatcaattaaatccatatatttttgattccgaagttcgctcaccaatttatccttttgcgtgattaaactagctaaatccacttctccagcggatgtttgtaaacctataaacggattgtcttttgataaatgattgatttcccctgccctaagaagagtttttgacggaacacagccaatattcacacaggttcccccaaccgttccacgctcaatcattccaacttttgcaccgtattctatagctttaattgccgaagaaaaggcagcagcaccagaaccaataataagaaggtcataattgtcttcattaattaacgccacgttttctagtgatgatacttcttcaatttctccggcttggtaatttgcttcatcaatcgcctttattgcactttcaacctcaatatcatcgggcagttcaaatactgcttcaccacgacgataactagactcaatatttttagcacctatcttttcaagtgctgattctacgtgtttttcacaacccgtacaagtcattcctgaaatgtttaccttaaatttattcataaaaaagctcctttcgttaattaatctctcatgttaatgtttctattattggacacgaatgtaatttcttttcatctggacatcgttgttttaagtcgtctaacatagtttcaattcgttttaaatcctctatttgtttttgcacttccttttgttttttagaaacaaattcgaacatatcttgacaacgaacttcatctttatctacaacaccaagtaatttataaatctcgcttaaagagaaaccaaattcctgtattcgtttaataaacccaacacgcttaacgtcatcatatgaatatatccgataaccagcttccgttcggtgaggttcttgtaataaattttttcgctcgtaatatctgatcgtttctttattaactccacatttatctgcaaactcactaatgcgataaatcatcttatttcaccccctgaatattataaaccatgtaccatagtacacggtcaagtaaattggactattttatttttttcccaaagtatcactcgtatgtgattgatacttttatataatactattgattatcctaacatcccaccagaaaatccgatttaaacaccagttgtttttaaactattaagaaagtaattccactatatattccgaagacccaaaaaatcaaaacatattaacagagaaatttctgagggagataaataaccaatctgggatggtcacatatacttttacaaaaatatagaaagacgaaatattgattttttggagcgaattcctgttcagtttaaaggttgtgatgattattataacgaaaatgttggataccctctaagcaggattaatttggagcattatctaactgaaggtggtgtgctctactttgtagtgtactcgaaagacgttagtcctactgtcacttatgcttcactaacaccaaaagtcattaagaacgtattgccagctagtgacaagaaaaaaagaattaagaaaaaagaagatatctttctcctgttctggatggctataatagcgaaattattgattttaccttatcccgctctccaaacctcatacaagtcaagaccatgcttgagaaggtcttccctgaggaaacttacccaaataccattctccatagtgaccaaggttggcaataccaacatgaagtctatcaccgctttcttgcaagtaaaggcatacatccttccatgtctcgcaaagggaccagcacggataatggtatgatggaatccttctttggtgtcttgaagaaagagatgttttatggctttgagaagactttcaagtctctggatcaactggagcaagctatcaccgagtatattttttactacaacaataaatgcattaaagaaaaactaaaaggacttagtcctgttcagtatagaattaaatcctttcaataatattttttgtctaactttttggggtcagtacaatgactcataaatatttttttgcaagttcaaatactccatgagattaataactttattattttagccaactttactaatcgtataaacattctccaaatttctcaacatcaattgagaaatttggctttttccgttgctcagttaaagcgtcctttagttgtatatttcctgttaatatcccttttgaagcataacattgttttcaatgatcgcatccgattgttgacacccattttagaacctattctttgattttcaataagcgtaaactgtttaatgttacaagtaaagttgctcccatatcagcaaatatcgctatccaaagtgttaaccaaccgggcatgaccaaaagtaatgccactaatttaatcgccaaagagaaggtaatgttttgcttgatgattgctaaagccttacggcttaattttattgtatatggcaatttactcaaatcatcagacattaaggcgatgtcagccgtttctaaagctgtatcagttccagcaccacccattgctacaccaacggtagatgccgcaagggctggagcatcattcacgccatctccgaccatccccacactttgatgtttttctcgaagttctttaataaaattaagcttatcttctggaagtaagtcagctttaatatccgaaacaccaacttgttttccgatggctgttgccgttctttggttatcgcctgttagcatcactgtttcgattcccatattgttcaacttgccgataacttctttagacgattccctcatttcatcggctacggcaataaacgaaagaatttctttttctgttcctaacaccatcaccgttttaccttgagtttgcatatcggcaattttttcttttttatcgcttgaaatgcttccgtgtaattcctcaaaaagattttgacttcccacataatacatttcattatttattttggctttaacgcctttacctgtaatggattgaaaatcctctactgttacttcattgaattttaatccattttcttctgcttttcgcataatcgctgaagcaagagggtgctgcgatcctttttcaatggctgatgttatggttattaattcattttcatttctaccatatgtcacaatgtctgttacagctggaatccctttggttaatgttcctgttttatcaaatgctatcgcttttaagtgtcctgctgcttctaaatggataccacctttaattaatacaccatttttcgctgcatttcctattgctgtaaccacagcaactggagttgagactactaaggcacaaggacaaccaaccactaatacagctaatccttgataaatccattggctccagtctccgccaaataatggtggaactactgcaattaaaagagctagtatgacaatagctggtgtatagtattttgcaaatttatcgacaaacgcttgagagggggcccgttctgcttgggcttcttctaccaagtgaatgatttttgaaagagtagtatcttcaactcgttttgttactttaacctcaagtaacccttcttcattcaaggttcctgcaaatacttcatcatttgtgattttcgttactggaacactttcacctgtaatcgcagcctgatttaatgtcgatgtacctttaaccactattccatccattgctaacttttgaccgggcttaactatcatgatgtctccaacttgaatctcatcaacatgaatcatcatttcttcattgcctcgtcgaattaacgcttcttttggggcaatatccattaaagattcaatagattgacgtgctttatccattgaataacgctctaatgcttcactaatcgcaaataggataacaacggttgccccttcaccccattcaccaataattgcagctcctataatggcaatagtcataagcgtattcatatcgaaatttaatcttcttaaatttttgagacctttaataaataacgaatatccaccgattaaaatggacgctgcataaccaattgtcggtagaacatgctcttcaccatactgctctcctaagaaccagctaactacaagtaaaagagctgatatatataccttaatgttttctttctgcttccaaaaaggttctcctcctaccctttgttctttttcatctcgaatttttaaattttcaaatgctcctgctttttctaattcttcaatggttgtcgtccctttaacataaactttagatgctccgaaatttactttcgcatcctgaacaccgggaagttctttaacattattttcaaaaatggctgcacagttagtacaagtaaatccttgaacacgataggctttcatttctttttcagactgttttgctttccctctagacattgatcttcacctctttcttatgtgccaatgcaatcatcataatttgtctgatatgctcatcatctaaggaataaaatgcaagttttccctcttttcgaaacttaacaatcccttgcttatggagcgttcgcaggtgatgagaggtatttgcaaccgtaacacctataatatttgcaatatcacacacacacagttcgtcatcttgacacaatgcataggtaatttttgctctatttttatctgcaatagcttttaacatttgggcaacactagaaatatctactgtctgtaaattaccttgtattcgattgaccttttcttcgtcataacaataaatttcacaagtattttttttaatcatattctcacctcaatatcattcaagtatttgtttgaatatagtataacccttttcattaattaattcaagtgtttttttgaatgaataaaaaaattcataaaaaaagacttggagtacccaattctaataacaaaataaccaaactgcataagactttaagtacataacattattagtattgaacttgttgaggaggtgctttatgaatcagcttgagtttcagcgtaatcacctgcaaatggactattacagcgagagctaccaagattttgaacgtgacttctaccgctactccaacatgaatattccattgatcttcctgaccgatgatatcctcaaaacaatggcgacttcacgtaagaattactttgtcctgaataaggaaaagtccaaagataaccgcgatcacttcttcatatttgaagtaagaaccttagaagagaatccactaatctatcattatacatataagaaaacaactacatacttaacacaaaaataggaactgttcaattgactgttcctatttttaatcttcataaaatctaagctattctattttgaaaaatttaccatcttcgaatatttttccaaaggaccagatggtttaaaactaggtccctgccgaccaattattaattttccttcccagatttcctcagggatattactatctgttagcttaaacaaactttttgagtttccaagtcgtttaaaatatgctccagaataaattggctcctgattactgtcatttgtgataaaagggtctttattcgaaatgtaaaaatcaaactcgttacgatctctcccaaaataaaagattggtatctcaagcatattatcaatttttctattatgaatatactcacatagatttaagtagccactttctacagttttaatcaaaccgagatctagtttatcttgctccgatattctataccctcctagtactagataaaaaattaacaatgcatggtttctagtttcttcaattgttgtccaatcatttaaattatgcttatgaaaatagccatttcttaatcctacaaaagttgacaatgactcaacaatataataatacgtttcgtcatcaataccatcagcaagtaaatccatattacgtggatagaatttctgactgttaaaatctccaaaaaaacttgtaatagatttaagatttatatttttaacttttgaactatcattaaggagtttgtcagagagtgtatctaacggtttagctcctgcaaatattttacggtttacagaatccttttctatggtatgtaaagagatataggaaaatagaaattgttcaatagatttaaaataccccatggctattgatgttaaatcaatattttctgcattttgaagagagtaaaatagttactcccttatatgctttcgacattgattatctgaatattcctaaatatgtcggtctatcaaaggagcagattctggaaaactaccgcatcctcctgacctatttgaatatcccatggtttctcgcattggatatgccggatttccctagttcggctagtgggcttttccactttttcgaggtcaagaagctttttatgctggactacctgatcttgatcttttctggaatgggcacgctatggtttgtacgacatctaaataggagacgagaatcttggcggctcctaccctacttccgccagggaacccttattccccttgctatccttttggctctcctggttagcttcgacacgctgtttgtgcttttccataaagttttctttaacaatgacgcctggctcttcaatgccactactgatcctattatcttagctttacctgccgagttctttatgcacagtttcctcttggcctttggattaatcgaagtcttcctaatcctggggtacttcactactaaatatcgaatctctgccccaagccgttgattaaaaaggttatggttcataagaaaaacagggctctccatcgaaagcatgggagccctgtttttatcgaaaatttatcgatctatgattttccttatacagcatactagctggtctgacccgattctggaagggggtcaaaccagccagtgttttttcgttcctgcttcgttttatttcggctctaatttcaatgtcatagcattgatggcaacaataacggtcgataaggacatgaggacggcgccgaaggccggacccaaggtaatgccgataggagcaaggaggccagcagcaattggaatcgcgataaaattgtagcctgctccccataccaagttttgtttcattttacgtgtcgtcttgtttgctaactcgataaaggattcaatatcccctggatcagactgagtaaggataatatccgcagaatccaaagctacttgcgttccagctccgattgcaatacctacgtctgccaaggcaagggaaggtgcgtcattgaccccgtctcctaccatgataaccgtcttgttttggtttttcatggactcgaccagcttgtacttatcttccggagattgattggcttggtattgaatacctagaacttctgcaactccttgtgcagcttcctcgttatcaccagtagccatgagtggttcaattccgtattttttcagcacctcgatcaagtttctgctggtttctttcagttcatctcccaatgcgacagcgccgattgcttcattattttctacaaggatacttaaagtagcgcctttcggaatatccatacgcaatgcttttccgtatgccttttggctgattaattgatagtggtggccgttcgcctccccttctattcctgctcccgaaacgatttcaatggagtcaaaggaaactgacttaatgcctttcgcttcagcgtggttcacaatcgattgggcaatcgggtgactggagcccgcctctatacccgccaacaagcctgtaatttcttcttcagaatatttatcactcaaaacagtgacgtccaacactttaaattcaccagttgttaaagtacctgttttatccaataccataacatccgctttagtagttaattccaaagcttctctatttttaaccagtaatcctcggcttgcacccaaactagtactacgtgatactaccaagggaatagcaagacccaaagcatgtgggcaggcaataactaacgcagtcacagtaaagataacggctgtaggcagatccgcaatgatcgtccagattagtagggcgattaaagctactacaaccgcaatgtagaacaaccagctagctactttttgagccacattctctgctcgagaaggttggctttgcgcttggctgattaatgtctgaacctgagaaatgaaggactgatcgcccgtctgctttatttccacatagaggactccgccaccattggttgatccaccgatgacctcatctccggtttttttttcaattggtttcgattccccagtcacaagcgcttcgtttacacgagattctccgcggataatgataccatcagctggaacattttctcctgcttgaacacggataacatctccaatctgaagttcagacacagggcgagtctcaatcgaatcgtcttctaaaacaacatgagcatctttcggcaccaactcagccaatgctttttgcgcgtcccctgcttcacccaatgccttcatttcaatccagtgtcctaataacatgattaaaattaaggttgtaaactcaaagaagaagtccatgacatgctctccggtcacataacgagcggccactgcgtaaacactataggcataagaaaccgttattcccaaagtaatcaaggacatcatgcctggagcttttgaattaaactcatctttcgcacccatgtagaatggttttccgccaaaaatgtatagaattgttgccaatacagctgctacaacgtctgcataaggaaagataatttggaaaggcaactgaatatccatcataggcgtaatgagtaagattgcaattcctaatgggagtgacttcaagaaaatctccttaaagctaccgtgatggtggtgggcatgccctcccattgcgccatgatccatttcactgtgatccatattgctgtgatccatctgactatgttccatttcattatggtcgtgttttgagtgatcaatgtcgccgtgattatgatgactatgtgacgaatgttttttgttatttctcatttttaattcctccttattatattagagactgattttaaagttttagaactttctcatctaacactacatataattctcacgaaaagggttctatactttatctctagctactatctatgaataaatgttattcgtactttatgcacttaatactgaatagttagtttctgctaaagcagcattgagcgtttcggtatcaatctctgtttgactttcaagtactgcttttttagtcgctaaatcaacctctacagattcaaccccttcaatagctgaaaatctttcttgtaccgtgttcgcacaacctgcacattttacgccatctaataagatttcttgtttcattattttattcccctttttttatcttctcctattatatagaataggtagaagtttaaatcccagataagctacgtgttttctaaaaaactgctggtttgaatcgtcttaaccgtaaagcattgagcaagaccgatacggagctgaaactcacggcgactgccccgccaacattggactcatcaatagtccgccaaaaatatacaaaagacccatcgcaactggaatacctacaaggttgtaagcaaaagcccagaacaagttttgtttaatgtttcgtagcgttgcatgacttaaatcaatcgtagtcaatacagcggttaaatcattacgcataaggacaatatcagccgattcaatcgccacgtctgtacctgatccaactgcaattccgacatttgcttgagctaatgcgggtgcatcgttaatgccgtctccaaccatcgctaccttcttgcctgcctcttgtagttttttgacttcctctgctttatcttcaggtaatacttcacttaatacactgtctatacccacttgcttagcaatcgctttggctgttcgtttgttatctccagtaatcatgattacttcaacaccgcgtcttctaagtgctttaacagccttcatggcaatcgcattgcccttctgtacactgacaatccacttcttctactgcgaaagatttttttatctctaatattttctctagtcgatctatatcatcgaagcttaagacatgatcttcaatgatgcttcctattacatttccgactttctttttgcaaatacggttaaaaatatcttctgcaaaatcccttacggcttctttctctacaatattggcagtgtaaataaactttctaccttcttgctctgtatttagtacgcctttttcaactaatcgacctaagatcgttttgatagtggattctgtccagtccattttttctttcaatacagagatgactgttttactagttactaaatcatttgcccaaactacacgcattacttcccattcagcatctgtgatagaagtattaagttctattgtgctcattttcctttcctcctcgttgtttacagatgtaaacgaatatgttcaagataagtttaccattgtaaacgaaatatgtcaaatcttttttataaatgtaaacttggaatttttttcaaaaaaagttaagttgtattgtatcaatttcagaactcacacttcggttttagtactcattttaatacaaattttctaagcaagaaaaaaagtcactcaataggtgactatagaacgtagacaaactctatttttagaaggtgtaaattaaaattatttaattaccattatttcaactaactcttgaaacgctcattttatcgtgtatcaggagtttttcttctctagaagaacaaaaaagattgaagaaaaattgtcccaaatggactttttcttcaatctgaaagccccatttaaggggcttttttatctataaaataaagttcagaaaagtctcaatcgtgccactttcatacatgatgtatagtccaagtggaatgaatactaacggcacaatgattcgctggtatttttcaattgtctcggatattaacggaatagaagatagcacccaactaagctcgcaaaagataattatgccgattgcaaacacaagcaacaccacgagggtctgtgaccaatctaacgaagcaaaataaggtatatagatacctaaattatctccgccagatgcaattgtcagcaatgttactgtccaaaacagttgatttgccttgctttgttctaatctttcaataatttcttcctcttcttcttcctcaccttctccaacaattgcaaagcgaatccctaaatagatagggattaaaccaagcaatccaaccatccatgcttcaggcacgaaattgacgacataagcagcaactaaactcgcccctacaagtaagccagtgcctagatactgccccgcataaatatgccatttctgtttattctgtgatagctgtgcaaataaaataattaaaacaattaaataatcgatactggtggaaatataaacaccaatagcagatatgattgtctgtcccataaaaaaaactcctgtattagtcagtaataaatcagcaaattttaagagaacacagacacattaatttagctatccctaatgggtaatgtcgaacgtaggaaagcattttactcctcctcaaaacatagttacaaagtaatttctaactggaattcggtgaccacttccatgtaaagtataacccattatactttacttcgtaaatgtgggctcgctgaggggtcttgcagacagctatttcggctcttttgagccgagtatcagcgcacccttacctcattcaaatatatttttgaatgtattctaacattaaactttgtagatgtcaacttcagctccgccaaaatatagataagaagttagtgtaccaaatataaaaaagccctgccatccaaatgataacagggcttaacttcaatatccaaaggacatattcatctaaaaaaggtagatttcttattgatttatattgcaatgtaatgaacttcaaaaattcaaaaatcgcttaaaatcaatgttttgacgtctaatgacgcgtagtgaaccacttacttaacctcagtaaagaaaatatagctaaaatagattttgactttcttaatgaggcacttaatgcaaatattcgtttgaaagaattagtagatgaactaaaaatttcaaaagaactggacagtaaaggttggtccaaaaaagactctcgaacgataaaaatcttgtacgatggccttatcaataaacatatagtttccctagatcgtgcagattataacattatccaagtcattccatttgctaatgtacatgtactactgtttttaataccagaaagggagaattctaaaaattatagaatatacaactacagtgattatgaaatggagttaatcaatgaggataggcaacaattttcaaaatatgaaacagttgatttagaccaattgatacttgttgatatttttaatattgatgactacatttcatcatatttaacaatataggatatagagaatctggatcttggtcttttaaagttgataaactatgctgataataaaagcgatagacatattttacaaacctgtttagaatttgctcaaaaaattgtagaatcagataaatctgaatatagtattctcattttactacaaataaaaaaacgattaaacatattaacacaaatggatagcaactatcttcattctctaatgaatcaaagttcggtagaaattaggtttgctgcagcctgtattctaggtaacaaagaacaagccagatattttttcgataaagaattcgctgatgaacaaaaagaacgatttctggaatatccgatttattacctccttagcctagactaataagttttaactataatgttaagttagagaaaacattttacaattgttttctctaatttttcttttttagtttaagattaataaataatatttttagcacaaaatttttactacttgcatcttaaatcttttatgatataattttgttagtttataaaacaacaatagttttcaggaggtaatatgttttctggtaaacgattaaagaaaagacgaataacacttggctattctcaatctgaactagcagataaacttcatataaaccgctcttcttatttcaattgggaaaatgaaaagactaaaccaaaccaaagcaatctcaaacaactagctatcctattagatgttcctgaaacatatttcgagtcagaatataaaatagtcaatacttatcttcagctttctttacagaatcaggaaaaggtagagaaatatgctgaggaattacttcaaactcaaaaggttcatgaaaagattgttccactgtttgctgtggaagttctatcagaaattcaactatctgctggtccaggtgaaggtctgtacgatgaatttgaaactgagactgtctattcagaagatgaatacacaggattcgatatagcaacatggatttctggtaattctatggaacctgtttataaagacggtgaagtcgctttaattagatcgactggttttgatcacgatggagctgtctatgccttgaattggaatggatcgctctatatcaagaaactctatcgtgaagaagatggattccgaatggtgtcaattaacccagatgttgctgaaaggtttatcccatttgaagatgaaatcagaattgttggtaaaattgtaggccacttcatgcctgtgattggaggttagtaatgtcaagacagtttgacgacattatatttattaaagcaaatagaattattttattactcgaccaaaaagaatatgatgtaactaaccatttaactgaattggttgatgaattagcaaaattgaaatctaggtgaatactatgggctatgtcgactactcaaaagaacctcgtagcgatattgcttttgtcgatatgaaatccttctatgcatctatcgaatgtgtagagagaggacttcacccgcttcatacttcactttgtgtgatgagtagggcagataattcagctggtctaattctagcttcttctccaatgttcaaaaaagtctttggtaaaggaaatgttggcagagcctacgacctcccctttgatgttcataccagaaaatttaactactaccgtgctaaaatttcaggattgccaacggatgcaaaatttgtttccttcatagaaaattgggccaagcgtacatttattgtgccaccgagaatggacttgtacattcaaaaaaatcttgaaatacaaaaagtatttcaaaattatgcagatccgacagatattctgccctattctattgatgaaggatttattgacttaacttcatcgctaaattattttgttgaagacaaatctctgagtcgcaaagataagttagatgtggtttcagcaaaaattcaacacgatatttgggaaaaaacgggtgtctattcaactgttggaatgagtaatgccaatccacttctagctaagttagcacttgataacgaagctaaaaccactgctaccatgcgtgccaattggtcttatgaagatgttgaaacgaaggtctggaatattcccaaaatgactgacttttggggaataggttcacgaacagaaaaacgactaaacaaattgggaatctacagcattaaagaattggccaactgtgaccctactatcttgaaaaaagaatttggtgttattggagtacaacattggtttcatgctaatggcatcgatgaaagtaatgtccatgaaccttatcgccctaaagcagtcgggattgggaattcgcaagtgctccataaagattacactcgtcaaagtgatatagagcttgtcctgcgtgagatggcagagcaagttgcgattcggctacgcagaagacataaaaaagcaactgtagtcgccataaatgtaggctattcaaatttcgaaaacaagaaatcaatcaatgttcagagaaaaattaacccaaataatcgtacgcttgtttttcaagatgaagttgtttctctctttcgttctaaatacgatggaggggcagttagaagcattgctgtaaggtacgatggattggtggatgaaaactttgctgtgatttctctttttgatgactttgaagaaagcgaaaaagaggaaaaattggagacaaccattgattccattcgtgatcgttttggatttcttgctgtacagaaagctagttctttattagaaaattcaagggcaatttctcgcagtagattagtcggcggacattccgctggaggattggagggtttaaaatgattgatagaagttatctcccatttaaggttgctagagaataccaagaccgaaagatggccaaatggatgggcttcttcttatcagaacatacggcaggacttgatagtgagcttaataaagttgactatacttctgagttatcaatttcagataaactactgctgctcaatcaattatacagtaatcagttgaatggtatcattgcagttcctggacaatattacagtggaaaagttgacaatctgacttttaaccatgtttcattgaagacaaaaacgggctttgtcagcattccaatcaaggatattctttcaattgatttggaggtggaatatgaatcagcttgagtttaataaaaatctattacaaatggattattttagtgatagctaccgaaaatttgaagaggatttctatcgctactcagccctagatactccacttacttttttaacagatgatattatgcttgccatggcaaaatctcaaaagccttattttaagctaaataaggaaaattcgaaagaccatcgtgaccattattttatgttcaatgtggaaccttcacgagataataatctagttaggctatattgttacgattcaacgaagacacatatttcaaaaaacaggccaaaataattggtctgttatttgttattattgctctctcgcctaccttgtctaaacctctcaatgtttttttccaattgttccgtgtgaagtttatttttcgcttcctggattgacctatcaagactttgatcctcgtcagttatatcgctttgagataattcaacgctcgtatcaggcttaaaatttgtatcaaaaaccacatctaggagttgttctactttggttagttcactatctgacatctctgatagtcgatgaatcagtcgtttgaattgatcctggttttgttttttcttttgaaaaaatttcattatattctccttcaattgtaaaaaggtagcccgcataggactacctgacttataaatcatcaatggctactgaaatagcctgcaactttttattttggattttcttttcatcaatcaattgatgaagttcttcaatttgcttctgacaggcggaaatatccttgttgttttgtgcaatggtatcagccaagtgttgtttatagtcacttgtgatatttaccttcttcggctgattttgtttaacggttgatgcgagcgtttgtacatcttttgattctgactccttttgttgctgttcaaaagcagccacataatctacttcttcaattggtttttcatcctgtttatgaaaaagtgctgcgattttagctcgttcttcatgggacgatgttggtttcacatcgtctagtggctgatcaaaattccatgttttactcattctgtatcctcatttctgtaatttgggtgtagtgtggtttctttaccaaaggcttgctctagtgcttcatgaaatgacaactgacttgattgttgtcgtttgataaaggtgctatacattgcagtttgtagttggtctcgatagtgttccaatttctcagtctcacgtgagaccttttcttcttgcctagctactttttcagccagacgttcaatcacactcatagggtgtcctccttgtcactttctagattatgatagcggacttgattttgttatcacaattccaaagcgtgctctcgtttaggtggaggatgattcttattgacttgtgcttgggctgactggataagatctcttaaagataattccttttgtcgtttcacaatatcattccaatctgactttgtttcaagtctttgcaatggtggtaaatcttgaaaaatcggaaatcctttatctgacagtttctgataaaattctcttcctgcttcatcgttatcaacagccatagttatgacgtttgaatgagtttgaaaaaaggttgtcgtctcttgtattgcctgaagataatggctaagtctaattggttttactgtatctagaaatgccaatttcccctgttcctctgctgctagacgcaaagtctgataagcaatcactgaaagttttaggccttccattgaaatcaggcgaacatctgatagctgcttttggtgaagttgataataactcatcatatcgataactgattcacaaaaaatgagtcgcttaggattcccaatatcgaaactaataccgacatggccatgagatcctttcatgatttttttgagataacctcgatcgtatttttcttcatttttgacgagaccttgaaggcttgcggcctgtaaggtcccattatggtcaaagcttttaaacactaaaactgactccgcttgataagtagcttgagcaagcaatccttgtctgccaaaggaattaatagtctgattacttagtccacggatgtctttcaagtaagtacgtgcttgctgaaagggttcttcacgcaaataatattggaagggttgataagtttcttcaatcaccttagcttcttcaaagcctccagtttcaaggtaagacaaggcttttttgaaagacactcctgccactaactgtacaaagtctatcacatccccttgtatatctcttgaaaaccatttgaaagtattggtatccgcaaaaatccgaaaggaatcatggtctgggtgttcataaatttgtcctgataaacgtctgaaggaataacccaaactttcagccacatctaaaatggccttttgttttactattttaattcgtgtcatcttgtctccctatcaaaaaagcagaagactgtctcctgctagttgttctcgcttgttgtagttccttggatcgttggtatgctggaattggctccatctgttgcttctttcatgtcctccagtttcccattccaaatggtcaactgattaactagaagcttgtcggaaactttggagtaggataacataactgtcttggtttctgtctgagttgttcgctgttgttgctcactcaaatcagaaacataagttacttgataggaaacttccgcaagtgcaacatggctttctgtattgacatagatactggctgattcaaatcggtagtcaagcatatagtctttataaacttgattgatcgctttattctgatttgcttcctcttctgaaaatgccgagtccgtcatgtagggtttgatacgagcgttattttcacccagctggaccttggtgaaatattgagtgagaaattcattgacaagctcatctgataggactgtcgctctttcctcctgctttttctttgacacaagtttattggcttctgctcgtatttggttctctgtttgctttgaaatggtttgtgagccaatcgtctagccaatcatgaccataaaactgactgcgattaaacctcctactccaatcagaaatcgagctttcactttatttaacatggcttactcctctattagtgatagcttcatcatatcaagattagcttggagattttatcacaagaaaaaggactacccattggtaatcctccgtgttaaactattctatttctccaccacttcataataatgctaaaaacaagaaatagattcaaagcaataaaaaatcctgtaaaactccaaactccattagttgctaaatcttctgaatagaggtatctctcagtaaagaagaggtaaattccatagatttcaataaagactaatccactgatgagtccgataagaaacaaagcacctgaaactttcacaatccgataaaggacaaacaacatcagtcctattgctgcgaaaatcaaaagactttgtagaatttgctccaacatcttacacctctttctaggctaattgcttacgataatagttggcttgttcctggtcaagttcatcaagttgggtaaccaagtcaaggtattccgtcttcgtcacctcatctaagtttgaaaaatcattctcacgacttttgatgatgagttccagctgtccagtaatttcacgctttgaaaaactgtaatcaaaggtctcatcttcatactgttcctttaaagtttggtagtttgccctatcttctggacttgtatagccttgtgccaaccattcttcaagtttataacgcatttcttctagtgtttgggtcatgatctattctccttttgtgatttcttgacttcattttaccgcgttcaaaattatttgtcagccttttttcttatatctcgagtgctatttgttgcttcttttggggtgttgtatcttcactaaacttggccaaagctgcatctatctcttcaatctctgcttctttttcaaccaagggagctaaaacatcatacttagcctttacaagctgatagtcctcttcctttggaaagactttatcaacttctactttggctactcgtagcttatcttttaaatcctttaccagctcttgcgtcttttcttggtcatctataatatggtcaatggcattactaatccgttgaatggttcccacgtctgatttcaaatcaagggcgacagtatactggttatcacctacaatcattaaagaaatggtttctggtaagggctcactagcacctcgtgtagtcatttttaaatcaaatcctctaaagctggcaagtgtcctgacttccttggtctctgagcggttataggtaatgagttttcgcagatagtccccagcttcagcacgattatccattgcttgattgtcaaatcgcatgacaaaatcttgcgacttggttgccaaagattgggcaatatctttatcatattgactcaaccgtttttccataatagggaggtgcttctcgctataggaaatggtatggcgatactcgtctttggagcgattaaaggctcgtttttgattctctaaaactgtcagttcattttccaactccattttgagtttgagataagggttcccagttgccaatgccttaaagtctgaggcggtcatggtttgttcatcaatgtcttcagctgatctcacaggatcttttgaggtcattatctgggtgatatactttagcttattctcctgcgtctgccagaggtaattgtcaaagctccctttagtaatatagtgataaatatctacctcctggtgcatgtttccttgtcgaattagtcgtccatttcgctggacaatgtctgagggcctccagggaacgtctaaatagtggacagctttcatgcgagattggacgtttaatcctgttccccctttttccgtagaagccatgagaatccgtacttctccactattgaccttgcgtgacagagagtttttcttctcatcagtattggcatcatggacaaaggcaatttcttcttttggtatccctcgatcgacaaacaagtccttaagttcattgtagacatcaaacccttcttccttacttttaggggttccaatatctgagaaaatcatctgagtggctttgtctccagctccatcacggtaaatccgctcgacattatcgactacttgaaggattttctgattatccgataaggagtaagtagggtcaatcaaccgcatatcaatagctagttttctggcttctcctgtgattttaagcatgttatctctacttggatcaacactacctgacttgatagcgtctgaacgctttaccagctcttccaaatagtatttctgagcttgcgttaactcgctttccaccgcaataatcttagcttccggtactggtaaatcaagcatgtctgaggtctgaatatcggcagtttccttgtagattcgcatgagttcaggaaggttgacaaatttcttgaaccgtttcttgggttggtacttatctcctgtcggggctagttccatggagttttcgatattcccaaaagccccaacccaggagtcaaaatttgataccaggtatcgttccaagacatcaggttgaatgtaatccatcatggtgaaaagttcactaatagagttagaaactggtgttcctgtcgcaaaaacgacatttctatctccatgctctgcctgtacttgtctcaccttcatctccatatccacgttctttttagaagttgtgttggtgattccagctacattcccaagtccagtgattggacggatattcttgaagtgatgagcctcatccacaaaaagaaaatcaattccaaggttttcaaactcaataaaggtatctcgctctagtttttggagttcttccaactggtgttctaatcccttaatcgaacgttccgcttctttcaccgtgtaatcactgtcacttcctagcttgatttctcggagttgctcaagtttgtcattgatataggtgacctgtttttcacgactcatcggtatcttctcaaattgtgaatccccaatgacaatggcatcatagtcccctgtaataatacgggacacaaactgcttgcgtttggctttggcaaagtctttcttagtagtcacatagactttcttggtagggaaaaatttcatgatttcttgaccaaactgagcagtcagactagacggcaccacataaagtggtttatgtaccattccgagttctttcagtttgaatcctgccccaagcatggtaagtgttttacctgaaccaacttcatgagctagtagagcacgtttttcctcgacaattcgttgaatggcattcttttggtgaggacgtaaggagatattctgagcaagtccatcaatggttaaatgactaccatcataggactttgataccgtacgattgtagagcctattataggtgtcttcaatcatttgttggacttctggatactttgctacaaaaccttgaaagagttcttgtaggtgtgtttccttggcacgcaggaccgttgttttctctacatccgtcacattctttttcttatccccttcgacaacttgttttgtgatggttggttgattggaattcaggagattttcaaagatttttcgaccactatcatagcgtgaagcagggacacctaaactcctatccgttgcgttggaataggtgtaggcaaacttagattggtaagtgataaccccgtcaatgggactgacttctaggactgtcgctacttcttggtctgacagttcataggctttccccataaaggtttcttgggcaaattttccataaacagccagaggaatccagcgtgaaccgattcgataatcaatgtctgccaaagtaatacgggctggtttgatagcttctagaagtcccgcataatgtgaccagttaaagtcctgattgtcttgtttgacgaatagatctaccacttctaacttagtgacgacatcccctgaaagaaagtcttggcgagaaacataggtcaattctccattcaaatacttctcaggatcaggcataatgaggtcgcctaactcctcaatcaaggtcatctgcgattcaacctgatagatagacatcatataagcgaaatcaacacctcgtccgtcagccaagctcgaatttaaggcatcaagggcagtatgcacctttttaacctctttttcaggacgcactagagccttctcaaaggcaagggatttagtatagataacagactttccacttggatccagactttcatcttccaaactagcaagaagcgaatacttatcatcactatcaaaaagattgcggttcacagcactattcaaatacccatagtgtttgacaaagctatcataggtacgattgagtttgcctaacaagtggttaaaggtctccttatcatagtcataatagcgttgaatggcaataacttcttggtaggcattgcgaatatcgaccattcctttgatacgtgccacttctttataagacaatggagcttcatagaaaactgtctttttataataccccttaaactgaccacgtttggctgcatcatcggtcacatagacatccagagcagtgttatcagtcacttctaaggcattaaagcgatcaatctgcttttgagaatgtttggtgtcccatgctttgaagttgccctcttcatcgacatagtaactgatttcttccgtcttggttccgactcgaatgcctttgttatctcgatagtaaactgtagacccctgataaccaaaactgtactgacctagattttccctcatttcagctggaatggaggtatcattgacttgtttggtcaacacatctgggttaatgatgacctcatttctatcaatctctcttggggccttaacgtgatttagagctgtttcaacacttgcaatcaagtcatcactagtccccttaacagaaagtgttcctccgttaaaattcctgacctcgtaggttcctagcacctggctattgtattctccatcaaaataaggattgagccaaatgcgactatccttgtcatagcgaatggaacctgaaaaggctaaatcgtctgccacatatcccttgtctaagtgtttctggaagaataacatatccgttgtgacactcgttcctgcaatggccttaaaggcagagtcaggcagtcgaaccccaccaagaaattcagttgtctcacgaatatcttgtaagatgttttctgttcgcttatccatagttcctgtggaagagataatcgctacttgtccaccatcatgaagcaaatcaagtgactttttgacaaagtagtcatgaatcatgtaaggcctatcgtacctattatccgcaattcgtatattggcaaagggcacatttgaaatcaccaaatcaaaactattgtcgttaaaagccaccgtctcaaatcccttaatttcaatatgactattgggatgaaggtgtttggcaatagctcctgtaatagtatctaactctacgccatacaactcactcttttctcttaagtgttttggcatagccgcaaagaaattccctgttcccatggaaggatctaggattttgccacctgtaaagccatctctttccaacttatcccacatctgacggatcagggatgggtctgtgtaataggctgtcagggaggactgtttcatatccgaatactctttatctgtgactaggctcttcagttcttctcgttccttagaaaattttggattatagtcatcaaaaaattcattggctagtccaccccagcctacatacttggcaaggagttcttgttcacttggtgaagcattgcggtgctctacttctagattttttaccaaacgaatggccacaatgtttgtctcaaccttatctctagcagtcttaggataaaagtccgtcaaatcttctggaaaataaaagtccgttactggaatctctggaattgtttcgacgacttcctcttcaggaatttgattatctgtttcttcaagatcagtatcgttatgaccattttctgaatcatctggttccaatagtccaatactctgaactggctcctcttccagaaatgagaataggtttaattcttggtccgcttcttctaactctgtttgtggttctgcctttggctgatgaagtgcctgactgacttcttcccaggtcctcacataaagaactggattttgttcaatgatatccgaaaagtcattgactaactcaatccgaatcaaaccgttcaatcgagcatcgctgaccgacatgacctcaaagtcctgtcccttataggaaaccaatgaccccagaggataagtgtccaatactctctgaaccagtggattttccgcgaattcttcatcaactacttcttttccctcagctttctctagcttgcttttccaatctctgagagttaaatctggctgattacctttatctttttcaaattgctccgcatcttctctgctgagttcttggtataaaaaggcgtaggcaacttgtcgcagctcttcaatggaaagctggctaccaaagaaaaattcaaccttttcatgacttagtcccatttggagtagttctgtcgcaagggctagttgagttaccgaggctttgggataaccacctagtaaagcaaggtctgcattttttaaacgaaaacgacctgctgcatccaataaaataccgactcggtctgggtcaaactgagataaatcaatccctagctgagtcaatttttcttgattttctatcctaatggcttgtccaattttttctaattccttttcttcgactgtagtcagcgttcgtttcagctcatagggactgccatcagcttcgagataagtaagtaattcctcgccatcaaagactggtgtcatttccatctctgtgtcaaaatcacctcgtctaaaacttgggactttggaacgttcatttcgaatttggtcaaaatatgttagaatctcaaatttacgtcgtaaggataactcttcataagctggcagatgactggtttttcctatttgaacatctagttgagacaaatctacatccaaactagcaataaccagagagccctcttctcgaaaagatattgcttgatgaacacttgttttgtgctcatcaacagtttcttcattttctagaacagtttcatcagctctagtttcaagctcaggctcgtaagttaagagaaactgttcaatatctcgactaatacgatccgctaaattattagccacacgatacacattgaccaaattagctcccctactcttttgtaagagtgaatccggcgatatggtttggtagtgtccattggaatccaataattgaaaacgagtggccagattgaacaaggccacttctatcaccaagtttttttcagacggcgatagtttatctagtttttgaagaccactttggccgaaaacttgtgtataggtcaatagatcatgagcagtatcataaggactagcctggacaaaagctgaaacatctgtctcaaagtgaagtacttgaacagacttatttatttcttgcctattggtcataaactgatgaataagactatcccactcctcatcaaaatgctctgcttggtaatataaaaatgcctcaagcaaggctctatcacgaggaatagtggctctcatcatttgtagtaagacttcttgattcattttccctcccattttaaaagggctgagagtgtttctcagccctttgagttaatctaggaccaaggttcgttggtctctttcttgtggaataccttccattacaattgccacatagtgttgtaagaaatgacttttctggtctagtaaatctttttgcaaggcaaggtgaaccaaatctccaaaataatcctgactggaaatagccaagtcctgttggatcatggcctgtaaggtttcaaggctaagtggtgaataatcgtcactatccaaaacctcatactgttccaaggtttctgagagactatttgaggacattaaatccataataaaattagagccttcacctgttcggtacagcttttccagaatgtcagtcatatctgcctgtacttcatcctgataactatcaactttaactcgtagctcatcacttatcaaggataggtcatcctcatccatataatcttgataaacctgattgaggattgttctattagaaatacttaattccaaagagagaaaagccttgataaactcttggtaatcgaccttctccatttcagacaaagcctctttcatggtgtcaaagttccaagtcattgtacaactccttttgtgggactaatggtgaatgtccagattgtagctcctctaaatcagcttgaccatcaccatctgtgtcaacagactgcggatcggttcccaaagctagttcctgagcatctgtcagaccatcctggtctgaatccttttcataaatagtttttggattcatctacttctcctcctttttcttcagtccataagccgtaccaagtagaataccagctccaatcaagcccaaaagggattcctgttcccctgtatttggcaaaatacttgctggaacaggcggttcaatagtctcaattggtggttgaggtggagtgggttgatttggacttggttcttcaggttgaggtgtatgtgttacaactgtatttgagctaatgacatagccattcactgtatggagataggtattctccacctgaccagccgcaatccgtttcatttgaaggtaaacatctgcctgaaaggctgaatcatcagagacagtctctaagaaggatttatcaaatgaaattgacacgaggccattttctgtatctacctgttgcaaggtgtatttcgtgacttctgtcccctcttttaagacagaaccgtctttgaggatgacatccgtcatcagatagctgcgataaacaccattatactcatcatgcttttcatcatagttatcttcaaaaccatattcaaataaatcagtcgcacgattgcttggaatcatcgctccaaccaagcgatagttaaaggtttgatgcaaggccacttctttcccgtcaaggctggcatctttatgagacaagtcgatcaccacatctttttgtgggtctaattttggaacattattaaccactgtttccgtgacataggccaagccaaaatcaatttgataggctgtattttcatactgaccacctgttttggtcaactcattttttaccgtcatcggaagcgtgacaactaaggtttgaccagtcttcacataggtatcataaaagacttttggatcatcgctactaagaacttgaatggctcctttaggtgtaaactgacgtttagccatggcatcttgaacaactttcggagcttctgacaaactagcgtaggtgctgacagagataccagatacacgattgccatccttatccaaaacttgaatgccatcaggatttagggtaagggcttcttctgggtaatcgtctaccatgtaaaatcccttggcaagaacatcatccgtcacgaccatatccttgtattgactgtaatccaagacaattttgtaataattgaccgtattcggaagaacagtctttccatcaattgaaataccttcttgattggtattagacttatgtggagttactttagggacaaaattggtcaccgtattggtttcataggcttgcccaaagtccacctgataagccacgttttcataagacttccctgaattaagcatggtttccaaaaccgtcattggagtgacaatggtaatattctcccccttggtcacataagattcaaaaaaggcttgtgggtcctcaggcatgaaaacttgaaaagctcctttaggctgaattttttgtttggaaaaggctgcttgtagcgttttaggagcttctaataattgagaataagacttcaccgtgattcctgaaactgttttgccatcagatgtgacaaactgaatagctgcttcatctggcaataaagcttcttctggataatcatccacaaagtaaaaaccttgtgcaatctgagagttgtctgctttaatccctcggtattggtccaagtcccatgaaagagtatagtgattttgagttcccactagcatgggcttcccgttgatatccactttatccttgtttaggttttgtttcttgggttctggtgaaacaagggtgttggtcacttccttggtttcatagccattgccgaaatcaacttgataagccttgtttgtataggtctttgtctgaccatagagactatctttaaccgtcattttggtcaaaagagctaaagaagttcctgtttgaacatactggtcataaaaggcttggttgtcatccggcataaagacttgaaaggcacctgtcggtgtaatcttagcacgagccaatttatcttgaaggtctttaggggcttcatttagggaagcatagtttttaactgtaattcctgataccttctgaccgtcaagggttgtgatagccgtgccattttccaccacatcaagcacttcctctgggtaatcgtccacaaagaagaagcctcgtgcaattgtctctttagcagaacgatctcccttatactggtccaaatcccaagtcaaacgatagtggttggttgtaccaagggctacgaccgtgtcattaatgaggacaccatccgcattttcattgtttttatctggtgtaatgagcgtggttgtctccccatcacctggtgtacgaaccgttacaacatttgaagtgactgtgtaagcattggttgtacccttgttcaaaaggagtttgtaactattggaataggttgccccatcattttgaacagaaccatagagttttggggcggtcaattgataaacctgagttaaatctttatttacctcctgcaacaagttttcctttgcggttaaggtcacaaaattcttagtctcatcaaagctaaggacatagtttccattctctttttgtgttgtttccttatcaaataggtaaccagcaggcaagtagtcctcaaaaatgagactagtcgtttgggcacgattgggcgataaggcatcaactgttaagggataaatcaccgttgaatcttttgcgacagttttctcatgaagattagcttggtcactattgaccacttctttcataatctctgaagttgtcgtcaaacggtacgcatgataatggacagttggtacttgtggtggcgttggaagttcttttggaataggtttgacaggcaaggttaccttggtcaaagttagactaggctgcactacttcatccaaaggctttggtgtgaaagttacaggcttttctggtgtaaatgtttttggtgtatagatatctggtgttaccgtaataggttctggaatgggttcaagttccaccgttacatgaggtttgggactatatggtgttactgtacgtgccactggtagggtatttaaggcgaaccagtatgacaagccaacattctgtggcatatcgccttggccaaaggttactgtgtaggtattacctgatgtaactgttgagacaatagctcctttataagcataacgacttgatgtggtatcccattcctcaggtaaattcaaatcacttgcacggttggaacccaaagaacgtgctagaccttcattagtcacttgaacagttgaaccattaatcggcacaaatttcccagatgaatctttgacatattctaaaccaatgtcattatgattgagggaagagtgtgtgaagactcctggcttttctttggagaaggtaacttgtgaaccgtcttccaagtaatacttggcaactacacgaaactccatcttgtctgttcgccagtcaccgtttccgtcatttcgataggcaataaaaccctcggttggatcatttggcacaaccaatttcacggcattggttccagctggtgatacaaggttggtaatatcgtaagtcacacgactaatctttttaccatcaaatcgtgcatgttgaagattttgatagttaaaactaagagtctcacctgttttgaacatgtcatagacaaagaatcctgttgaatccaatattcttgagtagcctcccagcaaagcatcgccagttgaaatgatctgatcaggatttcgggtaatggccccatgttgtgcttggggttcaccgttgttgagattgagggcttgagcaagggcttcagaaatataaccttcttcaccttttgaaatctcggccaagtcacgttgatagcgttccatttctttggtattataggcatcaatcgcttcattctcttttctggctgcggcttctttttctttattacgttttgtaatagcttcaatctcggctgcacgatctgaaactaattgttgtttctcctgattagcttgatctactgcggcttgacctgcacggttttcagcatcaacagctgcttgaccagcctgattacgcctttcaatggcttcattatctgcctttgcattagcaagtccagcttcattttctttttgaatggcctgatttttcgcaacaatatcatctgcctttgttttctttgttagataatccgctacagcttgttcgttagttgattgaatggtttcaacagccttgccatagtttgtatagtcaaggacagatgtcccatttcctgatgaaactacttgttcttttactgtcacatcagcatctgcataccgagcttttaggtcattgactttagtatcaacccaagcatttgtctctttaccagtttggttggccccctcgtaggcctgtgacagctccttattttcctgttcgatgcgagctttattcgattcgtatgtcgctttatcagctttgtaggttttagtgacttcattaatagtctcaacctgtttttgggtatctgcatctgcttttgaaatttgttggttggtttctaccgcagatcttgtatttcctaaatccattggactatcttcaaccgtagaaacaccttcagcctttgcttcttcaactgcttgtgttaccgtatcatgtggtacggtaacagcaatcgcaccgttagattgtccagttgatgccatactttcagtttgttcagatacagggtttggttgtgcttctggtaaatttgtggctggattctccgttcgttgaatggtggtgtcaactgaagttgtaacttcatcggcatgtgcaaccgttcctccccaagcaacaacagccgtcaccatggttccaagggcaacggaacatagagtgcgatattttttactcttgcgaaagacgtgtttctcgcctttttcctgattgacaagaaagtgatgattacatgttttggtcataaatagtccttcttttcttttttatgtagcaacaaactgtcactctttattagatacgagggcgttagcgagcacgacaaaaataggagttttgacgaagaactttccgttctatgagaaactctctttttttgtacagctcgtagcccaagttcaataccatcataaaaaagaaggcttgattttgttatcacaataaattgagggaaaagaaaatgttgcttttataccacaaatattgtaaaattgtagtgtaaaagcaacaagtggggggccgtatgtcaaaaaaagagattctactcgattttatagaaaagaacaatggcattgtcacaaacaaagattgtaaagcactaggtattccaacaatatatctgacaagactagagaaagaaggcattatcttccgagttgaaaaaggtattttcctaacccaaaacggagactatgatgaatactacttctttcaatatcgttttcctaaggctattttctcttatatttcggcactgtatctacaacagtttacagatgaaattccacaatattttgatgtgacagttcctagaggctaccgctttaatactcctccagctaatctaaacattcactttgtctctaaagaatacagcgagctgggaatgactactgtacctactcctatgggaaacaacgtaagggtatatgattttgaacgtattatttgtgattttgtaatacatcgagaaaagattgattccgaactctttgtcaagacacttcaatcttatgggaactatcctaaaaaaaatctagcaaaactctatgaatatgcgacaaaaatgaatactttagaaaaagttaaacaaactctggaggttctaatatgaacaaagctaaattaacagcactctgtcataaaatatcaaagaatactggtttaacctttaattccgtgatgacctattacttcctagaagtcattttgaaaaaattaagtcaaagttcttattcaaatcactatatcttcaaaggaggattcctactgtcgaatgtcatcggagttgaatctcgtagcactgttgatattgactttttattccatcaaataacactctcagaagaaactgttaaacagcaactcaaggaaattttagcagattccgaagaaggtatatcttttgtgattcaatcaatcacaactattaaagaaagtgatgactatggtggctatcgagcaacaatttcgtgccaacttgagaatattaaacaagttatccatttggatattgcgacaggtgatgttgtaactcctcagccgataacatacgactataaagctatttttgatgaagacaattttccaatcattgcttatacaattgaaacaattctagctgaaaaactccaaaccatctattcacgaaacttcttgaacagcagaagcaaagacttttacgatgtttatattctttcaaaattgaagaaaaaagatattgatttcaatcagttaaaaaatgcttgccaaagaactttttcctatcgcgaaactgagctcgatttcgaaaaaattattgaactactcgagagattcaaatctgatcctactcagaatcaacaatggcaaaattattcaaaaaaatatagttatacaaaaggaatttcacttgcaaatgtgcttgatgagatgattagtcttattacaattattatttctactgactctgattaaaacttttaactgccccactaggtaatcgtgacattaaaggaaaaggatatgctaactaatcaagttattgttagcatatccttttttatttcgtcgtataagcaaaactcaagctactatccactccagataatttacggaaggtatagtttggattgccattgtagttggtttctgagataaggaatgaaccgtctgggtagactttctccacaaaagccacatgtccgtattctgttggggtgccatgtcctcctcccgcaaaggaaaggatagctccttcttgtggacttgtccctgtctctccaccgagacttgcggctgttcgtacccaatcttggccattgcccatggtactgataattggaatcttctcaccgtttttacctttgagttttagacccagttgattgatacgggctgcgactccccaagtacattggccgtaagcgtaacccataccgtcaccacctcctggaatagagttttcaaaaaggtcttctcgtacagcttcaagtgcttttggatcgctttgtgctgtcccaccgttaggttgactaaagcctttttcaatttggtaataccactcactggctcgtgtttgacgttcaagtagcttatcaccactatttccttcccagtaaatgagaaagagctgggcaagactagctggactgcctgaatttttgaagaagtcctttaaccagttggtgtaataaggactatccccatacaacatgaaatccagttgtaagcctaagtcataccatttttgatgttttcctttggcatattccaacaataaagtatgtctgcgtgaaccatccgcggtatctgtccattggcctaagcctaaaccacgtttgagaatatttgggtaacgtccattgtatatagttggaccattaagtgtgagccagccctcatcatcccacgaactatctgtcgcaccaacaggtggagataaatagtcgccttcagctcgttttggattaatggaggattctaccgaccagttacctagaatggctgcgatagcttgattggtcgcacctttgcttttaagatagtcataaattgccttggctctctcgaactcatcgccgccaaactgaccgatagttggaagaatggtggtctgaacctgaatcacttttggaaagtagaatgctggattgacatagaccaacttatccgtgtcatcatcaaccttttgataggtgacttttagacccgttccgtctttggtctgaccaataatatctcctgccaagacttgttgattttcactcactcggcctgaatgaatgccaaacaaggttagtttagtcttattcactcccttaccagatgtcaaaacaacgttctctccatcaagagataccttgccatccatcggagctacaatgacttgaccttcttttgcttctaagatgatatgatgatgaagcgttggtttctcatcaatgacctcataaccatatcggtaggtcatgcttaaactatcctcatcggtctgtccctgaaagggattgtccaattcttgaagggctaaatagttgccttcttcggtcaattcgtttagttcttcttggtcctcatcagacagcttgtaagcaggttctttatataagtcagacatggatttaatagaatctccaccgtttaagtccgaccacagttgactgagaaattctttgtaggttgttccgcttgtctctatgaaatcatctaacttgtagtcttggtattgatgattcatgtaaaccatgacctcatcaatcttagtgtaaaaggtaattcccttatcgttggttcttgtatgttccgcatcttcccacgtcatgtgggtataactcttactcaattctatttcatcttgttgtatgacactactacctgaaacactcatgaaaaagctcatcatcaaaaggagtatcaagagaatgcctgagacaatccaagtcaaaggatttcccgcaaggacagaaaagaaagtcatacttcccttaatggcttggacgattcctttaaaacctgcgacactttgttttctgacatgatttaaaaaggtttggtagcgtcttcttggtttaagaggtttctggcgtgtgaatccttttccctttttgaagttctggaatcgttcctttccatgagaaaattttgttttggtaaaccgcacaccagtctgtccactttttactgccaccttacctgcttgataagtaaacctgccatagcgtctggctttcaaactagtatccttcatggttcttagaccatctaaatcatcctcctgtgctatcaggtcaagggattcagatgcagccaagcctaatccagctttgactttggtagagtttttcttagtcttttggactttcttgagttgtttaacctcacgcttggcagaacttacgtctttttctgcacttagccgatcaaatgatttttcttggtgaaactgaaagcgagacttcagggaaggattttctttttggaaagtaaacttgggattaactacctgctgtttctcacttagtttcacttctgacagatgttttcttgccgtccgcaaacgttcttgagcttgcggaagtcgatagttcttgatttcctttgccttcaacagtctaggagaaacataggtaatttcctttatgaacttctcttctgcttccttttggctactgagtagatttccttttaactctgttttcttttcctgaaacagagaatttttggctgattttcgaaatcttccttttttaggaacagtctgttttaaggtcctaacttctttccgataatgcatacgagctgattttaagttgcttcgaaagttttgcctagcctgtttgactagctttttatcctctttcatctcatgtcctcattttttcagggtccgtactcatgatgtcaaagagcttggtgtgttgcggaatcttattcttgaacggaacaacggtggaaccggccttaattaagcctgcccctttttcaggattgaccaagtacttctccagctctttagaaagcccaagcatatgcaccaattcttcgcgatcgctcttagcctgttttaaaagaatcatgaactcgctattggcaataatgcgtctgccattggcatccaaaagaagcgtttctacattctgagtaatacctgtcggtatcgccccatacttacggacacgactccaaagtttgaaaaagaaatcagaggcatacttgtccaataagagtagctgcatttcatcaaagtaaatccaggtcttcttccctagcttttggtttttgaccacccgattccaaatttggtcaaagataaccatgagggcaatttgttttaactcatcgcctagctttttgacattgtaaatcaggaaatgactgtctgttttaatattggtccgatgtgaaaatatgtccagcgacccttccacatagagttccatatccagtgccaagtccttagcttcctgttcaggttgttgagataagacaaagacccattcgaccaaggacggtgtgtcaaaatgcttatatgtcaagcgtgtcacacgatctatcaaggatttttcacgaccatccattttgcggtccaagagctttccaatccaagacaagagaaattcggatttgaccttaactgggtcctcatccatattctcatcagatagttctaagacatttaagaaggtggtagagtctggggcaatatcaatactctccccaccaaaggcttgaccgataatactgtactcattttctgggtcaacaataataatttcagtatcactatctgcttccttgagcttagttgagatgatttcgtgttttgtcgccatccctttgccagctccagaagtccctaaaatcaaacctgatggagtatttaacttgccacggtcaatactgatgatattacttgagatttgattgatgccataaaatttcccacccttgtcatgaatatctacggaagtccaaggtgcattcacggcaatatttgaagtcaatagagaccgagaaacaccttcgagatagttcttcccaaatggcaagagactattaaaggcagcttcttgcatataggtcaagttatcaataatcatatcattagaccctgccacttgcttgataatatcaagagattgtttgagttggtcttcagtatccgctagcacgccaattagaaatacggtgtcaaacagtttatctcctgtttgggtcatggtttgaagaagagcttcagcttcatcgatgttgttctcaagaacatggccgaccttctccaaatagattccagtccgagccattttttgttgttcaccaatcttttgtgattccatcaaggtcttcttggttcgtagcttggtcatggtttcagacttagtagagcctttggcatgtaggctaatcatcacttccaaatctgactgcatgaggtctcgaataaatttatcccctaactccatgccatagtcgcgaacataaacaatctgtaataatcgatcgtccaattcaatatgattcttgtgtttaaaggaaaggtaggttggggcaataaagtgtttggtggattgacctgagagagtcaaatccttataagaaaacggtaaatgattttcacctcgtaacatatccgcaaggacattcactcgctcctctccaccaagtaaaccaagagatacatcaatctctgaaaagccactcttgaaatattccccaatctgtgacagagaacgaaaagctagttttggtgtttggtcgctcttgccaaatgaaagaaacttgacagctgaaaagttgttctcacccgcctctaagttggcatccatcatgcgattcaattcatcacgataagtatcaaacccatcttcctgcaagggatagagaatactcttacgaaatttttccaaattaactttttgattgaaaatagtcagttggaaattggtcttatcatccagtgaattgattaaatcggaatatttctccacgatagctcccttatcatctaagccaactgtttggtaattaacatctcctaagagataggtttgtgagaaatagcttggactgacctgcataaggccattctgaaaaagtccttgataggctaacgtatttacggtagaagggctgatttcctgtttctgtgttttcgtcttttgctttttgtcattagaagaggtctttgatttcattgagtgttttaattttttcacgttggtctccttttcttccagtaaatgtgcggtctggcaccgttagttcataatgaaaacggtacttgaggtatatttcaaatggtaaatcgttggggcgatagaccccaaataacatgagtggaatggtaaagctaaaaacaaaaccatagacaaaccaatccccaaattgccaataaaataggttcaagcccaaaaccaaaatggttagggcgacagctggaaatacaaaaataacctgtctagttgtaaatcccagccatgccctgtgttgaacctttgagatgtccttaaagacacgtgtgttcataaatgttctccaatctaaataagctataaaaagaggaggcgagatagtgactcccttcctcctacatccccaaaatacttcgggcggttcgttgactgccaaccaaggcaatgattaacaatatggcctgtaccaagccaccaaacataatggcgagtgattccatcactccagctccatttgatacggcaatctttccagccgattcaaacaagggaacaagagatacaattagaaaaatcaaaataccttgaacggcatagaccatgatgtttttaaggtaaccaatcccaacacttctccagtcatcactaaggaaggtcggaatggtaacaggggcaaaaggaatcatcagatagagttggataaagcgaatggtaatcaagatattgacaaccataatactggccattcgtaccaaccaaatgagaatcgcaaaaaagccaataatcatttttcctacaattccagatcccttaatgcctgagatggtatcataattagcaccaccattcgtgacaagacttgccacttgttcaataacatatgaggcaatggcaataatggcttccacaataaccgtcgtattggtaatcacgaccgcgaccatgatgtagctgacaatcataggtgctatggcttcaaaggtcattgcaccgcctgagtttgcgattttcttggccatttttgaaaattcgagtacaagaactaccgcaagaatagctactcccaagggctgcataatacccttggtaatggctgtcatgtaagaccaaaccgtcggattaaagtccgccagtgacttaaccaagttagcagttgattctaaatcgacctgaaacccttcaaaaaggctatcgcttgacactttttcagaggctagaaatacaaaaggtgacgtaaaattcatcatcatgtcatgttctgacctcctctaaatggtaatctgtgtcacaaaagcacctgcggctcccaccatgacaccaccaacaatttctaaaatggcatttcggacgcctggcccaccatctttaatgttggttgaaaggttgataatgcccatgactacaagaaaggctcctactgcaatcaagcctttttgtaatagagacatggcctgggagaacatggagctggcgtccactccgtaaacaaagcctgttagtttttgattcatatttttcctcatttctattaatgtagtgacgtttctgtgcttaaatcccttatttgatagtctgacaagtccaattcttcctctttagccaagggattgatgtgatagttccaccaacggtcatcggtttccttatcagcgagcaacttccaatgtttatgtttgagaggaaaatatttcttggttcgaaaaacaggaacccctgcaatgcgtacgaggcactcatctcgtttcatagttccaacttcatcagccgtcatcaagtcacgagcaattttctgatgagaggtagaacttgaacccgtctgcccaaaagaacgactggtgcttctgacatcaacggtttgtttgcctaaaagtccactcatgaatttgaaagtttcctcgtcattcccacccaaatagaggagactgtcacagttccccagtatagttttccaagcttctttttccttataaagtccttggagttgagcgatattttggagaataggcacaagactcatattcctagagcggactgttgaggtttgttcagcgaagtctgggatttctccgacattcgcaaactcatccagatagcttctaacatgaataggcagttgccctttaaagtcaacatcagcctgtctggtcaaagtggagaaaaccgtagagaaaaataaagcagataggaaacgaaaggtcgtatcattgtctggaataacaagatagaccatggtcttttgagtgccccacgttttcaaatccatagtgtctctttgcgtcaaatcaatcaccgattgaatattaaagagggcaaatttagctgttgtgaccgcaatcaccgaatccaaggtcttatccttatagttttgaaaatctgcccagtttctcatggtaaagttctcatgaccatatttcttagcatagtcttcaaacaggacttcaagtatacttttgtcctgattgtctccctttgataagagtttgatgagtttcccaatctcagaaaaggctggataacggccacgcttacgtcttgcttcctgctcttgcttagaacttcctggaggattgtaaaaatccaccaagtaagaggcaatagctctcaccaatgtcatggaagcctcatcccaaaacggatcactgcgagaaccatttcctttggtattattaaaatagaccgttaacatacggttcaaatcattctctgtttctacataacgaaagggattaaaaccgtctgaattggtcatattaaccaagtctaaaaccttaacctgataaccgttttctaaaaagagtttacctgtcttctcagccaaatggtctttcggatctacgacaatattggaacagttaagttggataaggttgggtttcacaaagcgaaaggtcttacctgccccagaacccccaatgacaatcaaatttttatttcggtcaaactggggtttcttcttttccaacaaggttagacgaacatcacgagccaaaatcgtgtcattgaaaggattcttactgtaaaagttccgcttttccttactggttccaaatcgtgcagaaccatattcttccccttcccgatagactttctgtcctgtcgatacataaagatagactagcgtcatcattagaaccccaaggataaaggcaagaaaagatttttgagtaaaggaaaatagccataaaggattgaaaacctgatttaacccctctcctaagaggtaggcaatacgttccataggtggggcattagttaaactatcatagagtagggttagacgatggcagaaatagccaaaggcgagacccaagagtccaaagacaaatgctttttgcctggaatacattacaaggtcacctccttggtttttactgccgaaagttctgtcactctaattttctctttggccagttctatctcttggtccaaggttttatcaaaggttaaaccttctagcttctctggattagacatcagtttcttcaacaattcatccaagtgatgatcgagcaaggtcttatccttggcataaaagtagagatagtctttttgccaactaattgcgattggcagtttttctgactccatcaactccttaaatttctccacatcgattggcttatccagtatgtctttactaacatcaatcgcttcaatggcgtaaggactttgaaggagttcttccattttttgaaccccaatcttataagctgaatcttgagctaaggcttgcctagccgaccattctaagagttttaagagggttctgactgtcaataaactacttctttctacgtattgcatcgcttgacgttcttgttgttcagatgacatagtggcctcctcttttttcgattccctatcaaacataaggtgcttccataatacggaagcactcttgattttggtatcacaagaaagttacgacataagccaaactattccaaagtaaatgtaaggcgattgccgtcatacaatcagttttcaatcgaacaacagccaaggtcaagccaagacagctatagatgagccaactccctaactgattaggtccatgggatagaacaaagagaaaactggtcacgcctatttgttcaaaagggaatgtcaatttttcccacagcaattgcctgtaaacaatctcttcaagaatacttgcattgaccagaaacaataaaaagataataggaggaacctgttttcctacttgtaccaatactgcttgattcctagtctgaactggaaataggaaactgatgaagactgcaaaagcaaccatagccacaaagccaagaagcaaccaacttaggcgattttgtacgcccacaatttttaatggaacagttttatgacgggcaatctctaagcaagtcacacttaataggaccaattgtagcaagactataccctctattgtcagatactctttcaggaataaactcaccagaagaccgttaagctgtatggctagataaaacaacactatccttatcattgtcacctcttaaataaatcttcataatcaatatctaagactagaacaatacgctcaacccatcttatttgtggcatcagacgattagatttgtaatgccgtaatttttgatagaggcgattaaattcacttggataaacatattgaccgttgaatactttgcgagctagttctgcccaagtgaggtctttttcagccagaatgatttctaaattgtcccaaaatcgttcattcatcttcacacctaccctgtcacttgtttcatcagactggcctgaaacaactcttcttttacctgtctgggaagaaaagtacgtacttcgtctagcccaatagctggatagacgtgattctgacagacaatgagaggcagacgaaggttttggtctggcttttggagaatgagctgaatcatctcattcaaacttatcgaatattgacttttaaagcgaagaaatcgtggcgacagcaactcaaaacaatccgtggttttggcaaagagtgacagtatgatttcacggtttacctcacatgcttttgtacaacgataagccactccataggtcgtcaaaatggttagtaaatcttgatttgtattggtattatttcctagatatacctcaagcataggcacctccttatagggttaggctattttcaactgttggttcaggagttgagaaatagcgactcatatcaatgggcatccgtccttcaccaaagcacttgaccgtcactagagtcgttaaaatgccctcctttcccctagcagaataattttcaccaaaggcacgaaaggccaggtgattgtctttcgtcaatagtgtatctacaccatttttaatatccctagtttccataaaatccgaaatctgatgaagattggattcgtagaataggggatcattcatctctttgtggtaatcatcttcaaaagttacctcaaagtcacaatcaaaattggggagcgacagtatcttttgtaatagctgattggtttcagcttggtgaatacgttcttctaattcagtacaatctaggatacttttcttatgtagtaagttcatgtttttcttcctcttccgttcttctaaattctctggcaatggcttcaataactgtgacagtcacgctattgccggcctgtttgtatagttggctcttactagaaacactctctgctctttcataagcccaatcaggaaagccttgaagtctgaagcactctcttggtgtcagtcgtcttattctcaggcgataaagtttcccctctaagacaatgcctgtgacttcataccacttatcctgtcgatattccagagcagcaactactactcccatattgtctgaagtcgtcagagtattggatattccctttcccacacgtcccctacgtttggttgagtctggataagccagattgacagagtctccaagagttgcctttgcgtaccctgttttagtggcttccttgattttcagaaatggcagctcctccctcagcaaaatctttggcaccttgtctccaccttgcatggtggtcaaggtcggtgacaagccagaaatgtcaaatactctaccggtctggtcaaagctagtcggcagatttcctgcgacaacaactccgtgtttgtcttgactggtcaaagtaaacatagggtcttgattgtccttaaatcgacgaccatgttggcgtttttctagtctatctggtgttaagactggaatggcgatttttgcaccctctcctttacctcttgttagtgtaggagcaagtccactcgtcagatagacttcaccattcaaaccatgtttagagggattgatatttcctagcctttcaagatgagctgggctgtcttctcttctgagaggaaatatgaatctggaacggtatcttctagaatgtccgataataaagacccgttctctgttttgcgggacttggaagtccttgctgttaagcacctgccattcgacatcataccccaattcatccagcgtggagaggattgtggcgaacgtccgtccctcgtcgtgattgagtaggcctttgacgttttccaaaaatagaaaacgtggttggatttgtttggccgctcgagcaatctcaaaaaagagagtccctcgagtatcttcaaatcccaatcgtctgcctgcgagtgaaaatgcttggcaaggaaatcccccgcagatgatgtccacttgccctctaaattgtctaaagtcatggtctgtgacctctttaatgtcatggtattctatttccccttctgtgttaaacatggctttataagatgttctagcgaatttatcaatttcacaaaagcccaggcatttatgaccctgtgattccatccctagcctaaaaccgcctatcccagcaaataaatctaaaaatttcatttttcctctctttccaactaaaaaagagccttacacttgtaaaactcttgcttatatatgatcatccatttctggtgcacggatgatttcaacaatcaaaatgatgatagaaatcagatagattccacctagtatccaccaaatcatcttattcacctccttttacttcttgtcgtctcagttgcttggtccactccgacagcacaccattaaatacgtattcagctattacttcggctgaccgagcaaatcgcatttgttccaatgcatactgataccggtcactaaaataaatcatggcatagtcactagcagactgagatagacctgtctgtcttaactggtcatgaaccaaaccccaaatatagtctcgatcgtacttggtcacgccatcgacttttgaagtaaagttttcttcttttttctcatctactagctgcctctcctcctcgtccttcataactaagtcactcccttcagtttcactatatttagtctcacttccttcagtctcactaggggctgaatataagaccggccccgtctttctttgagactcccctagtgtttttttaacactagccccgtctgtatgtaagactggggtaggttcatgttctaattcccccaagtaaattttatttgccattcgacctctttcactagaggactgttggacttcatcaattaagccatattcacgtaaggttttcttgatagagagtagttttgactttgaacagcctaatagtgccatcagatttgaattggaataaatcaaataaatagccccatcctcatcaatccagcctttactcaaagacaactccaaccgatcttttaaaaccgcgtaggctaccttaacttccagcttcatatccttataacgttcactctcaaacaaaattttagggagtttataataacgctctgatgtctgatattgattagcggtaatacgtttcatgattgtccctccaagactaaaagtccaaaattcccgaattcatcaaatcggattaaacctgtttgttccatttcatttaccagttgagttgcttttagattatcaactcccatgatggtcatgatatggctcttcacgatatgacgtgatgactgttcttccttttgcataattacctccaaaacgcaaaaatggggtagacaatctagtgtctacccccgaaagtttattaaaacaaaaatcctgccaaagaatttttggcaggatttttggcaggaaaccaaatcaatttatcagtttctatcaatcgcttatcgctctcaaagactggtaaatagggattccgcaatctaattatgatatgactcttatttaagagtaactgaagcacctgcagcttcaagtttttctttgatttcgttagcttctgcttctgaagcaccttctttgataactgatggtgcgttatcaacgatagctttagcttctttaagaccttcgcctgtgatttcacgaacaactttgataacgccaacttttttgtctccagcagctgttaattcaacgtcaaatgagtctttagcagcagcagcttcaccaccagcagcggcagcagctacaggagcagcagcagttacaccaaattcttcttcgatagcttttacaagatcgttaagttcaagaattgtagcttctttaatttcagcaataatattttcaatgtttaatgccattgttatttcctccaaaaatatgttttaatataaaattatgtagctaggctacttgaagagtgcttatgccacttcttcgtctttttctgcaactgctttgacagcatatgcaacgttgcgtactggcgcttgaagtactgaaaggagcattgaaagcataccttctttgtttggtaatttagcaagagcgttaatttcttcaactgaagtgaatttaccgtctactgaaccacctttgatttcaagagcttctgcatctttagcgaaatcgctaataactttagctggtgcaataacatcttcgttagaaaacgcaactgctgatggaccaacaaaaagttctttaaggtcttcaagacctgctttttcagctgcacgagttaaaattgagtttttgataactttaaactcaacatcgctttcacgaagtgaacgacgtaagttagtatcttgctcaacagtaagaccacgtgaatcaacaacaacgatacttgctgctgctttcattttctcagcaataagttcaacttgttcagctttttttgcaataattgcttcactcattagttttacctccgtttttattttttgggataagcacaaaaaaatcgcacctaaacctagacacgaaagtacaatacgttattttataatgacgttttgtgcctcggtaggaatattatgagcactgctcccctactgtcttaggtcagtttcatcagaaactttaaatagtataacttataattctagcattgtcaataatttttattatttttctgaaataattttatagtaccaaaaaatactaaaatagttatctttatatcaaaaaaataatattttagtatttatttattgacctttactgactaaaggtgtattatagtaccagaaagataattaaatatttaaattagacctctctatatgtattaaagtataggaatcaataattaactttcaaaaattaaaatcaattgaggtatttaatatatggcaaataataatttttataatcgtgacccttttggaaatatggatgatatttttaattctctaatgggaaatatggggggctataacagtgagaataagcgatacctaatcaatggacgggaagttactcctgaagaattcagtcaatatcgtcaaactggaaaactccccggtcaagagctaaataaccaaaacactcctacaaaccaagtctctgcagatagtgttttgactaaattaggaactaatttaaccgatcaagcacgtcagcatttgctagatccagttattggacgaaacaaagaaattcaggaaactgcagaaattctagctcgtcgtactaaaaataatcctgttctggttggtgatgcaggtgttggtaaaacagctgttattgaaggtttggcacaagcaattataaatggtgatgtccctgctgctatcaaaaataaagaaatcatttcgatagatatttctagccttgaagctggcacccaatataggggtagttttgaagaaaatattcaaaatatcataaaagaagttaaggaaacaggaaatattattctcttctttgatgaaatacaccaaatattaggagccggttcaactggtggtgatagtggctctaaggggctcgcagatatacttaagcctgcactttcacgtggtgagttaacggttataggtgcaactactcaagatgaatatcgtaacaccattctcaagaatgctgccttagcacgtcgctttaacgaagttaaagtcaatgcaccttctgcacaagatactttcaatatccttatggggataagaaacctctatgagcaacatcataatgttgttttacctgactctgttttgaaagcagctgtagatttatctattcaatacatcccacaaagaagtctccctgataaagcaattgaccttattgatatgactgctgcacacctagctgcgcaacatcccgtaactgaccttaaatccttagaaaaagaaatcgctgagcaaagagacaagcaagaaaaagctgtcaatactgaagattttgaagaagctcttaaggtcaagacacgcattgaagagttacaaaaccagattgataatcataccgaaggacaaaaagtcactgcaactatcaacgatatcgctatgtcaattgagcgtctaactggagttcctgtatcaaatatgggtgctagtgatattgaacgcttaaaagaacttggcaatcgtctaaaaggtaaagtcattggtcaaaatgatgctgttgaggcagttgcgagagctattcgccgaaatcgtgctggtttcgatgatggtaatcgtccgattggtagctttctatttgttggaccaactggagttggtaaaaccgagctagcaaagcaattagcttttgatatgttcggatcaaaggatgctatcgttagacttgatatgtctgaatataatgatcgtacagcagtttctaagctaattggagcgactgctggttacgttggttatgacgacaatagtaatacactaacagaacgtatccgtcgaaatccttattctattgttcttcttgatgaaatcgaaaaagctgacccgcaagttatcacgcttctccttcaagttctagatgatggccgtttaactgatggtcaaggaaacactattaactttaaaaatactgttatcattgcaacctcaaatgcaggttttggaaacgaagcatttacaggtgacagcgataaagacttgaaaattatggaacgaatttctccatatttccgtccagaatttctaaatcgtttcaatggtgttattgaattctctcacctaagcaaagatgacttaagcgaaattgtagatttgatgcttgatgaagttaaccaaacaattggcaaaaaaggaattgaccttgtggtagatgaaaatgttaaatcacacttaattgaactgggttatgacgaagcaatgggagtacgtccattgcgccgtgtcatcgagcaagaaattcgagatcgcatcacagactactatctcgatcatacagacgttaaacacctaaaagctaatttgcaagatggccaaatcgtcatttctgaaagataaaaacaaaacccgtttggaagaatccaagcgggttttctagtggattgaaaaaggaaatcaaacttaccctaaccttcttcaagatactttacttattttaaatgtgcagagaggtcagcaatatcagctggtctagttcggcaacaacctccgacaacttgggcgccaagtttttgccagtcacttgtattttcaagtagggtgtgtgaatgatcagggctagattgccaagattggcttgccccatcataaacctctccagagtttggataggtcacaagaggcttgttagtctgctctgctattgcttgcaagaaatcagcaactaacgatggacttgaacagttaatgcccagcgccacgacctgtgggctaacatcaatagctttcgccaagtctgcaacagcactaccatctgagatggtcttaccatcttgagaggtgaatgacatataagcctcaacctgagggaaatcctcggcaagtagctcaataagagcctcagcctcctgagcgtttggaatggtttcaagtgccagaatgtcaacaccctcatctaaaagaagctcaatacgatggcgatggaagtttttaagaccttgcttatcaatatcgtagagtccagtgtactcagagccatccgctaaaaaggcagcgtagggaccaacatccccagaaatcaaaggatagattctctctgatttttcttcttttgtcaaacttttccaaacttgctcacgcgcagcttttgccaactgaacagtcaagcgaatcaaatcttctgtctgactttcagagacaccaacttgagctagtccttgtaaagtcgcctgataagttgatgtcgtcacaatatcagcgccagcacgaatataatcttcatgaatggtctgaatagctgctggatcctcaatcagatatttggctgaccaaagtttcccagaaacatcacaacctctactctcaagctcggtccccaaggcaccatgtaggatgagagtttttttactctctaaaagttctttaaatcttcccataagatcaccatttcttgtaacgtagtttgtgataaatatagcagaaaataataaatggaacaccgaagtaaagcccagcacgttgtgagctatcccaagcaatccctacaatcgaaatcaagagcaaaatgattgtgatataagggagaactggtgtaaaaggtgttttgtaagacaaatcttctagttgattctctttcaagaattccttgcggaaattgatttgtgcgactggaatggctagccatacgacaacaacagcaaagcccgcgattgaaaccaaggctagataaactgtgtctgcagcgtaaatacttgaaaagagcgacagcactgctcctgccattgacaagagaagagcacgcattgggacaccgtgtttattgattttcacaacagattttgacaacataccttcattggcaagggaccagagcatacggcttgatgcgtagagacctgagttaccagcagacaggatggctgtcaagataacgaagttcatgatatccgccgtaaaagggattcccatcttgtcaaagacatcaacgaatggtgctgtggatacgcctgcctctttcattggcaatagcgaagctaggacaacaattgtcagtacaaagaaaacaaccaagcgaccgattgtcgttttaatagcccttggtacagcttctttgggattatccgtttcaccagccgcaataccaattaactcagtaccagagaaggcatagttaacagccaacatgactgagacaactgcaacgataccatttggaaaggcaccattggcagtcagatgagtgaagagaatagccttgtgctgaccttcaaaggaaactagaccaaacatagcacctaagcccaagataataaagataatgatagcaataaccttaatacttgagaagaaagactctgcttctgcaaaaaagcgtacgctaagagcatttaaaccaaaaatcacaagggcaaaaaaggaagcaaatgcccaagccggcacatttgggaaccagcgctgcatcagcatggcagcacctaaaaattcagtccccaaggcgaccgtccaacaaatccaatatagccaagcaacagtaaaacctgttccaggactgataaacttagtggcataagtgtggaatgaccccgtcaccggcatggcaaccgccaattccccaagtgatagcatgaccaaataaaccacaacggcaccaatcaaataagacagcacagctccaagcggaccagcctgtgcaatggtataacctgaactcaagaaaagcccagtcccgataacaccacctagcgataacataaagagatgacgactggtcatcttacgctggaatttaccttcatcttcataacgatgattttccataacaacctccaagaaactaatacttttatcctaccacaatctagtcgtattggggaataggtattagctatcatatatgataaagaaaaactattacaaaaaatcagcgaatcataaatagcggtaaccttatttttttatccttacaaaattaacgaccttatgaaaacggtccatttgccaaggactaataatataattggtctccttatccttcaatagctgtacaggtgcaataatgctagttagtacacagacaatcaacatgataaaaccacctagccaatctccccaagtgagcattccttctgcactagcttgatagatgtatacgcaagctattggtactaggagaaatactgtcgttgctagaccaggattataccaagttttaagtttaatattcatctgaaaaccatgacccaagagctgcgttagactaaagaacatgactcctaatccaagccaataagcttgaggaaaagcaatactagcaatgtaaagcaaccaagcaatagtattaaccaacataatagactgagtattgcctggaaaacaatccatcagctcttcttcatcataaacaacatagttaatgataggtgatgccccaccgggaaactgatattcttcaaattgatgcgctagaagtgccataaagtaaaaatacaatagatagtgaagcattgaccagtcaggtctaaaaacaagcaatattactgctaaaataataaataaaattgctccaaaacgataccagtaatttctaaaatatgacatgataatacctcctatttaaactgtgtttcacgaaaatgtgttaaaaatggttttgagcgtgaaagatcaacatcactaaatgcgtaatttgaatgtcgacctaaacgcttatagattggggaacgaaaggctataaagtagttaagaacaatccatatcagcctaaaaaccaatcaagtccagaatacaacttccaatcatgagctaaataatagacagaaacagggacaagacctactaaggtcgtaagaagtcctggattataccacttcttcaaggaaagattaaaaaagaaaagatgcatggcaagttctgcaaatgcaaaaatcatgactgcaagtgttaaaaatggtatattgggacaaaaaatcggcaaaagataaacaatcactgcaaaccactgattcccgaaaaaggctgatagatggtttaagtcccacttactagtatcagtttcaaccgatttaagttcaactagcatagtgataagcggaaaacctccagggaaaccaaattcttcgaaaaagtgtaattgaataaaaagtcccgaaataagtagtgactgcactcgtaaatcccaatttccaaaaaataatgctaaggcaaaaagagaagcaagatagggacaaaagaggtaccattttgttatcaatgctttcataagatgacctccaagatttgtgacatttgataccatatagtataatcaagtgaacctataatatcaatacctttggaggttttatgcacaaatgactgaaagtgtgacagttaataaaaagagaataaaacaaatcactcaaacacaagaggatatcttaacagcttttggccaacttttggaagagtatccctatgagaaaattcagattagccaaattgccaagaaatctggctatgctagaaggaccttttaccgacactttgacagtcgagatgacctacttacccttttcatcgaaagactaacattaaatctctttaagcaacttggtcaattggagcaacctacttttagccaagttttccaaaatttttttagttattggtctgattataaatcccttcttctcattcttagaaagaatgacctactccctcaatttcaacaatcctggttccgacatattgatttgatagagttaggtcgtggtgatttatcttccaatacctatgctcagcgatttgcgattggtggtattttcagtgttctaattgagtggattcatcaggactgccaaacaagtatcgaagaattaactcaactttccttcgatattatcaatcatttaaaaaattaaaaagagctttgcagtagtctcaacagctactgcaaagctctttttgtcataaactctcaaattataactcagataaaatagtatcccatgattcatcaagacctgtgcggtcaacagatgaaaagacgatgaaatggtcctttttatcaaagtttaatttcttcttaatagacgactcatgtttattccacttgccacgaggtattttatctgcctttgtcgctacaataattactggaatctcatagtacttaagaaattcatacatttgaatatcgtccgcacttggatcatgacgaaaatcaactaaactaacaacaacacgaaggttatcacgtgttacaaggtactcttcaatcatcttgccccacttagcacgctcagttttagacaccttagcgtagccatatccagggacatcgacaaaacgcagtttgtcatcaatgttataaaagttgagcagttgtgtcttacctggcttactcgacgtacgcgctaggtttttacgaccaagaagcgtgttgataaagcttgatttaccaacatttgaacgaccagcgagagcaacttctgggagatcatcctgaggataatgtgacttgttagctgcactcaataaaatagacgcattatgagtatttaaaaattcttctgccatctctatctccctaagccgtctctaaaacaggcttgtcagtaccctcaacagcagcctttgtgatacgaacttttgttacatcttcttggcttggaatttcaaacatgatatcaagcatcgtttcttcaataatagaacgtaaaccacgtgcaccagtcttgcgctcgatagccttatcagcgatagccaatagagcatcctggtcaaattccaattctacaccatcataagataataaggtttggtattgtttaaccaaagcattgcgtggttctgtcagaatacgaaccagatcttctgcagtaagaagttctaacgctgcaactactggtaaacggccaataaactctggaatcagtccaaacttttgaatatcctcagaaattatctcttgcatataagaagcgttgtcatcaattttacggcttgtctgtccaaaaccaataactttttcgcctaaacgttgcttcacaaggtcttcaataccatcaaaagcaccaccgacaataaaaaggatgttcttggtattaatttgaatcatttcttggttaggatgtttacgcccaccctgtgggggaacacttgctaccgtaccctcaataattttaagaagggcttgctgtacaccttcaccagacacatcacgtgtgatagaaacattttcgcctttcttagcaattttatctatttcatcaacgtagataataccacgctcagcacgttcgacattataatcagcagcttgaatcaatttaagaagaatattctcaacatcttctccaacgtatcctgcttcggtcaatgaagtcgcatctgcaatagcaaacggtacattaaggcttttagccagtgtttgtgctaagaaggtttttcctgagccagttggaccaatcatcaaaatgttggatttttgcaaatctacatcatcgtcactactctcggtataactaacacgcttgtaatgattgtagacagcaactgctaaagcacgtttagcacgatcttgccctacaacatattgatttaatatttctaatagttccttaggttttggtacttctgctaaatcagccagtacttcctcagctaattcttccttaataatttcttgtgataaggccacacattcattacaaatgaaaacaccattacctgcaataattttttttacttcatcttggcttttgccacaaaatgaacaatagacattcatatcgttattacgattcccagccattttttcctcaacttttctattcatttaatttaaaataatgttccataaaaggcatggattgtgttgacaaggttagtgaaagcattcatcaaaaaaactgttcctaatccatatctttttttctttatagcaggaattgcacataaaacacaaatcacagctaaaaatgcggtaaagaccccaaaaaggctacgttgcattgaatagtattccttccttatttttcaaaatatgtcacagtaaaagcatgagcattctgctcatccttttcaaaataatctctagagataactttaaactcagatagattaacatcaggaaaataggtatcacctttaaattttccatgaactttagtttttatgattgcttcacaataaggcagaaatgctttataaatacttgcaccacctacaataaataaggtcttattatgttcctgaaaccattttataacttgttcaacactatttaggactgtcactccatctgcttggaattgttcatcttttgttaagatgattgtctctctaccaggtaaaacacgacggttcattccatcaaaggtctttcgtcccataagcaaagcctgccccatggtcgtttctttgaagtgatgtaactctttaggaagcctccatggtaaaccgccattaactccaatcaaatggtcttcatcttcagcccaaatggcaattatttgctttgtcatgacttttttcctcactaacttatctctagatattctaacaaattttacctcaaattgcttgttaaaaaacatgagatagttagattgctaaatcaaaacgtaattgaggtttaattgggtcataatcaactaacgcaaaatcatctggtttaatatcaaaaaagtctgttccatctggaacattcaatactagtttggggttacactcagacggttggcgttttaagagttcctgagcttgttcaaactggttatcataaatatgaagattattgataaaatagaaaaacttcccaactctccaaccaaaatgctttgcaatcatcatctgaagtgctacatactgcatagcattaatatgatgtgcaactaacatgtcattagaacgttgtgttaatgtggcatccaaataaagctcaccattaacgcgtctcacatcaaacatcgtttgaaaagcacaaggtagtaggccttctgtttcttcaaatgcttcatagtcccataatgaaataacattacgacgattccaagggttatcttcaagctgttttaagagttttgatataatattatgttttttaacaactgcaccgtagcgctgacctatcgtgccagtatggccaacttcccaatcattccagtatgtcacaccatatttatcattcaaaactgctaaatcatttgtctgatcttgataaatccagaaaatttctttaatagcagattttattggaattggacgtagagttgtaataggaaattcaccctttgataaatcatactctgcaaaggcacctgtaatatacttagaattagccatttccccatttttatatctaggtctggcttgctcgctaaatacaccttcagacataattttcgtgatattgtctttaaataataaatcggcttttgtcatgagatacctccaaagtcttattttatcagattttaaaaagatattctagtgagaaacaagactttgaaggttaaagctttttttcatatttttagcttctttatggtaaaatggaatttagcaaaaatgacttttattcagaaaggtttaccaatgaaaataggaattgataagattggttttgcaaccagtcaatatgtccttgaaatgactgatttggctattgctcgccaagttgaccctgaaaaattcagcaagggattattgttagattcacttagtattacgccagttacagaagatatcgttacacttgcagcttctgcagctaatgatattttatctgatgaggacaaagaaactattgatatggtgattgtcgctacagaatcaagtatcgatcagagtaaggcggcttctgtctatgtacatcaacttttagagattcaacctttcgcaaggtcattcgagatgaaagaagcatgctatagcgcaactgctgctcttgattacgctaaattacatgtagaaaaacatccagattctaaagtattagtgatagcttcagatattgctaaatatggcattaaatctactggagaatccactcaaggtgcaggcagtatcgctatgcttattagtcaaaatccatccattctagagctaaaagaggaccatctagcgcaaacccgtgatattatggacttttggcgaccaaattattctgatgttccttatgttaatggcatgttttcaacaaaacaatatctagatatgctaaaaactacttggaaagtatatcaaaaacgttttaatactagtctaagtgactatgctgctttttgtttccatattccttttccaaaattagctttaaagggctttaataaaattctagataataacttagatgaacaaaagaaagctgaactacaagaaaattttgagcactctattacctatagtaagaaaattggaaattgctatactggctcattgtatctaggacttctatcgttactagaaaatagtcaaaatttaaaagcaggtgatcaaattgccttcttttcatacggtagcggagctgttgctgaaatttttaccggtcagttagtagacggctaccaaaataaacttcagagcgatcgtatggatcaactcaataaacgtcaaaaaattacagtaactgagtatgagaaactcttctttgaaaaaacaatcctagacgaaaatggaaatgctaacttcaacacctaccggactggcactttttctctagactctatttgcgaacatcaacgtatctacaagaaaattaataattaatatgacaaaaatttcctggacaggattttcaaaaaaatcccctgaagaacgtattcattaccttgaagaacaagattttttagctgattcttccctagaaatagtgacgaatcaggacttactctctttatcactagccaatcaaatggctgaaaatgtcatcggtcgaatagccttaccattttcacttgtcccagatgttttggttaacggtaaagtctatcaagtcccatatgtcactgaagaaccgtcagttgttgctgctgcaagttttgctgctaaaattataaaacgatctggtggttttctgacaaccgtccataatcgtaaaatgattggacaagtagccctttatgatgtacaagatagtcaacacactaaagaatctatattaaatcaaaaacagcaattattagaaatagccaacgctgctcatccatcaatagtcaagcgtggaggcggtgcttgcgacctaactattgagattaaagaagactttttgattgtttaccttatggttgatacaaaagaagccatgggtgctaatatggttaacaccatgatggaagcattatcttcgccattagaagacatttcaaaaggcaaaagcttaatgtcaattttatctaactatgctaccgaatctttagtgactgctacatgccgagttgatttaagatttctaagtcgccaaaaagaggaggccatcaagttagctcaaaaaatgacgatggcaagtcaattagctcaagtagacccttatcgtgctagcacacataataaaggtatttttaatggcattgatgctatcgtcttagctactggaaatgattggcgagctattgaagctggagcgcatacctatgctgtcaaagatgggcaatatcgaggattatctagatggtcttataaggttgatgataattgcctagaaggtactctgacgctaccgatgcctgttgcaacaaaaggtggatccattggtattaaccctagtgtccacctagctcacgatctactaggtcgtcctaatgctaaagagttggcaagtattattctttcgattggactagctcaaaattttgcggctcttaaggcattggttagcacaggaattcaagctggtcacatgaaacttcaagcaaagtcgttggcactacttgctggagctaaagaagaacaaatttcagaagtcgttaaacagcttctagactctaaacacatgaatctagagacagcacaaaaaattgtcaataaacttactaaaagtaaaaaaagaatttgagaaaaatcatctcaaattctttttttacttgacttgaatttccataagtgtataatctagttataaagactagattatatggagttttaaaatgaataaaaatcaatacccaaaatgggaagaattacctgaactagatttgtatcttgaccaagtacttctctatgtgaatcaattaattaatcctaaaacaataactaacgataaactactcaccgcttcgatgatcaacaattatgtcaaacataattatatatccaaacctataaaaaaaaaatacaatcgccgtcaagtagcacgattgattgttattacagcttttaaacaagtttttgctattcaagaaatcagtcaaacattagaacttctgacagctgacaatcattctgaagaagcatataacggatttgctgcttgtatgaacaaagaagaggttcacgatttaccaccagttgtcattagtgcctgtcagacgttgaacctttatcaagaaacacaaaaattagttttagaactaggaggaaaaaataaaaatgcttaaagaaatgtctatcaaattaagtcctcaactttcctttggcgaagagcttgcaaatagtatcactcacgctgtaggagctttgcttatgctaatcctattaccaatcaccgctgtctatagtcacaaccacttcggattacaagcagcacttggtacctcaatattcgtcacttctttatttttgatgtttttatcatcaagtatttaccactccatgacttataacagtcttcaaaaatatgttctacgcatgattgatcactctatgatttatattgctattgcaggtagttatactcctgtcgcattgtcacttattggcggctggttaggatatctcatcatttttttacaatgggggattacattatttggtatcctttataaaatcttcgctcccaaaatcaatgataaatttagccttgtactttacctcattatgggatggctggttatctttattttccctgctattatcacaaaaactggaccagctttttggggattactcttggctggtggtatttgctatactatcggtgcactcttttatgctcgcaaacgtccttatgatcacatgatttggcacctttttattctattagcttctattttacaatacattggaattgtctacttcatgctataaaatttaactacattttattgattatttttttgctaaaccatgatataataataatcatctaaatcttagagagaaggcgtggacatatgaaaagtgcttatatcttttttaatccaaaatctggtaaagatgaacaagcattggcaaaagaagtaaaatcttatttaatagaacatgattttcaagacgattatgttcgtattattacaccttcatctgttgaggaagctgtcgccttagcaaaaaaagcatctgaagaccatatcgacttggttattcctttagggggagatggcactattaataaaatctgtggtggtgtctacgctggtggtgcttatcctactatcggactagtacctgccgggaccgtcaataacttttcaaaagctttgaacatcccgcaagagaggaatctcgctcttgaaaaccttctaaacggtcatgtaaagtccgtagatatctgtaaagttaatgacgattacatgattagcagtttaacacttggtctccttgctgatattgctgctaatgtcacttctgaaatgaagcgtaaattaggcccttttgctttcttaggtgatgcctaccgtatattaaagcgtaatcgatcatattctatcactcttgcttacgataataatgtacggtctttacgcacgcggttactccttattaccatgaccaattcgattgccggtatgccagccttctctccagaagcaacaattgatgatggactttttagagtctacactatggaacatattcacttcttcaaattattgttgcatctaagacaatttcgtaagggagattttagtcaagcaaaggagataaaacattttcataccaataatctgactatttcaacttttaaacgtaaaaaatcagctatccctaaagttcgtattgatggcgatccaggtgaccaattacctgtaaaagttgaagtcatccctaaagccttaaagtttatcattcctaactcattaccataatataaaaggacctagacataagtattagagtaaatactatctgtctaggttcttttttgttatacttaaagcaataaatatcattgaaaggaagtatacgatgacaacatttactgctaaatttattgaccaagagtgggaagtcccagtagaatcaggtcgctaccatatgattgttggggaattttgtccttatgcacaacgtccgcagattgcgcgccaactgcttggtttggataaacatatttctatcagttttgtggatgatgttccaagtgatataggacttatttttagccaaccagaacaggttactggtgctaagtcgcttcgtgatatttatcatttgactgacccgacctaccaaggtccttatactatcccaattttaattgacaagaccgataatcgtattgtctgtaaggaatctgcagatttgcttcgactttttactacagatttctctgatttgcatcaagaggatgctcctgtccttttcagccaagaaactgcttcacttattgataatgacattaaagacattaataagaacttccaaagcttaatgtataagttagcttttcttgataaacaagcagattatgatacttatagtaaggaattcttcacttttctagatcaaaaagaacacttactaggacaacgtcctttcttgctcggagataatctaagtgaggttgatattcatttctttacaccattagtccgatgggatattgctgggcgtgatcttctactacttaatcagaaagcgctagaagactacccaaatattttttcttgggctaaaactttatacaatgactttaatttaaaaacattaaccaatccacaatccataaaaaataactattacttaggcaaatttggaagagctgttcgtcatcataccatcgtcccaacaggtccaaatatggcaaaatgggaaaaataaagctaaaaagctaaggcaattcacagccttagctttttagctatactagtccaaagtggaccaatcaaattcaataaaagtcttgaagagatctccataagtaccactgtaagcaatatctttatctttataagtcattttcgtaataggataattgtcaggaacagtaacacatcccattaaaactcgaataaaatcatttggattttcaaaaacttggcatcgttcagtgtcgtaagcatctttataatacagtttaatcatcttattacctctgacgttttacaaggaaactttgacaggaagctatatctacttcacaaaaataatatcatttagcattggcttccttcaattgaccatacaatatataattgacttgtcgtaaatcagttatttttttacaattcagtgcacacattatcattcttaaatcttctttccaagaattgagaattgcaataacatcatctacaggataacgctcaactaattctaaaactgttctagaaagtccaacagctttagcacccaacactaaacattttaccatatctaaaggatgacgaatgccaccagatgctaggatatccattttgtccatcatagattgagcgtttattaaggattgagctgttgtttgcccccaggtattgagatacgaacggtcgcgtccacgttgattttcgatgtaagcaaaactagtccccccacgccccgaaatatctacagttgtgatacctatatcgtaagcatcctttattgattgtaaatccatcccaaaaccaacctcttttaaaataagtgggcattggatattgtcgacgtattcttttaagtgagaacgccacatgtgaaattcacgctctccttcaggcatcaaaagttcttgcatcacattaacatgaacttgtaaaaaaatggggttcatagccttaacggttgactctgctgctggtacaggcttgtctaaccctatatttgtcgccagttttaaatcaggatacaagtctgttgttgggtaggaatcatcttcatcgtttttgagagctgccgaatatgaacctgtcaccataacaatccctgtagcttgagcaacctgtgccaatttatgattgactgctttccctttttcactaccgcctgtcatagcattgatataaaaaggaaattcaaagctttgaccagcaaaatgtgttgataaatcgatatcgttgacattatattttggtaaggatgaatgtattaactcaatatcgtcaaaactattataatgcgactgatatttaagagcatattttatgtgatcatcttttcgatttgtcatgacagtgtctccttactaagtagttcaataccagcactctcccaacgcttgattagagtttgattatcatttttattaaaggatatggctataccacaatcgcctcctccagatcctgaagattttgtgactatatctaggcctttgcttgcctctttaagcttttgaagtttatcggtgtaaatagatggatgaagattaaataatagcaagctaatttcttctaaacatctcttaatcgcttctttatctccttctttaaaggctgaaagtaactggacaacttgatactttgtatcatctaaaaaacgctgcgtaatagttgatttaactatatttatcatttcttttgaaatggacggttgcattgtccatcccactaaaaaatccatctccaataaagcttgtattttggtaatacgataaccccattcagcttccaatacttgttccaaaggttttgtttcaatcatttttgaaacagccctacgatcaaaagctgaataagaaattaaatgctcataagcaatacaagcaatatctcccattgagccattatcacctctttttaagagaacataggcagataatttaaaaagcaagtcgcttggcatctctatctcataaagcgcagccatagctttaatagtcaaaacgacaacacttccgctagagcctataccaaatttaagtccatagcgctctaattttcccgtaatttcgaggtgaatcggttttatatttttgccaaaattaatcaaccattcttccataagcaatatcgtttcctgaatgagactatattgcttatctggctgtaagcttgccgtatagttaaacatatcagaataaaggctgtagttatctgcaaaagtagctaatgcagtcatataaataggaacgttctttaaaatagctacttgcccaggatacagtatcgcgtattcacctgcaatatataatttgccacctgtttgcaccttaaccatctgctaattcctttgtcgttgaaacaataatacgataatctttctccaagatagcagctaatgcctcaaggtcttgacgtaagcaaagtactttaacatttggacccgcatccatcgtataataacattcatgacctttttcgcgaagtttcttcacaacatccatagctttatatgtctcttctgtcaaatatgaaaaggctggagttgctgttttagttgttgagtgcattgcaagtgcattacgctctgtcagttgacctaccttttgaaaatcattattttttaggtatactaacatatcttgataatcttgttcagattgccttacccattcattaaaagtagttgaagtttcggtgcagattttcataccttcacggcttgaaatcggctttcttttgtcatttaagaccagcataatcatagctaaatctaaattagtgtgaactttatagatatcaccactatctttatcccaagcagcaacaggtccaaaaaaagagcgtgaagaggagcctgaagcaaacttggcttcttgagctagctgtgattggctaaggttagtaccaaaaaaatcattgcaggcctttactaaggctgataaaccacttgatgacgatgataagcctgcagctgttggcatattattagttgtttcaatctttacaaagccggacctattttgtcgaaagcgatccaagatagctgacattttgtcatgttcatgatcattttgaagaacaccagagatgtaaaattcatctttcttagcatccttcccaagggcagtcaaacgtgtttcagtgtacatgttttcaagtgttagagaaatactactggtagctggaatcattttttcagcatctgcttttccccaatatttgataatagcaatgttagcataagacttaacacttatactttttccgtccatgtgttgacagctccttctctttctaattgctgacttaagcgctcagcttctcttttttcttttacaagtgcgataatacaaccacctaatccgccgccactcattttagcgcctagagcaccacaactaatagctacctctaccagatgatcagcttctaaacttgagacacccaattgttttaaactttgatgtgctttagtcatcaagctaccaagttgtttggaatcacttttatgaatagcatcctctgatgcctctgctaaataacctaattcttttaaaaagggtagtactgcctcgccagatgatttcaccttatccactgcttctttagtatgcccatgaattcctgtatcagcaataactaaataagcattcaaatgcatgggtactgttgaaaaaccaatattgcggataaatttaatagtattttcactaagacaagtttttgcatctaatccactcggatttgaatgtgctatcatttctgctcgattaacaaggcattctaacaaatctgcctccaaatcttcatcaaaataatcaaaaactgcacgaatagctgcaatagcaactgcagctgatgatcccataccacgtctttctgggacttgtgactcaatatgatatgcaattttagaagaagttttacctaaatagtccaaggcagcaaaaatggctgtcgacaaaggatcagtcatatctaatgctattaattgaggagcctcttcaataaggcaagttacttcaatattttttaaaggaatagcaatggctggataaccatatactactgagtgctcacccatcaagataatcttgctatgagcctttcctataccaaacttttctttcatctttttctctttacaattctattaccttactattttaatataaatccttaaaaaaagcgactttaacgtgataataacataaattaaaggaactacaattgcagtccctttaatcttaaatgtaaatgacaaaggtaatggtatcatgtttataattcacatcgatacttcctttaaatagatgcaccaaactagttacgatagaaagaccaataccatatcccgattttttgttattatgtgactcatcctctcgataaaatcgttcaaaaaacttgctatagtctatgtctttaccattcttataagtatttgaaacttcaagcttagctcgtctcaaacgacttgaacgtgataacttaactgtcacagtccccataggatcacaatacttattagcattatcaaccaataatgtaaccaattcaaataatgatttttcttcagctttgacatgaatacctggttggatactcattataaagtctttaccatctttaatgattggacctttaaaatcttctgcagcatcttttgtaatatgtgaaaagtctaagtcaaccatacttatatcaggctgttcttcaaagcgggcaagactgaccatgccattaattagacccgttaaacgttggatttgatcatttgtagatttagtccactctgattcaccactcatcatttccaccaattcattattagcggagatgatagcaagtggagtttttagttcatgtcctgcattggtaataaaacgcctttgcttttcatagttagcaacaaatggtaagataactctccctgataaaactgaaacaattaccatgaagacgataaaacttaccaaggacatccatattgaaagttgcaataatctttgattatcaagatattggttggttgtatctaaaaataccactaaataatcatttttaccaaccttttttagtagataagaataagtactaaaattataggtgatatgacctgaatgactattttgtgatacgatacgcttggcataattttttatttgcctatcgcttacttcaaagatatttctagaatcaaaactagtcacgttaccttttgcatctgttcgcgcactgaaataacggaattggaaaatagcgtccgttgataggtcatcacctaattctttactaaattcaagtttattcggtatacgtccattgttgtctgcaaggatagttaacacacgataaatttcattcttcgtttgatagtgattagcagagttgaggacaccgactactgaaaataagacaacaagaatagctagcgcagctattccgataaaacgaagtcgtaaatttctaaacattagccaccatttatttcacttaatttatagctactaccttcttgaccaataatctccaagttagcaccaattgcctgcaatttttgtctcaaataagaaacatagataaagacgtatccctcatctacatcttcttggtccttatctgctccccagacatgttcgaaaagttgttgtgtagataattctttatcatggttcaacatgaaaaatgctaacattttagcttctttacccgctagacgaatagtgttttcacattgcaactcttgttcaccgactgataaggttactcttcccaatgacaatacattaggtgtgaaatcttccaatcttcgggacatagagcgaagccttgctaataattcttttagagagaagggttttgttaaataatcatctgcaccagcatctagacctgttactctatcatcaatttctgccatggctgttagcataataatgtgagatttatttcctgattgtctaatttctttgacagcctcaatacctgttttaacaggcatcatgacatccataaccatgacatcatatgcattttgattagctaaatcaatagcagtctgaccatcgtaggcgacatcaacaacataaccttggtgactaattgccgtactaaggacacgtgacatctgttcttcatcttctgcaattaatactctcattttattccttctttgttccactctctatcaattgacgaatcgtttgcatcgttaaatcaacggatgccatttcatcagcacaacgttttaattcccttacaattcgttcgggattttcaatatcatgcttgtatttcatttgatgttctaaactagcccaagaatcttgcgcaatggtacgcaactgaatttcaatgtaatatttaccgtctgaattacccaaacagtctggatagggggtatcaatttctaaaatcacatgataagaacgatacccatttggcttaacatgctggatataatctttttcaaccacaatacgacaatcatcgaatgccttaatacgttctataatttgataaatgtcgttaacaaaaccgcaaataatacggactccaatgctatctctaatcgtttttagtgcagaatctaccgttacaggtaactgtttgcgacgacatttctctatcatactatctgacgttttaatacgaccaatgatatgttcgtacaatttatagcctgtttcaaccttagctttatcattttctaattggatacgctggctgaaatcttctaaaattaatggtagatatcgaccataatctccataaatatttgtttccataagaaaccttcctattctctcttagcctccattatatcatagaaacttaaggcaaactaaaaagatggtaggtactgtgagactatttatacaaataattgttacttaaggatcttaccacaataatttgtaaaatttattgagtttgtcaagcaaaggcagttataaagttaagataattagtaattattttttcaaattctttttgtgattgataatctaaaacgacatgagaactactagaattatgatctgtttcaatgtatataaaaatttcaaattgagactgctcaataaatatggtatcggcatcattgataaactttctttttaatgtcttataataaaattccataaaatatatcctatgaatttccttttagtttcacactagcaaggggtttctctcctaaatatatctcggaatcatatttcagtatattaagagtctttaacggtataggctattaacctttctttgaaattttcttgatgataagtctaattgaaattatccattaccaacttgtcctgtattcgatttccatcccctagccaacaatcttttagttataaacttctaataacacctaataaataaagagtacttacttttatcgaaatatagaacaagactctctttgctaggttttatttttatatattttgaagatagtctgtactttatataggtataaaaaccgggataggaaatttggtgcatttaacataggtatattcagtttagcattatcttccttttaattagagcgttaagccctctaataatattttattccctttttaaaatgataaattgcaaaaaaagccatcaaatgatgactttttatgtagactcgcaagacgctcctctttagatatagctataattaactcattacaatccaaacacaccataacaaatagttcatcaaaatctatgatgtgattattaacaaaagaatcttataataacggtattggatcacatcgagtcagaagaattttaatttttacgtcgttttaaactgctagctgccaaagtagctgttgttgctactagagtaatcccaacaactccgagagttctattactttcctcgcctgtagttggaagaacagatttattggttggttttttagatgaagttaatactcctttgttaggtctattttctgtagtttgggtagatataaacttaggagactctgattcgcttggaatagaaattcccatttcctttggtagggtagattttactgattctcgatacacataagtcacttctgttgtgccttcagtgacctttccgaattcatttcccatagtttttgcagaaacgagtttataaatcttaccattaaatttaatttcagcgaatttataatctgtggtatcatatggtgtcccaacctttgattcgtgtgtatctagtattggttttttgataacattacctgtttcgtccacatagttaatcactacattccctacagcctctgattcatctttcttaagcttatattcatatgtaatggtctgatcttgttcagtcaccttaccatctgctggagcatcgcccttattatcacgcacatgtacaaattcatacaacttaccatctttttcaagagttgcaggtgctctatctgaatatgcttcatcaattggagcttctgatttaactgttttaacacttgcaagctcagtctctgtccctaaaataacatagcgggcatgaacatttccaactttaacgcttggaacctctaccactttacgatattgatagacaacatgttgttccccttctcgaagtgttcctttctccgctgctgatccctcttgaattgaaactagttcatattttattccatctttgtcaagtaacaatggtttctcagaatcattctcagctgtattataaggagtagcttggccttctttatcacgaatataagctgttggggtatcgacataggtatctttaagttttgtagcagtaccctcgataacataatctacaaccacacgacccttaggaacttcaacatattcatatgtaatggtctgatcttgttcagtcaccttaccatctgctggagcatcgcccttattatcacgcacatgtacaaattcatacaacttaccatctttttcaagagttgcaggtgctctatctgaatatgcttcatcaattggagcttctgatttaactgttttaacacttgcaagctcagtctctgtccctaaaataacatagcgggcatgaacattgccctttgattcttgtttaatgctataaacataagttactgacttagtaccttctgcaacttctccagatgctgcatcagtaccataattaaatgagcctccatttgtagccaacgtaccatccgaattaaccttaccaactggtactgtaatattttctgctactaattcatacaccttaccatctttagtaatagtgaaaggacgctcaactgtcgcgtctgaactaaggtctcctgatgattctgccgtattgtaatgtgttcctagaattgcatcggtggtatctttgtattcagtaccaataatattgccttctgtatcaatataatttacaacaactgatccacgcggattttgtaagcgaacagataaacgaagtaagtcatcgttcgaaatatcattattatcggaaattttatcatcaataacatcgcttgcgtgcttatttaaaccattaatactatctggtttaactacagttggtcgaatattcgcagtactattataatatccatctcctgtatgatatttctctttagaaaatgctgtaaatggaacagcttgatgatataatttaaatgaaacctctgtaaaggttccttttaaacgaattgaacctgttcccgctgggactgcatcaggcgttctatctagaccattgacaaagtctgcgtcagatggattaacaactgactcattaaaggtgtttttgtctgttacatcaaccgtattcgctgtaactgttaaattaactcctgaacttgctttttcaaggcttatacctggagttattaactcaaagaacgttgaattatatgaaccacgtgcatagtcaattttttcaacaatcctaccattttcattggtagtttctgtaaatgatagatgtgcattacctccaacaccagataagtcaataatagggtctgtaactgccttgtcaaatttcaatgttaaaatagttgatggcgccttcccattaaaattgagcttatcagatagtttactacctccttcagtacgtcctggttgtgtatagacacctaaagcaggtatttttgcaggatctacatttccaacaaacatttctgatgttgctttatattctgactgattaccaccatttgttaaaacaccagaaccttcatcattccctggtacaggagtaattgtcgcagtcactttgacggttgagttatcgtcacgaaccaccgttgtttcagcacttttaaatgattcatcacgaacacttggagaaatatttttatttcgaacactgtcagcatatggattttgtaacgtccaatcgccactagtagcatacgtcctcttgtctactgatggggctacattatcagttgttggtgatgttgctgctaaagttgcaggcttaatgatttctgaagtattactcaaattacttccttgagtgctagttgcactcctattagtggaagtaggagttgaattgttagaagtgaccaagtttgcatctgtggccgttacacctgttggagttgttgcagatgtaacactagttgtctcatctgcaagtacctgaggagaaatgaataataatgatcctatagcaactgaagctactccaaccgaaaatttacgaatggaaaactttaaacctttttcaaaattatatttacgaaacataatatcaacctccctgtaacagtttttatatttcacataatgaatagcaaaaaattaaaacgctgtcaattagaaaggtaaagatttttgaaaattaccctaatttaaaaatattttgactttacataaaactaaagaggagtcttattcaagataaattgaaaaatagatactaagacctggtagtttacataaaacagattcgatacttctatccaatataaagataattaaggagacttttaactaaaaagtgtctctgaaagctatttacaattgattatattatcacaagtctattaagcaggtttaaaatcatattatcagacactataaaaactatctggtgtagctgattgtattaaaatatttagtatatctatttaccttgctcattgtccaaatgggaggttcatctcaaagtattacagtataacaagttaaactgtagcttaaaaatttcctaaaatttctttacaatatcatcctcatcaatcatgttgctctttaacactaaaactacttaaacacaggaatttccaaaagaacaaaacagttaaagtgactaatcgtttagttcttttagattgaagttgaaatggtaaacgagaactatcggctatatttaaaaatgattctctagataacttacctttattaaatattgttaaactagcaatcctgtagaagtaattcttaccaattctctcttcatgtctttaataaaatcacagcattaagtcatcaccctaagatagttaatcaagattttccattgccatatttttagctaatgtcctaataacctttttggtggtacgaatctcttctttagtaatacctgctaacatagtactatgcaatttttctaagaaaatttcaaattgtgtagccttttttttacctaagtgagtcaaataaagatattttacacgcttatctgtcttagatggtacaatcgcaataaaaccatttttttccatccgttttaccaaattagaagctacagacttagaaatgtgtaagatttcttcaacagcttttatagacatatccttatcaggatgtttatagagatacatcactaggtgtccttgtggacccgctaaatgttcaacatcatattcttttgcataatgatctaaatacttttcaagttgattaacaagtattcgtgctttttgaagaggattctccataatcatactcctttaatagttaccgtgagaactattttaaaacaacctttattaattgtcaattaaaacttatcgtaagaactactcctacattaaaatttctaatatatatatatatatcattcgttaaataaaaaattatttcgcttactatccaagattaaaaatatatgttcgtttttttatatcttaaattataaatttatattgatttttaatttaaatgttagtaaaatacaaatgtaatatttatttaatttacaggagatttaaatgaaaaagaaaattattttgaaaagtagtgttcttggtttagtcgctgggacttctattatgttctcaagcgtgttcgcggaccaagtcggtgtccaagttataggcgtcaatgactttcatggtgcacttgacaatactggaacagcaaatatgcctgatggaaaagttgctaatgctggtactgctgctcaattagatgcttatatggatgacgctcaaaaagatttcaaacaaactaaccctaatggtgaaagcattagggttcaagcaggcgatatggttggagcaagtccagccaactctgggcttcttcaagatgaaccaactgtcaaaaattttaatgcaatgaatgttgagtatggcacattgggtaaccatgaatttgatgaagggttggcagaatataatcgtatcgttactggtaaagcccctgctccagattctaatattaataatattacgaaatcatacccacatgaagctgcaaaacaagaaattgtagtggcaaatgttattgataaagttaacaaacaaattccttacaattggaagccttacgctattaaaaatattcctgtaaataacaaaagtgtgaacgttggctttatcgggattgtcaccaaagacatcccaaaccttgtcttacgtaaaaattatgaacaatatgaatttttagatgaagctgaaacaatcgttaaatacgccaaagaattacaagctaaaaatgtcaaagctattgtagttctcgcacatgtacctgcaacaagtaaaaatgatattgctgaaggtgaagcagcagaaatgatgaaaaaagtcaatcaactcttccctgaaaatagcgtagatattgtctttgctggacacaatcatcaatatacaaatggtcttgttggtaaaactcgtattgtacaagcgctctctcaaggaaaagcctatgctgatgtacgtggtgtcttagatactgatacacaagatttcattgagaccccttcagctaaagtaattgcagttgctcctggtaaaaaaacaggtagtgccgatattcaagccattgttgaccaagctaatactatcgttaaacaagtaacagaagctaaaattggtactgccgaggtaagtgtcatgattacgcgttctgttgatcaagataatgttagtccggtaggcagcctcatcacagaggctcaactagcaattgctcgaaaaagctggccagatatcgattttgccatgacaaataatggtggcattcgtgctgacttactcatcaaaccagatggaacaatcacctggggagctgcacaagcagttcaaccttttggtaatatcttacaagtcgtcgaaattactggtagagatctttataaagcactcaacgaacaatacgaccaaaaacaaaatttcttccttcaaatagctggtctgcgatacacttacacagataataaagagggcggggaagaaacaccatttaaagttgtaaaagcttataaatcaaatggtgaggaaatcaatcctgatgcaaaatacaaattagttatcaatgactttttattcggtggtggtgatggctttgcaagcttcagaaatgccaaacttctaggagccattaaccccgatacagaggtatttatggcctatatcactgatttagaaaaagctggtaaaaaagtgagcgttccaaataataaacctaaaatctatgtcactatgaagatggttaatgaaactattacacaaaatgatggtacacatagcattattaagaaactttatttagatcgacaaggaaatattgtagcacaagagattgtatcagacactttaaaccaaacaaaatcaaaatctacaaaaatcaaccctgtaactacaattcacaaaaaacaattacaccaatttacagctattaaccctatgagaaattatggcaaaccatcaaactccactactgtaaaatcaaaacaattaccaaaaacaaactctgaatatggacaatcattccttatgtctgtctttggtgttggacttataggaattgctttaaatacaaagaaaaaacatatgaaataataaaaataggtttggataaaatatccaaacctatttttatattaatatgccttccaaatgatctaactcgtgttgacaaatttgagctggaaaatctgtcaacttgatttgctgttccttccaattgatatcacgataagaaatcgtaatgtgacaatatcgttgtgtacttctgcaacctacgagagaaaggcaagattcttctgtctcatatggatccgattttgcaactactacagggttaaacattactaaatttgtaatacccacattgatgataatgacacgcttcagactaccaatcatatttgctgccatacctacacaataattttgattagcatgcaaagtctcctgtaaatcttttgctaagctcacatctgctctactagccatttgtgatttttgttgtaaaaagaaagtatctctaacaattggttttatcatttattttaacctaactctattatgataatactagtataccataggttagctaaggactatgataagagattaaacaataccttgtgcagacatagcttgagcaacttttaaaaagcctgcaatgttagcacctagaaccaggttaccactatcgccaaattcatcagccgcttcggaagcattcacaaaaatagttttcataatacgttgcaattcttgatcaacttcttcaaaagtccatgccctacgactagaattttgtgccatttcaagcgctgaaacagctactccccctgcattggcagctttagcaggaccaaaagcaacccctgccttttggaaaactttaatagcacccaaggtagatggcatatttgctccttctgttactgccaagacaccattttcaactaataacttagcgtcttcttcgtctaattcgttttgagtagcacacgggaaagctaaatcagctttaatagaccagatactaccttgatctgctggtgtgaaattagcttttggatgtttctccgtatatttaacaatacgtgctctttcaacctcttttatctgtttcaatgtttcaaggtcaataccgtctggatcataaacataacctgaagaatctgatacagctacaacagttgcacccaactcttgtaatttttcagtagcataaatagccacgttaccagatcccgaaaccagtgcaactttgccagttaaatcttgaccacgcgctgctagcatttctttagcaaaatagactgccccataaccagttgcttctgtacgagccaaagagccaccataagtcagtccttttccggttaaaaccccattttgataaccatttaaacgcttatattgaccataaagataaccaatttcacgtccacctactccaatatcgccagctggcacatctaaatctggtccaatgtatttttgaagttcagtcataaaactttgtgtgaaacgcatcacttcattatctgatttcccttttggatcaaagtttgaccctcctttgccaccaccaattggtagacctgtcagtgaattcttaaaaatttgttcaaatcctaaaaatttgacaatagattgtgttactgtagggtgaaaacgtaaaccacctttataaggaccaatagctgatgaaaattgtacacgatatcctcggttaacttgaacctggcctttatcatctacccatggaactctaaaagaaatcacgcgctcaggctcaaccaaacgttctaaaagattttcttcaatgtactgagggtatttatcaaaaactggtactagtgactcaaaaacctcttcaaccgcttgtagaaattcttcctcatgctcattttgcttcttcactttctctaaaacacttgctacatatgtctttccgcttgtcatttattttcctccgtattgttttaatatagttagcattataaattgtcagaattttcttgtcaactatttgctatggtatcattattaggagcaattttaaaggtaattatttgacttttactgactttcgttctataatgagacaaatatttgattggagtatctatatgaaatggttcccacttgttggaggtataattgccttattagctggcttctatctctttataaatcctgtaacggttgttgcaactctgggttggttcattgctttatttatctttatttatggcatttcaaatttagtacgctacttgcaagctgattcttatcaccgtagcccttggtatctggttcagagtatccttgctattatttttggtatcattttactatccagctcagcaatgtcactttcaaatactgtcatgactattttagcatactggctactggtatctggtattttacgacttttgggtggtttccaaatgcaaaaaattaatttcccaggtgccaaatcctataaacgttcggcttatattgcactcattttaggtattattttactggttcaacctaccttatcagcagccatcattggaagatttgtagcctttatattaatagcaattggagcttcggctatttacacttttactcgtattaattattaaaaggacatgtttcgtgtcctttttttatctattgatgacgtcatttactatttgaaaattggctattatataattcgtaataaaatcctttatctgctaggagtttctggtgattaccttgttcgatgatttgaccatcctttagaactaaaatgttgtctgcctcttgaatcgttgatagacggtgtgcaatgacaaaactagttcttccttccatcaattttttcatagctttttgaataagcaattccaaccttgtatcaacagatgaagtcgcttcatctaaaattaaaattttaggatctgctaataaagcacgtgcaatagtcaacagttgcttttgtcctaaggagatattgcttgattcttgattcatcaccatattgtagccaccaggtaacgttcgaataaagtggtcaacattcgcagctttggcagcagcaactatatcctcatcactggcttcaagattaccgaatctaagattttcttttattgtaccttcatataaccaagcatcttgcaacaccatgccaaattgttgccggaaatcttggcgtgataggtgtctaatatcgtgaccatctacggtgatagcaccttcactaacatcgtagaatctcatgagtaagtttataagtgttgtcttacctgcacctgttggccctacaattgcaatcatttgccctggttctacatctaagttaaagtcgcggataagtggcttatccggagaatagtgaaaatcgacaccatgaaagctgacttgaccggttaagtcatggctcaatttttcagtgacttgattggcttcctcttcttcatctaagacttcaaaaatacgttctaaggaagattttgcactttgcaaaacacctgctaattgtgtaatggtttgaacgggttgactaatttgccaaacatactgcacaaatgcctgcatgttaccaattgttaaggtaccagcaataacttgtaaaccgccaacaaatgcaatgataagataaataaaatcagagatactattcaatactggcatcataattcctgaaatgaagctagctttgaaacctacatgacgtagattatccgttatatcacgaaattcttgactagacgcctcttctctaccatataattttatgatattgaaaccagttaatttctcttgtacaaaaccattcagttctcccagaatctttgcctgttctttaaagtaaggttgggatctttttagtatcgcttgtgcactaaaataagttacaggaatacaagcaatgataatcatggctaatggtacatttagataaagtaccataacgactactagaataatacttaaaaaagcattgataatctgtaaaaagctctgttgtaaagcatttgagaccgtttcaacatcacttgtaaaacgtcccaacatatctccaaattggtgcttatcaaaatacgatacaggaactttattgattttacgattcaaatcatgacggatatcacggatacttttttgaacgacagtagtcataaaataatttgagccataagaacctaattcatagaaaacacctctgaaaaaataaataatcagaataccagcaatataaggaacgttcaattctgccccagaaactcccttagccatatcaacaaggttagcagtcaactctgttatcgctaaccctaaaataaaaggctccagaatactcataaaactagataaaactttcaaaaaaatcgctaagaaaagagtagctttgtagcgagttaggtaagaccataatctcaaaaaaatagatttttttctcatacaatcactctccttctgataagttttggttcttcagttgtgactcagcgatttcacgataaatagcattattttctattaattgagcgtgggtaccacgaccgacaatttcgccttcatcaaggacaataatctgatcagcatccataatcgtacccaccctttgagcaactatcaaaaccgtagaatcaccggttacttcttttagacgcgctcttaaagtagcgtctgtcttataatcgagagcagaaaatgaatcatcaaaaatatataaatctggatctttaacaacagccctagcaatggataaccgttgtttttgacccccagaaagattgctcccaccttcagctaaatgcgtttcaaaggcttcttggtgactctcaataaactctttagcttgagaaatatcaaccgcttgtctaagatcatcaatagtagcatcagcttttccatattttaaattctctcctattgtccctgtaaataaaagagctttttgggggataaatccaatcttttggcgaagtgatttaaggttataatctcttacatcaactccatctactaagatttttccaagtgtcacatcataaaaacgtggaatcaaattaacaagagaagattttcctgaacctgttgaaccaataaaagcaattgtttctccaggcttagctttaaaagaaatatcatgcaaaacgggactctctgtttctcctggataagcgaatgttacattatcaaattctaaatgccctttaagtttcgtatccgtaacaccttcggtattaggattaatagaaatcggcatatccattacctctctaatacgatggctagataccaccatacgaggatacatagtaaaaagattggcaaatagcaaaaatgaaaagagagcatggaagctatattcgataaaagcaactaaatcccctattttaatagcacctctttgtaagggatccaaagcaaaccaaacgatagccacaatcattgcaataataatttgaacgaaaagtggttctgttagccctgttaatttaaaaagaccagttgaagtatctgtgtaacgttggttagcgacttgaaatttttgtgattgaaaattctctcttgcaaaggccctaacaacgcgtaaccctgttaaattttcacgaacatattgattgattttatcaagcatagtctgttgtctttcagataaaggttttgtttttatagctacatataaaataactcctaccaaaagaggcatcgcaaccgctacaagccaagctaaagatggactcgtaattagtatcataaccacgctaaaaatcattaccataggagttactaggcctaaacgtaaagacatttcagcaaattgcatcaaaacaaaagtatcgcttgtcatacgtgtcactagtgaagatacacctatctgttcatattcatgatgggagtattcttgaagcttagcatacatatcattacgcatatctctaatcattgttgtcgttaagcgactagatgcgtaagccatcgtaatacgcccaataatacctagtacaacaaatataaacatgatgaacgtccacagataaactccagtccgatcaccttttgtaacgccattatcaatcatacccgctaaggctgtgggcattcctaggataaccgtcacaaaaagcatagctcctagtaaatcaagccataaccaattggggtaccttttcaaataagaccaaatatatgccatatatgtctccttttctttcctcttatctcaaaataattaatccatgttcactaatccactttcaacttataaatctttaatcatccaaatatccatagctgtatgaccttgatcatttgctattggttgcgataaggcacaatatcccatatgcttataaaccgcagttgccctactcaaagtactggctgtctctaaataaagttgtctatacccaatttttcgagcttctacttcaatcattttcactaaatcagtagcaagccccttaccacggaaacgttctgcaatgtacaccttctgcatctctgcaattagatttttcagcggaccaaagccgccacagccaataatctcatctctctcctcaatgacaaagaatcctgacttctctattttttcgtagtatgaggtcaaatgatctaagtgagggtctgaatatgctgtatcaggtttatctaaatcataggcgcgtaaactttgtcgaattaattgtgcaactgcttggtcatcatttttaataatcggacggataatcatgtgtctaactcactaaggtactcataacggtcatacttttctagaagtgcttcattttttgcatctaattccttttgtaaatcagataaccttgtaaaatcactaccacatgtttgcatatcattttctatacgagtgatagtattttccaatatcataatatcgtcttcaattgtcgcccattcttgtttttcaaagtaagacattcttttacgactttgcttttcacgacttgtcttggtactctcttttttactgataacttcattattttgctcattaaatgctttttcatctaaataatcagtataattaccaaaaaattcacggatatcgttatcttcaaacgcaataattttattagccactttatctaaaaagtaacgatcgtgactaactgtaatcacaggaccaccaaagccttgtaaaaaattttcaagaacagttaatgtagcaatatctaagtcatttgtcggctcatcaagtagtaacacattaggcttttcaatcaggatttttaaaaggtaaagtctttttttctcaccacctgataattttgcaatttgtgttccatgtgtcgaacgtggaaagagaaattgttccaatagttctgtcacacttgttgtaccgacactagttttaacctcatctgcaacctcttgcaaataattaataacacgttttgagccatccatattatgaagttgttgtgaaaagtaacctacacgtatcgtttcaccaatagagacattacccgaatccggctgtaaatcttgaacaattaaattaagtaaggttgactttccaacaccattatctccaacgatgccaatacggtctttattttgaattaacaaattaaagtctttcaagatagatttatctgggtaagaaaaagagacattttcaaaattaataacctttttcccaattcgacttgtttcaaatgtcatttccaaatcgcttgtatcgcttgtttggtgtaaatcgttttttagattttgaaaacgattaatacgagcctgttgtttcgttgcacgagcttgtggctgagtacgcatccaagctagttcctgtttataaagctgtttctttttatgtaaactagcagcatcacgctcgtcttgttctgcacgaagtcggacataatcctgataattgccttgatattctgtaatctgtgccttatctaattcaaaaatacgtgttgcaacattgtctagaaaataacgatcatgagttataaaaagcactgtctttttactatttttcaaaaaattcgttaaccatgcaatagtgtcaatatctaagtggttagtaggttcgtctaagagcaataaatctgcatcatttaataatacttgcgctaattgaacacgtcttcgtaatcctcctgataattcaccaaccgacaactgcaaatcagtaatacctaatttggataatactgttttgacttcgctctcaatagaccaagcatctaaagaatccatttctgccattactttctctagacgtgattgcttactttcttcgtagtgattaagcaataattcatattctttaattaaagccatctctcttaagtcagaagaaagtacggtgtccaaaattgtctgagaatcatcaaagtctggttcttgttttaaataagcaatcttataatcattagctgatgaaaaaggggaacgatcaccatcaaaacctaattcacccgaaataacatctaatagtgttgtctttccagttccattgacaccaataatcccaatacggtctaaactatggatgataaatgaaacattactaaagaccgtcttatcaccaaccgacttagtcaatccatctactaaaaaatcgctcatataatcctctctaatccatcaagtactgcttaacaaaatgtaaaatagcctcttcttcattaatcagttgtcctaaaacaatggctaattcaatttgagagataatatctcccatctgtggaccaggttttattcctaatttcttgattaaggtgccaccattgacaactatctcatgcctatcatggattgctaactcactatctagttgttctattttttcgaaatcaaccatcaagcctcttgctttgcgaataccttccgcttgttttattatagtttttccataacgataaagatgttctttagtcaatcccatttgttcacgaatacgataaacatccactatatgctcaacatctttttgaaagtgagttgatgtcttccatttttttaaaaaagtctttgtgtgttcaacttccatactcaagatgagtgatgcccaagcttgttctgatgtctcaaataaaaaatctttatctaactgggacaaaaaggcgcttaattgtaattccctattttttaagcatggtagataattaaaagcatgactatctattagtgccagcattcctttacgccaataaggtgctaatagaagtttatcaaattcaataaaagaacgctcaacagatattttctccaataatgacgcgtgctttttcattgcctcaaaagttgttgtttcgatatcaaaatttagactagcagaaaaacgcaaaccacgcataattcgaagagcatcttcattaaaacgctcactggcgagtcctactgctctaagaaggtgattatctaaatcatccaatccatgaaagagatcaataacttctccatcttcatttaaagcaaaggcattaactgtgaaatctcgacgttttagatcttcttctagcgacctaacaaaattgacctgactcggacgcctataatcaacataaacctcctcagtcctaaaagtggtaatctcatattcaccacctttttccaatactaagactgttccatgttcaataccaacatcaactgtccttttaaaaatctgctttgtttcttctggataagatgacgttgctatatcaacatcatgaattggacggtcaagtaaaacatcccgaacactaccacctacaaagtatgcttcataaccggctttttttatcttttttaatattggtaaagccttctgaaactcagaaggcaaataatttaatctcatcatactattccaaatctaaacgaactaaagtcgcattattatttcttataaatggattcagaaacaaaaagaactgcctaagggacactccctacctactcaaattatcaaaaaagaatctcctaacttcttctttgatatctgcaataaggatcaacctccaagcaactctttttatcacacatcaatttttgggggtaataccaaaggcaaccgcaccttcaccaagatgagttgcaataacgccaccaaatgatacaatttctaaatcgtctttaagaccagctttagctaacaaattatataattgttctgccttatcttgtgctctagagtgaataatagcaatatcatattcaccatctgctgtcatttctttgacaatctcagccaagcgttttaaggcttttttctctgtacgcactttctcatagacaacgattttaccttcttcattaaaatgtaagaccggcttgatacttaaaaggttaccaatgatagctgaaccgtttgacaatctaccaccttttactagatgattcaaatcattaacaacaataaatccttcaattttttcaatttgtgattgtatcttgttaactatgacatcaaaatccatcccttcacgtgaacacatcaaagcatttctaactaaattgccctgtggtgctgaagttattttagtatccggaaaagcaattgtcaaatttggatgttcttcaataagaaactgaatattctgccagaaacctgatatccccgctgcaatgaataaaccaaggacgtgtgtatacccttctttctccaattgacataagagatcatctagttcagctaagctaggctgacttgttttaggtaattcttttgatgccgctagcttatcataatattggtctaatgtcagattttgtccctcaatataagttttaccatcaatgataattggaatatctaaaacatagacatcttcatgattttcgatagcctcaggcaagtaagctgaggtatccgtaataagtgctaatttcattaactattaaactccaatgttactcctggtctatctaaagcaatttctgtaacttcataagtcagacgtttaacgatttctaaaagaggagctgctagattctcaacttcatcttgactaaactcactaggctcattgataaggcgcccttggatatgagccatttgtgaaatgacaccagaaataacaaactcatcacgtacaataacaaattgtaacactgctacaatgctcgttacttttgctgcttcatctctattagctaattggaaagtaacttcaaaatttgtttttggggtaccattttcctcttcccattctaaattgcgcgcatcatagtggtattgattgacaaattcttgttcacgaatgacttccatgtattttctccttgatagacaatatgtattattatagcataaatttgtagattcttaaagcaggtgggaatctagaacttcttcttaggatgtctatcaatcacttcttgattgttactcaaggctgctaaacctttttctgtaagtgccaaccctctgacaacaaacaacttccctaattcctcttctgtaaaagcaatagctattgcctgatctaaatcagagcgtttcatctttgacaagccttttacgtttttttcttttaagaatagttttaaaagtggagcagataagtgatctaaagaatcaagcggtgactccattcttacaaatccattttttattaaaaattctaggtgttcttttccatttataccataaatgtattcaaaatattttgaaaaacttgtttcagttgtgaaagttccaaactgtatacgccataataagataatatctccaggcaagagtccttcactagtttcttccatatttttcctaggaacaactttactaaaattaatttcagccaagtctctttcaggtgagatataggggatattaggataatttttgtaaatttcttcaatagttttcatagtcatattgtagcaaaaaagcgcttataaaaacaagcgctaaggcatgggggaagtcacctttttgaaaaattcaatttcattttctgatattctaaccatgttaaaattatcatgataacatcaaatacacatagaaaaatcattaaaatgctatgactagaaaaatattcccttagttggaaaatgataaacccaacgaaaactaaaattgataaagggtaagcaaataatttctctttatgtaataaaataagtgctactaatttgataccgccatgaattaatagatagatagcggctaaatgactagccgaatcattaatataactgcttattttcaagaaatgagcagaaataaaaccatgaatcccaccgtgaacttcaccttcagttaaaagaaataggagatgttttatttgtgtaggtttaaaataatataataaaacgccagctactacttgtccgactgcaaatagcgtttttagatacaacataattgaaaaacttgtatcaactagttttgtttctttttcattccatttaatcattgcttacctcctttcctcaatcatattatccatttttttgcttaaataaatcatatcctattgaaaaaagattagcaattattaatgattaatctaccattcttttacaacataaaaaggcgaatagacccaataacgatagtttattcaccttttattcaatgtaaatttggataagttgagattaactattttattttacggaacaagccaaagagtacacctgagactaccgctccaattagaataaatagaatataaagtaaaggattacttgttaatgcgatgacaaaaatccctccatgaggagccatcaacttgataccagctaaaccaacaagtgctccagttaaggctgaacctacaataaagctagggattgcacgagctgggtcagcagcaccaaacggaatagcaccttcagtgataaaagataaccccataacgatatttgttagaccagattgacgttcttcattattaaatttatctttaaataataaagttgccacaaatactgctaacggtggaaccattcctccagccattacagctgccataacaacagagccgccatttgcaacagttgctgcaagagtacctgtaccaaaaacataagctgctttattaacaggcccacccatatctacagccatcataccaccaactagtaagcccatcaagactgctgaactaccagataaaccttgtaagaaagtgttaagagctgtgttgatagctgccattggaatgtttacgagcaacatcaagaaacctgtaatcaaaacacctaacaatgggtatagaagaattgatttaataccttcaagcgattttgggagacctgaaagtaattttctaagtagtaggataactccaccagctaagaaaccacctactaaagcccctaagaaacctgatggcacacctgctaatgctaaggttgctttcccaccttctgcaaaaggtactttaccgaatgccagtccacttgatgcaattgaaccagctacgaagccagctactagtcctggtttttcagctattgaataagcgatataacctgccaatactggtaacataaatgcaaatgctgcgccaccgatatttttgaataaggctgcaatttcatggtatgaacctaaattacttaattggtcttttggtacaccaagtatgttatcaaaaaggaaagcaatcgcaatcataataccaccaccaataacgaatggtaacatttgtgatacaccacccataaggtgtttataaaaagcagagcctaagcctgattttccatcagattcacctgattgtttatcattttgattttttgcatgataggtttgtgccttattatcgagaataatgttaattaagtcttcactttttttaataccatcagctaccggacgtgataccaaaggtttgccatcaaaacgatccatctctacagccttatctgctgcaataataacacccttagcccttgcaatatcacttgaagtcaacttatttcctacaccagaagcgccatttgtttcaactttaatacctacacccatttcagctgcttttttctttaaagcttcttctgccatatacgtgtgggcaattcccgtagtgcaagctgttactgcaacaatataatctgaacctttacttgttgattgtactgtttgtggagctactgtttcttgagaaatgctattactatcaaaagtagcaataatgtcatctggcgtttttgcttgacgtaattgatcagcgaacccttcttttaaaagatatttagatagttctgccaaggcagctaaatgcgtatcattagcaccatctggcgcagcaatcataaagaataaatcagttggctgtccatcaagtgcttcgtaatcaacacctgatgcagattttgcaaaaaggacagtagcttctttaacggcagcatttttactatgtggcatagcgataccatcacctaatccagttgatgtttgtgcctcacgcttcatgataccatctttaaaaatagcaaagtttgtcacaacacctgtgtcaactaattttgtaatcatttcatcaattgcagcctctttactggttgcttttaaatccataatcataacttctttttttagtaggtcttggattttcataatttttctacctcaactttattataaatatcttggataaactcagctgttgctaaatcatctgagaaagtggttgctgtaccacaagctacgccccattttagtgcttctactggattttttgacttaacaaattctcctgtaaagccagctaccattgaatcaccagccccaacggaatttttcacttcacccttaatcggttttgcaaaatatgaagcttctggagttactaacaatgcaccatcccctgccatagaaacgataacattcttagctcctttatctagaatcttatgtgcatatttttcgatatcaggcagaccttctagctctacgccaaaaatatctgctaattcatggttattcggttttactaaaagaggctgataagcaagagcgtctaaaagtgtctgaccttcaaaatcgcaaacaacttccgctcctgtctttttagcaattggaatcaatgtattatagaccttatttccaaggctagctggtgctgaacctgcgaaaactactgtgtcctcaggtgttagtctcgaaagaagtttctctagacgatgaagttgttcatttgttatcctaggacccccgccattgatttcagtttcaatttttgcttttactttaacgttgatacgtgtatcttcattaacagaaacaaagtcagttttgataccttctaatacaagtccatcttcaacaaaatgtcctgtaaatccaccgataaaacctgtagcagtattgtcaatttttaagcgttttaatatgcgactaacattaattcctttaccacctacatatttatcatcgctagtcatacggttaacactacccaacaatagtgtatctagacgaacaataaaatcaatcgatggatttaatgttactgtataaatcatacttgaatcaccttcattttctcttttattattgtcataagttctgaatcagtcttattagttactaaattaatgtcatttatctctttcactttagcaaatgtaacttgtccaattttagatgaatccattagaataaaggtttgttgactattattaataatagcttctttaatagcagcttcttctaaatctggtgtagttaaataaacttcatctataccattcatccccagaaaagctttgtcaaccgttatctgcctaatctgattaatggctacctggccaatactagcatctgttgaatgtttaaccgctcctccgataatgattgtttttatccctctatcaactaactttgcagcatgatgaatagaattcgtcaccaccgttaattgctcgtgagggagaaaatcaattaataattctgtcgtagttccggcatcaataaatataacatcttgctttgctatcagctttgcagtttgtctagcaatatccaattttttttgaacgtttttgatagctttttcttgattacttaattcctggccaagtgagtatggtaattcagcaccaccatgcaccctttttaaaaaacctgcagattcaagttcatctaaatccctgcgaactgtagattcagaagtctctaagatagacgttaattcatctaaagtaacactcttattttgctcaagtcgtgataagataatttcttttctctttgactttagcatagtccctccttgaattgaaatcgtttgcaatttaattatatctctttttctttcaatgtcaagcattttcttccaaaaactatcaataaactaaaaaagcctaatctaaagattagcttttacaaatactttaatttctcttcaaaacctttttaagaagctgaattcctttgtatttaaaaggacttggataatagttaaaagttcccattttacgaatgatacaaccattaaaattctgtttaaagcgaagaatactatctgaaccatcaaaagttccctgaatacctaggaggttatagaaagtagaacctcttttgagagcctcttgcataacatattcctgaagaactgctggtgcataaaatttattaaattctgtgtaggatcctgaaaagaaataaactgtctccttaagactataaacaaatagactaccagctaaaacaacgtcttggttatcatacttttgaataaatgactgaacttcttgtcgtcgtgtttcaaaactagccagttgattaattatttcagagcgttgcctatgatacttaggagagtctgcattttccctaaaacgttcatcaagcaatttaagcttattttccaatgcttcagcttttatttgcaagttatggtcgtattctctaaaatttaaagtggcaatcacaaattcagccttgccttcaaagctatcgtaaaaatcttgataataatctaaggacttatccatataatcacgtctatttgacgtagaagttgttatctctttaaataaatgtagctcatcacgtttaagaacgcgaaccttgattccaaaagacattgctttcttaaccaaagctcgtcctgtcttagagaatgaagatagtaacgtttcagaagtgacaccttctaaatttttaacatagtgccaagataaatatttaccagtaaaaccagttgttaaaccatcatggtgataacctgaactggtaaaatcttcaatcagattatcatttccctgattactaggaactcccgaactagtgaataattggtaatcatcataaggctcaactattaattctagaacaccgttggatttggcatagccttgcaatgctttataaaattgttttagatacttagaatttgaatgaactggtcctgaatcaattttcatttgaaaaccaccagtgactggcataatataagataaactgattatctctagtttattttctacttgatatcccaaatacctaacatcatagccgcgtttttctaaaagtttagccatctcaggtgtttgtaaaaatgattgtgaatcataatttcctgaatgttctttaaattcttctattgttaattctcgaagcgtcataaatacctttcttaactatttcctacttttctccacattctatctattcgatactatccaaataatataattttgacgtaaatctccactgttttttccaacacacataatattagtaaagctaaatctaaaaagatttagctttaaatttcaatatagcgacgaataccggaataactcttgtatgaaatccactgatgaccatctactactaacacttgatcataatgtattttttcacccttttgaaaattaaattccactggacttgatactttaggttgacttttcacatctacagttttagtaaatgtataggtacctgttttaggtaagttgggataactagtcggtttagtcgcctcatctttcgctttttcactacttgtagttagctttttcacaggaatatagcgacgaacaccactataagatttgtaagaaatccactggtaaccatctgctgtcaatacttgatcataatttattttgtcacctttttctaaagtaaattgggtctgacttgatattttagcttcattttttacttcagtacttccgataatattataaacaccagtctttgctaaaccattttcaataggttcttgagaagaattagttccagctactgtcactttagttcctgttacacctacaagtgtcccactagcttcttggtagtataaatgaatattataaagacccttctcattcttatggtcagcaaatgatacagctactttgtagttgccatccccagtagttacagctgtataccatttaatatcatcttgccctccttgttcagtccaaaccggtaccttaacagcagcgataccgttatcatctttaatattcgtaattaaaatatcaaaacctgtagttgtttcgttagaaatagtcagtctaccagttttagtaatacgggcttgtggttgaggagacactttttctttatcttcagttttttctactgaagatgctttacctagcaaaacaaaacgacgaacaccattgaatgatttataagataaccactgatttccttcaatagttagtatttggtcgtaaaaaattctgtctcctttgtccaatgtaaattgagttggactcgctaccttagcttcattttttacttctactttatgtgaaaatgtataatttccttgcgttgctattttctcttgattattgcttcctgaatttgttacaggagtaggtgctttagtctctgaacctcctgatggatctagtgactcaatagctgcgtatcgacgtacgccacaaaaagacttatatgaaatccatttcacattatctttattaaatacttggtcatagaaaactttatcacctttctttgcatagaaagctactggggctgattttgaaggtgtatttttcacctcggtttctttgctataaacataattcccttgttcaggtaatgttttttccaccattggctttgtctctactaaaggagtagtaatgtcctttgttgccgtattttgactatttacaactttatcagacgcttgaacactatcattattggaagtaatcacacttgacgcacttgtctcattggaagaattattagcatccacactagtgcctgtctgattattaacttgaaccgatgtagtttgatccgcaaaaacaggacttgtgaccattatgaatgaccctaaaattactgatgctaaaccaaatttatatttacgtagagagtaagattgcttagtatcatttacttgtccttttttcatcataaacacctacttccttatttatttacactactattataatatcctttttgtaacatgtcaacatattttagaaatatttgtaatacaaatgtaatattttatgctgtaaatacttctcgaaaaaaatacccaactcttattattcttagtataacaaaatcattatcattaagcatatcaaaaaaccgggcactattctcccggttgattattattttatgctaagtacattttctttagtgtgaattaattgtgtgattaatcgacagtaaggtgtatcaatgcctaggttttcaccttttttattcactgcgccatttaagaaatcaatttcagttaagcgctgattttgaactaagtcttgatgcattgaagggtaatgatgggctgctttaacagatgtatccataacgtactttgttatttcttcttcatcaagctctacaccttctgcttttccaacagtaacaaattcatggataatttcatgtaccatatttacgccgtcttcactagcaaagagttgaccaattgtacaatctagcaaggcgcaagttgaattcatcgttccgttaacacaagcttttctccaaatatttggcaaaacattttcgtcataagtagcctgtaattttgcttcattaagcaattcagtaacgcgatgacctgcttcttgattgttaggatcgatactttgaagatttacagaaccaactccttccagatgagcatgccctggtcctttcaaccctgcagtccaaactgttactcccatcaaaatattgtgttcagggatatattgacgaatgacatcttcatgtcctaatccatttaaaagacataagacctttgttttcttaccaataatttttttaatatcttgaagcatatttggcaactgcattgctttagtaaacaaaataattaaatctgcttcttctgtcgcatcagttggcttcatgataggaagtttaacaaggtcctctgtatcacctgttaccttcaagccattttctttaatagccataatatggtctgcccaattatcaagtaaaataacatcatgatttgttttagaaatttgatatccaaaacgacatcccatagcgcctgaaccagcaatataaactaacatacaacctccaaattaattttgaccttcaaaaacgaaaatatcgtctttataaagtttcagaatgtctttacaaattttgtgtgatacaaaacctactgcaaaaggaataacgagccaagataagataacaatcaacatacttgctcctgcttcaaatgaagcaatcggacctactgcaccaacaagcccaaaaccagacgaagctggtgtccccaccaatttaaacaatgggactgttagagaacttactgtagcagtcataagcattggaatcgccattactggatgctttaggaaatttggcatcatcatcttcattgcacctaaagcaatagcaattggaactccagacttattagccttcatcgttgcccaaactagcactgctgttgttgaagcaactcccattgaagctgcacttgctgacataccattaagaccaatcgctagaccaatcgctactgttgaaataggacttacaataagcattgaaaaagccatcgcaattagaattgacatcgcaattggttgtaaagtagtaaaagaattaattccttgaccaataagtgttgtcacatatgaaacgtaagggagtaatttccatcctaaatagcctacgcctgtacctatgataataggtaacaagataatggttagggaaccaaatttattaccaaaccacttaactgctaaaactgctaaagctgctgttagcatcatattgatgagatcaccaatcccacgcaattggaaactaccagtagcaactcctttttgaataacttctgtgtaagcccacgcaccagaaccaatatatgcagcacctccaacagcaagctgttgcattggggtgaatttaaactgttgaccaatcaaaaatcctgccataattggtgtgaaaaattggaatacctgcacgatgtgtaagaactctgcagcaagtccgtaagataaaaatggtttcaaaaaagtggctaggatagcatttgggatgagtgctacaacgattgcagttgctgtcccacctaacactttattgataaaagaaccagccgtctcttttggtgttaccgtatttgtcataaaatacctcgcttcatttatttaatatcattcataacgacaaagttaattatatcacaaaataaataggaagctttgttatttttttaacaatatatataatccttttttataaacttatcagttttatttatagttattttatcaatgatgttgaatggactacacggttatctcgatcaggataaatataattgatagcttggtttatagcgactggtgcttccccatatcctgttgcaatcaattctacctttcctggataattagcagcatctccaatagcatacacgccttcttgagtcgtctcaaaaagtgaagaaacattgatactagaccgtttataatccaaattccaataacgtaaatttttattagaagtagaaaagccaaaactaacaatcaagttgtctaaaggtaattcaattacttcatcacctttaactttttgaacgaccaagctgctaactctctgactatctccatttaaaccaattgggacataaggggttaaaattctaacacctgatgcctttagtatatccacactatgctcatgcgctctaaaagcatctctacgatgaacaatcgctacactagctgcaatcttatctaattcattggcccaatcaacagctgagtcgcctccaccacaaataacaacatgtttacctgcaaactgttctaactttgtaacgttatagaataaattattatctgcataattttcttcattttccaaacctagtaaacgcggagcaaaagcaccgttgccacaagcaaaaacaatagcacgtgacaaatgttgatctttatctgtttgaattgtgaaaacatcatctactttttcaaatgataaaacttcttcttttaaacagatttcaatagaatctttaaatctctctaattgttcaatatgtttatcaattaattcacgtccagtaatcaccggataaccaggaatatcatagatttttttctcaggataaaggatagctggctggcctcctaattccgaaaggctttcaataattttaacggatactccgcgtagtccagcataaaaagcagcaaagagacctactggtccgcctcctacaatagtgatatcataaattgttttgttcatttactgtatctgttctttctatttctgttttaattttctctaagataagtctctcttcatccgtcattgcataattttctaacaagtctggtcgacgttctagtgtttttcgcaaactttgttctaaacgccattttcggatattttcatgatgaccactcatgagaacatcaggaactgtcatgcctaaataatcatatgggcgcgtatactgaggatattctaataggcccgatgaaaatgaatcatcctgatgacttgtttctttacctataacttctggaatcagacgaacggtagcatcgaccattgtcatagccgccaattctcctcccgtaagaacaaaatctcccaaagatacttcgtctgttactaatgattttatacgttcatcataaccttcatagtgaccacaaataaaaattaattcatcttctttggatagttcttctgcaaaatcctgatcaaatgttctgcccgctgggtctagcaaaataacacgtgctttttgagcatctattttatcaattgtatcaaaaataggttgagcacgtaaaagcatcccttgccccccaccgtaaggctcatcatcaacatgtcgagacttctcagcattttctctgaaattgtgataattaatttcaagaagtcctctttcttttgccttaccaactatagaatgttccagaggggcaaacatttcaggaaataaagttaaaatatcaatcttcatcatctaaaccttccatcaattcaacttgaacacgctgattagaaaggtccacttctaatactactggcgggatatagggtaataaaagatcacgttttccatgacgttccacaacccaaacgtcatttgctcctggttgtaaaatttctttgatttttccaatcagctcttccccttcatagacatctaagccaataatttcatgataataaaattcaccatctttaaggtcgctcagttgatcctctgccaccttcagtgtgaaacctttatatttttcaatatcattaatatgatacattcctttgaattttataatgtcaaaattcttctgcttacgatgactagcaatttcaatatccataacaaactgattcttttcatcgaataaagctaacacttgaccttttttaaagcgttcttctacaaagtcagtcacgcttaatacacgcatttcgccttgtaatccttgtgtattgacaatttttccaacgttaaagtattccatagtaactccgatatttttgaaaataaaagaaaaaccagccgctaaaatgcaactggccacgatagtccgtacgggattcgaacccgtgttaccgccgtgaaaaggcggtgtcttaaccccttgaccaacggaccatgtgaaactggggtagctggattcgaaccaacgcatgagggagtcaaagtcccttgccttaccgcttggctataccccaaaagacaaaatctagtatatcgaaattctagattactgtcaatatcttttcgaattaaattttaaatttcgattttatcccttttaataaagctcatatagagtctatcaaagtattttatgtttcatttttgaaatatattcaaaaactttttggtcccttttttcgataatagcttgtaaaagtagttcatggtactgcttattattcatcccaatttctaatatatcttgtatagccacacctgagtcattttttaaagaagatatatagcgtctctcagcaataatgatatctgctttttttagtaatttttcatctatctgagtcgtttgatagtttacaaaaaagaattccgctatcttagatgtaaaatattggtttaacattacttgataggtttgtaatctaatattactagatgaaattacatatacagaaagaggagctaagaaagtctctattaagttagataattgcattgttagtagcactgtctcatgttttgaaaaagttaaattccctcctttaaggttaaaaatatcagccagacctttatctaataggtgatataaatccttagaatagctcagccttgatgtatttaaaaaataaaaatcaggaataaaataataacaataacaaataaaatgtctcaaaaaataggcattaatatctttaaaatgctgcgagtcaataaattctctacccaataatcgaccacaaaaattcttaaaggctttagactttgatatcttataagaagcaaaaataaattcttcgttgatattgatatcatctcgattgctaaatagaggaccatcactaatacaaaacactaaatatagataatcaagtaaaccttcattcaactctataccaagatgtatagcaatactcttttgagctgctttggataactccatgtagagaatagatttttttagttgattaaaggattctgtttgaggaatttctactttatattcttttcttttccaaactaaattcaccaaaatataaaaatagtaatattcttcagataagtctttaaggtcgtagtcacaccctttaaaattcgagtattcaataaaatcccttatcattacctcacttgtagcatcaaaaggataaataataaaaccaaaatgatactgtaacaaagcaatcagcagcctaatctgatattctggacctgtcactttatttttttgtattgataacttaacactctccaaataaagtttacagtttttctttattcggtaggcacttgcgacggatatgaatttcttagccgtgaattcagaaaaactgacattttgaggagcaataaaatatgccaaaaactgtaacgtattagactctcgataaatggtatgcaaagtctctagcttagaaagtgtttcgtaatggaacaataccattgttctacttttgacaacaaggtagaaatcagaataaagtatttgtagttccgaaataagaccttgtaaaatcttttcactcaaagcatattctgttttaaagtgatcaaggttaatttctccatcatcaagtaaggcggtcatcaggtatgctttcagttttattttttcttcgagaaaatcaaatagcaatatcttatcctccttaataaaaaatcagaaaattccctttcacatccattatattctaaaagactaaaaaactcacaatttttgtgtagatataacaaaaaagacaggaagttcctatcttttagaataaattattctttctcatcaatgatgagtcttacttttttcccttgtgttggtaccgaatagacaatcgaccttatcgctgtaattgtacgaccctttttgccgataacacgaccgatgtcttgggtatctaaatcaagatggtactctaaaaattctgggccatcctgaatttttatggttaactgatctggttgtgaaatcaaaggtttcacaatagcaataatgagattttcaatggtatccataagcttttattattttgagaatttttgatcgtggaatttagtcataactccagcttttgaaagaaggttacgaactgtatctgaaggttgtgcaccttttgataaccattcaagaacacgttcttctttgattgtaacttggttttctgcaactaatgggttgtatgttccaacagtttcaataaaacgtccgtcacgtggtgcacgtgaatctgcaacattgatacggtagaaaggtttcttcttagaacccatacgagttaaacggatttttactgccatttttaaatagtctcttttctttttctttatatttggtcgttgatagcttaactaacaactttaccttactaagtataacataaatacaaactctgtcaagaaaaaatcttgacagagtacatgtttttttattcatatcgtaaagcatcaattgggtttaatttgctggctttattagcaggtaataaaccaaatataattccaataaatgctgagaaaattaaactgcctatagccacgttaagtgacacagaaggagtaatcttatcttgcgcattagcaattaacatcgtacctccataggctagtaataacccaattaatccacccaaaatcgttaagaccattgattcaattaaaaattgagctaaaattttacgtcgagttgccccaagggctttacgaaggccaatttctctcgtgcgctcagttacagagactaacataatattcatcactccgataccaccaactaggagagaaattgctgcaatcgctccaataacacctgtcataataccaacttgggtattgatagatttaactatagatgtcatgtcaaaattatcatagtacccatccttagcatgactaatgtctgttaaacgtttgcctatttctttaccaatgcgattggattgcgatacatcattaagatgaaaatatatgttttctgcttctttagcaccaaactccgaagctaactgtgtattggttaaaatagcattcccatcagaattacttccatataagcctgaaccagcttctggatccgaataaacccccactactaagtaagatttattttttacagtcaccaccttatttaacgctgcttcatttgtctggaataatctctgagctaatttttcttctagtaaaataactctcgagaattggttataatcctcctcttggaattgacgaccacttttaattttgaactttttgataccaaggtaagtgcggttaattcctgttatattaaccgtctttgcctttttttcaaggtaagctactggagcatttgtttgattggttacatagtagccactaacaccatctacttccttagcaatcttttttaaccatgattcttgaataattggttccttacggttggtatcactaccttgcatgaaagccccttgagctccaaagttatcctcatttttttggtcttcttttgttttataataaatctgaaggttcttctgagactttgtaatctcatttgtaaccgaatctttcatgcccttacctaaggccataattaacacaactgatgcaaccccaatgatgatccctaacatggtcagaaaagcacgcatcttgtgccctagaatcgatgatagggcaaacttccaattttccataatcgaatctccccttaatcaattctaatactatcagtagtatctgctgtaatttcgccatcacgaataacaattttacgagtcgcataatcggcgatttctggttcatgagttaccatgataatggttttaccttcttgatttaattccgttaggaactgcataatttgctcacccgtctttgtatccaaggcaccagtcggctcatctgctagaataatagatgggctattcaccaaagcacgcgcgattgctacacgttgcttctgtcccccagataattctgttggcagatggttcatacgctctcttaattcaactttatctaaaaattgttttgctaaatttttacgctttttaggaggtacacccgcataaattaagggtaattcaacattttgtaaagccgttagtttagataacaagaaaaattgttgaaagacaaaaccaatttccttatttcgaacttgagctaattttgtttgacttagttcttcgacacgtttaccatttaaactataatctcctgaagttggagaatccaacaagccaataatattcattagtgtggatttccctgaaccagatggccccatgattgcaagaaattcaccttcataaaccgtcaaatcaatgttctttaagacttgaagtttttgatccccattttgataacttttaacaatctgatgcaatctaatcagttcttttcgattagttgtcacgattatttcacctctgatttcttattagagttaagatcgattgattcaatattatcaattttttgcccatccttgaaggttttacttggattagtaaccacgatttgtcctgctttcaaacctgataaaatttcttgtgtcttagcatcagctttaccaattttgacttcaactttggaaattttacgattagaatcattgtatacccaaacaaagtgtttattatctttgtttatcacagaacttgtagggacaataaggtgcttatctccattaactacttcaactgatacggtaaaaccttgttttaatgcatcgagagggctagtaatatctactttatatttataatttacagcactagagccgttattagagtcattgttgtttgcttctgcttctggataatttgagatatatgaaattttaccttcccattccttgtcaggatagaccttagattttattttaacagcctggtcttttttaacattagccaaatcatactcactcatcgttccttgtacttggagtttaccttcagttgctacatggacaagtacttgactagtttttgaagctggatcaatatcactattaacttcaacaactgtccctgatacgtcacttgtaataacagtatcattcaatgctttttgtgctttatttacttctgcctgtgcatctgcataagcatcattcaaatcttgaagttgttggttgtatgaagcattagcttgactttgataattttgctgtagacgattcgtcgcaccactagtcgattgagtcccttgtccttgtgatgatgaagaagattgatcacttgattccatagctggaagacttcctgttgtctttagattattaatctgacgcgctactttatttaattgacgattagcagtgtcgtaggctgcttgtgcagttgttgtatcatattgaactaactgctgaccagctgtgattttatcacccactttaactgtgacagttgctcgattacctttattagcatcaaaatacacatactgttcttgattagccttagcttttcctgtcaaaagagttgaggacgaaacacttccttctctaacattaaaaactttgtagttagtttttactgcactcttattaggttgagattgtacccataaaaagccacctattactacaattagtgccactgagagccctgatataattgctccttttttactaattcctaaattttgtcgtttactcatgtccatctcctgtttgtattattaatatagaacaagtgtattatttttaaataatattgtcaagaaaattctttaaaaataatatttttactcattaagtatactattttgctcatagaaagaacttacaaaattgaaagtactttactttttaccacaaataaaagctgagatatagatctcagcttttattaagaattgctaaatagactgacaagagatagaaaaatttttcatttttgaaaacatgtctgcttgactttctcccaataaatacacttcttccacctcttctatacccataattgttaatatggtctcaatacctatagtgtcaaaaattatagatgtatcatttaattgttctatgaggagaggttgattggtaacaattaataattctaaatgagtttgtttgatttgcttaattaactcatttaattttactagggaataacccttgtctaccattatcaaagccttttgacaaccgctagaaatgtagtctgaatgccaatcatagcttcgaaaatactgaatttgatggccagttagaacaccagaactttgttcgacttgcttcagaacaggtgcgacactatgtttttttcgatattctaacatgtctatcaaagagatttgccaactactagcaatatagtcatccgaaaaaccataccttttagcttccttataaatatctacattatattggcttttattcaggttttcatacaactctacaatatgtaaacatttatctaagtaaaaagggttgattttagtaactgaggataaatcatacaaatcaaagccacgtctaaaagcctccaaaagataagctagacgattttcttttttctgaatcaaagcaaacatcaaatcttcctcgctaatatcactcagaaatggaaaatgatcatgactgctagcctcgagtaaatttaaaaataattgctctatattacgagcaaaaaagatatagtcaactttttcaaaactaaaagatacggtagctacatagtctaattgcggctctaaaaaggcagaggtatttgggtaataagaatgcttcagttgactaaaagtatatcccactgtcaatttagttgctatctctaaaacaggataggtcgtaatagtctcaaataaaatgctttgatgagacaaaccagatgataaactaattatatgataatccaaactgttcaaatctattaagaaactaaagtaacatactccaataatgtttgcttttcgacacacatcaaatgcaacatctcgaattgtttgcctagcagcatcggataaagtttgacttggtacaatcgctagagacttaccagttgttttattagattcaatatattctaaatcagagacatataaacaattattcaaagagtctctcattactaaacaatctacttgcacaaagtcttgattattgtctattgcctgaacacttttttctgataaattatcgctgatatactgccttgaataatgactctgccacgctaaaaactcttgaaatagctcatgatttttatctaagcaaagggggtaaatcaaactatcttcatgtgtatttatataccccacaagcgtctcaagattttcaaattgtgcatcataatggtgaatcacatggtttagctccttcgagataagaatactaacaggtctatcccttttagataacctctcaacagttgatctaattaaatcgtcatattctttcattttctgtccgaaaataataagcaaaataggctgtttatcctttgtatttagcatatacgcacctccttattaatcagctcaccgactgactttaaataataccttatgtttaagcgcgtgatccaatcatttctaaaaattcatcaaaaaaataggtcacatcatgagggcctggagcagcctctgggtaaaattgcacggacatcactggaaatgagcggtgccttagagcaacaatctcttgatcattcaaaccttcgtgtgttaccagtaaatcatgcggaagatttagccggttaacggtaaaatgattaaactgactaactgtttctaaacgacccgtagcaatatctctcatgggataatttggccccttcttagcaactgggagtctcataatttctgcaccatttgccatggcaattaattggtgccccaaaccaatacctaacataggaacagatttttgtaattctttaatagtgtttaagatttcctgaagcttttctggattccccggaccattagataatatgataccttctgggtatagatttttaataccttctaaagacgtattgtagggaatgacagtcacgtcacactgacgtttagacaattctctcaaaatagaatgtttaagaccaaaatcaagtacaacaatatttcgaccgctagcaggcgacggataagctgtttttgtcgaaacttgttccacattatttgtcggtaatactgtcgctattaattgatcctgtaaatgtgataaaacatcacctgcttctgctaaagtagcttttacaaatcctttttctttaataacttgcatcaaataccttgtatcgacccccgacattgcaggaacctttttcattttcaaaaattcatctagattcatcttgctagtatcgctacttacacatctggaatactctgcaacaacaactcctaaacaagtgggaataatggcttcagagtaactgcgatgaataccataatttcctattagcggtgaggtaaaaactaaaatttttccattatgtgaaggattcgttattatttcctgatagccggtattccccgtacaaaaaactaattcgccagttacatcaagagatgaaccaaaggatagtccttcaaaaaccgtaccatcctctagaattaacaatttttttgccattgtggttcttccccttctataaaatcatcgtaaataatagtcgtctacttaactcggatcaataatactcacacgatcgtaaccatcatgttccatcacttcaactagaatttcttcaaattgacttgttggaatatttttccccacataatctgcacgaataggtagttcacgatgcccacggtcaattaatacagctaaactgacacgactcggacgccctaaactaacaagattatcaatagcagctcgaatagtgcgacctgtatagagaacatcatcaattaatataatatctttatcagtgatgtcaactggcatagttgtggtgtcaacttcaactttcatatcatcacggaaaggtttagtatccaattctccaacgggaatatctaaattttctaattgcttcaagcgttcttgaatgcgtttggctaaaaaaacacctcttgttttaatgcctgctaagacaatattatctaaatttttgttacgttctataatttcgtaggtaatacgtgtaatagcacgtttcatggtcacatcatcaataatttcttttcttttcattgcagtatcctctctaagataaaagagccccttcaaaaggagactctctagaatgacaaagccgctcaggcattgatttagtctgaagtttctccttaactatctcactggataaggttaaaggaatgatttgcttatattatagcaaatggtaaaagtatttttcaagaaaaacttaattttttctcaacttttctaaggttgtctgaaaaatttccggaacctctactgaaaaaatcaaattctctccgttactagggtgcgtaaaacctagtgtttgtgcatgcaaaaactgtcctttaccccctaaagtcttacggggaccgtagacaggatcaccggctagaggatggccaatataagccatatgaacccgaatttggtgtgttcgacctgtctccaatgacaattcaactaaggtataatcaccaaaacgttctaaaacatgaaaacgagttattgctggcttacctttagcagtcacggcttgcttcttacgatctttatcgcttctaccaatcggagcctcaatcacacctcgatcatttggtaaattaccatgcacaattgctaaatatttacgaagcgattttttatcttttaactcttcagccaacacttggtgagctctatcattttttgcaaccatcaataaaccagaagtatctttatcaatacgatgaacgatccctgggcgaacaacgccattaattgatgataaatccttaatatgatacatcaaggcgttaactaaggtgcccgaactgtggcctgcagaagggtgaacaaccatcccttgcggcttattaaccacagcaacgtcatcatcttgatagataatatctaaagggatattttcagcttgataatctagtacttcctctttaggaatatcaaaagtaatccgatctccttcttgaacagtatatttcgctttttttacttgtccatttactaacacaatcccttttttaatttcttcattagcttgactacgcgacagttcagaattatccgctaaagctttatctagcctaactcctgctattttaattgtgatttccattactttcctctttccaaagtgcaatcattaagcaaataataccgattgtcagatatgagtctgctacattaaagatagcaaaattaataaaatctaaatgcaccatatcaacgacataacctaatcttaagcgatctataaagtttcctaatccaccagagatgattaaggttagagaaattaataaccaataacttccattaatatgtttcatcaaataaataatagcaacaccaacaacgaagattgtaattaaggtaaaaagccattgttgattttgcaaaatagaaaatgcagcaccataatttctcagataagttagactaacgatatttggaatgaattccttaatttggtttagttcaatatgtttaacaatccataacttagatagttgatctaaagcaatcaacaaaatagttattattggtataataatctttctcattacttctcctatgaattaaatcccttaaaatactcttccataacagcaacaaattttaaagccatctgagataaattacgatcttttcgtttgatataaatcatttggttatctagatgatcttctaatggaataacagtgataccattcacactgcggctatccaagaatcctgagcccgtcgcataagcttgggttctttctaaaataccatttaatgttgctctatcagtaacattataggtaacagaactatcaagtacttccacaaaattctccgagtaataccgataatcatctctatcctgtgtaaaacgtacggttggtaatccttctaaatctgtcattatcagagatgttttactagccaagggatggtctttcccaagataaatatgagttttaaaaggaataagctctacaaactctaaccccaatttgtccaaccgctgaagtagaccttttttattttgactattgatataaatgatacctatttcgctattcccttgagcaacttcatctaagatacgtattgttgttgattcgaaaatacggaaatagctaaaattatcattacattttgaaaacgctgtgattaaaggaggtagaaaatcataatgttgacttgctattgagaattcttgctctgtagcttcagattgcgaaaactgtttttcgaatgaatcaaagcttttcacaacttctaaagcattctcataaaaagtcatgccttgattggtcaacactgcaccagtagttgtacgcgtaaaaatctgaaaccctaattctgtttccaaatcacgaacggcaacagataaacttggctgactaacaaatagttttgcagctgcttcacgaaaagtaccactatttgcgatagcaacaacataacgcagttgttgaatattcattttatcacttcctcattttagtacccttcattataccaaaaaataactatccttgcggaaaattcttcatgaattaggactatttcactataaaagaacaacaaagtttatgagtattaatgataaatctcttaacatattgtcttttgttacaaaatgaaagctctgacaataataaaagaccttatgaatagtcataaagtcttaactaggcattattttgcgattgggtaaacagacacttgttttttatcgcgtcctttacgttcgaaacgaacaacaccttcaactttagcaaaaagtgtatcgtccccaccacgtccaacgttagcacctggatagatgtgtgtaccgcgttgacggtaaagaattgatccacctgatactgtttgtccgtcagctgctttagctccaagacgttttgcttgtgaatcacgtccgtttgatgtagaacctccaccttttttgtgggcgaaaagttgcaagttagcaagattcatttttaacataatgttgtgtcctctcttaaattagtgtgtcatgactactgtactaacaaattcagaagaatctttagacagattagtcattccaagaaggtaagactcaaataataattgaaccttatcctctttatgttgtggtatagaagataaatctatcttcatataaccaccttcaacgtcattgataatcaattgcgcttggcaggttgttaaagcctctaatgaattaataaaattaattgataaagtactaacagctgcacaaatcacatcaaagccgtactcgccactaccagcatgaccgctgatttcagcactataaagatagcctgattgattacgagtaaaagttgctttaatcatgaaaaattaagcgttgattgcgttgataacaacttttgtataaggttgacggtgaccttgtttacggtggctaccttttttaggtttgtatttgtaagaaacaactttcttttgtttgccttgtttttcaacagtaccaacaacagtagctccttcaacaactggagtaccaactttagttgtttcaccaccaacaagaacaacttcgttaaatgtaacttctgctcctgcttcaacgtcaagtttttcaacgtagatagcttgtcctacttcaactttaacttgtttaccaccagttttgatgattgcgtatgtgctcatgatgcacctcctataaaaatttcttgtgaggtttccctctgtgaagactcgcctataaatcgtgagagccttgctctacttaatctaacgattttcgcgcggttgcacaggatgtgcatttagtcaacattcaaattttatcataaactctttttttatgcaagataaaacaaaataaaattatcaactttaccacttcaaattaactaactcattcatctccttatatgctttatcaactttatctttcatagtctgatcaatcgtagaacgtttcttaccaccttcaatataatcctctaaaactagcgtcctataatcataagctggaaagccttcttcaacataacggccatttggttttgcttctactagtgttggatgcgccttaacttttttaattactgttttttgaccttttttctctatggttacatccattaataatcctctttctgtccagatatcatcaaccgtttctaaacgctgatttgaaataaaatttcccatagagtaaataataaattttttctggccatctttttttatcacttcagacggttcaacaacgtgagggtgtcctccgaatataatatctgccccccatttaatcatactatgataaagcattacttgttctgtagtaggttttttttgatattctatccccatctgtggcatgacaatggtgatatctgcttctttttcagcctttttaatatcttgcttaatctttttagtatctaaatcagacatatgtttttcatagtcactctttgaaacattagcttccataccattgtagccatacgaataacctaaaatagcaattttaataccatttacatgcttaattaagatatcttctttatttctatcctttaaataaaccccaatagtatccaatcccagacgattaaaagtcttgacagtattgatagcacctgccagttgtgaatccagaatatgattatgtgctaagtcaacgacatcatatccagtttctttcatagtagttgcaatctcattaggagcattaaataaaggatagcccgctaaaggatattctgaactaatcgtcccttcataatcaccaatcgctaaatcagcgctctcaatccaagattttacctctttaaaataaggagtaaaattataagtgccgtcgggttggcgcgcactggcatatagtacatcgtgcagcaaaatatctccgtttgcaaccacacgtgctgtttttacagtattattatttgcaaccttttgccctttagattgtgctaaatccttagataaccccaaaataaaaatagcaataataacggctacacaaaaaataagtgttttctgataagggattcttgccatacttgcctcctttattcgtattatagcattttttataaccttatgatagcgcaatcattttaataaaaaactacagagtaaatctgtagtttaaaaattcattataataaatcgtcaatcaagtcatcaacatcatcactatctgcttgaggttgaatagtagttaccataatccctgcaactgccctctctacaagaccttctacatccatacgtttctcatactgttctgtattcttaattttagggttagtttttgggcgatctggtgcaaaaatcgtacagcaatcctcaaatggttgaattgaaatatcaaaagtatctattttttgagcaatatcaataatttctagcttatccatcgtgaccacaggacgaataatcggtgttgcagtgacagcattaatagcttgcatactttctaacgtttggcttgccacctgtcctaaactttcaccgttaataataacaagaccatttcggtcctcacgaatacgatctgtaatacgcatcataaacctacgtgttaacgtcatcaagtaggcttcgggagcttttgccttaatttcctcttgaatttctgtgaatggaacttcaataaattgaatattaccaccaaattttgtcaatttacgtgttaaatcatgtgcttttttcaatgcacctgggctagtataaggaggacttgcaaaatggactgcttctatatctacaccacgttttaacgctaggtaacctgctaccggagaatcaatcccaccagacaacatcagcatcccttttccagatgttcctactggtaatcctcctgcacccctaatatcctcatatgaaatataagcagcctcatctcgtatctcgactttaagattgatatctggttgcttcatctgagccttaatatttggcaagactgaaaaaacagcatctcctaaagtatgatttagagcacggctatccaattcaaatgagtggtcactacgttttgcggtaattttaaaagtcatcccatctttataaacggaagtcataatttcctggacagcttttaccaatgtatcaacatttttttctactttaaaagatggagaaaaagcttggataccaaaaatctcttttaaggactctgcaacttcatgataatctgtaccattgagatatacatgtcctctatcacgatctgtttttactgaaacatctggataaatggagagtacatgctccatattattttttaacttattgatgaagcgcatacggtttttcttcttagtagagagttctccataacgaatcataatttctgaatactgcatcttatcctctaactttcttagttttttcataaacttgtttaaaaatagttaaaaattgctctacttgtcccatatcattatcatcatctaagctgatacgtacagcagtttgggctaacttagttgaaattcccattgctataagagttcctgctggtttacctgctttagaagagcaagcgctagttgtcgagataaaaatatcatgtccctcaaaggcatggacaagaacttctcctcggacacccttgataccaaacgtgataatgttaggtgaaaaatcttccttacccgaaaataacgtaatatcctcatatttggctaattcatcatgaataatggttttcattttacttattttaggaatagctactacttccttgtccataaccattcgtaaagctttagcagtagctgcaatccctgcgacattctcagtagttgaacgtaaatcagtttcttgtccaccacctgttagtaatggtgaaatacgttttccttctttaatatatagaaagccaaccccacgaacgccgtgaaatttatgactagaaaaagatgcaaaatcaactcgctcagtcaaataatctttagtcggtatcttacctattgcttgaacagcatcaacatgaaacgatatagtaggtttatctgacaacaagtctgaaatagcttttattggctgaatagaaccaatttcattgtttattgccataattgaaataagaatcgtttctggtttaattaatttgaccagtgcttctacgtctacaaatcctttatcatctactggcgcataatcaatctcaaacccatactctccaagccatttagcagactctttaacagctgggtgttcgatatcagaaacaataatatgatttccaaaatgttgtttctcaaacgcaagacccttaataacccaattatcggcctctgtaccaccagaggtaaagaaaatttcatttgctttaagctcaagtaaactagcaatttgtttacggctagcctctaaaatccgagaagatgttgttcctagctcatgtaaacttgaggggtttccatagattttactagctacttcttgataagtccttaaaacttctggatagggaatagtagttgccgaattatcaaaataaatcataaatctgtccttctaaagtcaatcagtgttattatagcataattttcctactatttatattagtttgtgaacatcccaaaacaatatttatgataattctcataatttatcacaaaactcactacctattacactaacatagcttaataacctaggttgcttatttaaatgttttaaattattttttctttagctttttttaggataaaatcatataatagttgatgtacatttaaggagggcgtcatgtcaaaaggatattcaagacaacagaaaaagtctactaagactaatactgattcaactcaatcacccgctaagcatataaaaacaggtttttctgcacttcaaaaaacaattgcattagtcggtagtgttttaagtattattgttgcctctattactattactaatgcgattaataatcacaaagactctagtaagactgattcttctacttcaaaaaccgtcattataagagaaagtggacaaaattctagtaaccaagtttctactgaaaaagatgagacaagggcatcatccagccaaacactagaaaattcctctgctagtagtactccgagtagcagttcaaattctgctgccaataacgatcaaacatcatctagtactaacaatgatcaaacaaataatactactaccgatacctcaactattgaaaatacaacaacaccttaaaaaagctaggttccctagctttttttgtattctttgatagcgttagcgcattgtaacaaattcctcagatccagttgggtgaatagcaacagtatcatcaaagtctgctttagtagcccccattttgatagcaactgaaaaaccttgaatcatttcatcaataccataaccaacaccatgaagcccaataactttttcctcttttcctagggttatgagcttcatcttaactgcttggcgattagtggtaacagccgtatacatagaggtaaaagttgatgtatagactttgatattatcttctccaaattgctcgatagctgctgcttctgaaagtcctaccgtcccaattacagggtgagtaaaaataactgaaggtacattatggtaatctaatttttcgttatctttatgattaaaaagtctttctgataagcgacgacctgctgcaattgctaccggtgtcaaggcaattttcccattaacatctccaatagcatacacgccatctacagaagtattctcaaattcatctgctttgatataacctttatcatttaaaacaatatcggtattttcaagtcccatgtctacatttggtccacggccgatagcccatattacacgatcaacgacaagcgttttcccattttcagcttcaaaaatcaacttgccaccttcatcgcgtttaagagatttaggtacatggttagcatgtaaagagatacctgatttctccatttcagccataacctcacttgttaccatgtcatcaaatccgcgtagaatatggtcttttctaaatgcaagatgggtttcaacgcctaattcattaaccactccagcaagttccgccgcgatatagcccgccccaacaatcaatatagaatctggtaaggtctcccatccaaaaaaatcatcagaagtctcaccaagttcacttccaataatatcagggtaaagagggtgtccacctgttgcaatagtaatgtgaggagctttatattgctgaccattcacttcaatagtatggttatcaataaaacgagcaaatccatcaatcttttcgactccattacgctcaaaattagcggcatacgactgtctagaccgctgcacgtaagcatcgcgattagcttttagagtagtaaaatcaaaattaagattattgacttcaaaaccataacctgaactatacttatggagtgtctcagaaacttgtgcaccataccacatgattttcttcggtacacaacctaagttaacacaagttccacctacttgtccaccttcaattaacaggacttttgctccatacatggctgccctattagcggtaccactgcctgcactacctccaccaataacgatataatcatattgttttgacattactctctccttgaatcattgatacctatactctatcacaaagtgtttacagtcacaattttctgctacgtagaatgcaaaaccaatataatgtgggcaatactagttcagtagactatcataaattgaaatattataaaagagaaaactcaaggagctctctcttttataatattacatcaagtcctgcatgggtgcaaagacaattttttcgatatcagacatatagacagacaaccgttgttgttggtcaaaataaacttttaaaaggtcattggattcaattttttccccaagtttagacatttcatcttgttcttcttgacttggcatttggccagattgcatcatttcttgaacttttgattgggtagccaaaaagtcttgccaaagcacttgtgcatccgcatcactttcaatagctgattttgcagttaaaactgcttggtattctggtaaagcacgaacagcacgttctaattcatttgctaaatcatatacattagccataagttactcctttttctacttgaacttaccactattttagacttttatacctttttttgcaattgaatactactagttttcatttaaaaatgatcaacataattgcgatatagttttacagcttcttttagttcatacatgttgtctgaagaaaatttttctagcacttctgtcaccaggacggtggctactacagcttccataacgacacctgcagccggaagtgccgtgggatcagaacgttccactgtagctctataaggctcgtgagtatcaatatcaactgacattagtggcttgtaaagcgtaggaattggtttcattactcccctaacgataataggctctccattagtcataccgccttcaaaaccgcctaaattatttgactgacgtatataaccttggtcctttgtccatgatatggagtccattacttgacttccttttaaaaaccctgacttaaaacctagaccaaattcaacacctttaaaagcattgatagatacaactgcttgcgctatcttagcatctaactttctatcccagtgtacataagagcctaaaccaacgggaactcctccaacgatagtttcaaccactcctccgatagtatctccagcctttttcacactgtcaatataatccttgatttcttgttcgaaggatggattgacgatagctacttgcgattgactagataacactttgatttgttgaactgttagcttatcagggacagtaatctccttgccaccaaaaactacaatatggttggcaatttcgataccaatttctttcaagatacgtttagcaatcgcaccaatagctactcgcattgtggtctcacgagccgaagaacgctctaaagcatttctcaaatcatcgaaacggtatttaattccacctactaaatctgcgtgcccaggtctaggatgcttaatacgacgtttttgctttaggcgctcttcaatgtcttcgactgacatgatgtccagccatttgctatgatccttattagttactgtcagtgtaataggtgaacccaaggtttttccatggcgcacaccagaactaatgatcacttgatcagtttcaattttcattcgattcccacgaccataaccaccttggcggcgttttaaatcttcattaatatctttagcagataatttcagtcccgcaggaatcccttcgataatagctgttaaactaggtccatgtgactcaccagcagttaaatatctcatctatttctccaaataatctctcatttcttctaaaggtatttggtggactgttgcactacctaattgaggcagtataacaattttaataaattgtccacttgcttttttatcatgactcaatatgtcaaataagacgtccttatcccattccgcatagtggaccggaaggccaaattttaaacacatattataaatatcttgactgatacctcttggcataagatttttacgctcagccacacgagaaagctggatcattccaattgcaacagcttctccatgcattatttctccatagccagcatgtacttcgatagcatgaccgatagtgtggccaaaattcaaatgcatccttaaccctttatcatattgatcagctaaaacatgctttcgtttaacttgacaagagtgataaataatagctaatgcattatcaaggatactatcaatagtcccatccatctcttctaaaatatgccagagttttatatcatcaatcaagccatatttgatgacttctcccataccttcaactaattcacgattgcccaatgtttttagagtaacaggatctatcagtacaccatcaggttgtgcaaaagtacctaccatatttttagcgaatgaagtgttgactcctgtttttccgccaatggaagaatcaacctgtgctgttaaactagttggaatttgaagaaaatggattccccgcatataagtagaagcaacaaacgctgctaaatctccgacgacgcctccaccaagtgcaatgatcccatcgcttctggtcatatgatgctttgctaaaaaagcataaatacgattagcaacttccaaagttttactagcttcacccgcagcaaaactaaaaacatgtactgtaaaaccttgtttttttaactggttgacaagcgactccccgtataatatttctacgttactatctgtgataatagttatcatttgtttctgccataaatgtgatacccagtcaccagcctcagaaaaacatccttcttcaattttaatatgataagggtgattcggtaagtcaacttcaacctgcattctaatgtcctctcatgtttgttttaataagacaaaaaccctaagcaattgctagggatctcatcagtatatttaacattttgttatctcgtatcagtcagcgtcaagcaatgctttgacacgcttcatctctgaaatagtaatttgtccgggtgcgatagatgaatctaaatatgcaaatgtccaactagatccagttacatcaccagcaaaacgagaaatacgtccaattttactcatagataccgtcgcataaacttgatcaggattaatagtcttgaaaccgcgagtgtaattcataacgtctaagacatcttgttcattctttggcattactgcgattttcacaactcgtggtgctagggctgttaattctgaaaatatctccataatattctccggtgtctcttgaaaattgtgataagacaggactaaatttggaaattctagcatttcttgaaaaacttctttatgtgaaaaatactcaaaatcaatataatctggattgtagatagaattaattttctggattaactcaacatactcagcatcagataagacaatattaccaccttcacgcgttgtacgaagagtaaaaataatttcatgacctgcgaatttctcaaaaatagctggagctacattaataatgtcatcctttggtaaggcatcagctcgccattcaataatatcaacactatcaaattttgataaatctatttcttgagcctcttcaagactgcgaggcattactggtactactattttcattattttacctttattgtaaatacttttaaataattactttgttggtccttatcatttatagtgaaatcttcaggcaactgctgtaagctaatgtaattatgtgaagctttaccaaaccccttttccaattgtttcttaaattgtgatacggttagattagctgcgttagttgatgcaatgatagttccaccaggggttaaaatatctaaagcttgttcaattaatttatagtaatctttagtaaccgaaaaagtttgttttttatttcgagcaaaacttggtggatcaataacaatcacatcatatgatagatgttttcttttggcatacttataatattcaaaaacatccataacgataaatcgatggttatctgtgacaatctgattagcatcaaagtgtgcttttgaaagttcacgcgagcgttttgctaaatcaacagaagttgtctctaatgctcctccaacagctgcagctacagaaaaagccgcagtgtatgaaaacatatttagaacttttttaccttctgatagattagttgctaaggcttttctgacatcatgttggtcaaggaaaatacctgtcattaatccatcattcaaaaagacactatatttgatattattttctaaaatcaaaaatgattcaggagcctcttgaccgtacaaatgagcactttcaaagtctaaacctttgaaacgaattttttcatatgcccctttaatattaggatagacctgcttaaaggctgcaacaatcatttgtcgattagtataaacaaattcattgtaccacgaaaaaagagcatagtcactataaaaatctatagttaggccaccaaagttatctccatcctgattaaacaagcggtaggctgttgtttggctagatttttcaaatttttgacgcttctctctagatttttcgaatagcgatacaaagtaatcatggttaaaatcaaaaacttgtcttgatagtaaccaaccaatacctttattttgtggtgaaagataggccatccctaagaattgatttgactgtgaaaaaagttgaaccaactggttaactaaactggtatcaaaatcttttttttccagtaactgagcacctgatttgatttttctttcaacgacagaattcactttaagtttattcataaacagtattataacaaatttttatcttttttcatactgaattcgacctttctttaccgtatgttacaaaattttatgttataatttaatctgagattttatctttaggaaaaaaattaaaggaagttcctactgtgaaaaaaattaaagattttgctagccgtgcgatcaatacacgactcggctttattttattgttagtagttatatattggttaaagacaatttgggcttaccatactgattttaatttaggtttagaaaattcctatcagttgtttttgaccattataaaccccatccccttaggactcttaatcataggtttggccttatatgttaagcgaaccaaagctttttatattaccgcttttatcacctatgctatcgtaaatatccttctaattgcaaacgcaatctactatagagagttttccgatttcattacagttagcgccgtcttggctagtagtaaaacttcggctggccttggagactctgctcttaatctattgagaatttgggatcttgtctacgttttcgatttcattatccttattttcttatttgcaaccaagaaaatccacttagatgatcgtccatttaataaacgtgctagtttttctatcacagctttgtctggtttactcttttcaattaacttattcttagctgaaattgatcgtccagaactactaagtcgtggtttttcaaacacctatattgttaaagctcttggcttgccatcattttcgatttatagtggtaatcaaacttatcaagcacagaaagaaagaaatggtgccactgcacaagaattagcgactgccaaaaaatatgtagcagagcattatgccaaacccaatccagaatattatggtatcggaaaagggcgaaacgttatcatgattcatttggagagttttcaacaattcttgattgactataaattaaatattgatggtaaagaacatgtggttactccatttattaacagcctttatcattcgaaagagactgtctccttctctaacttcttccatcaagtcaaagctggtaagacatccgatgctgagacactcatggaaaactcactttttggtctaagtagtggttcattcatggttaattatggtggtgaaaatacacaatttgctgctccacatatcttagctcaaaatggaggttacagtagtgcggtcttccacggaaacgtcggaacattttggaatagaaataatgcttacaaacagtggggttatgactacttctttgactctagctacttctcaaaacaaaccaaagataattcattccaatacggtttgaatgataaatatatgtttgctgactctatcaaatatctagagcacatgcaacaaccattttatactaaatttattacagtaagtaaccattacccttacacaagtttgaagggagagtctgacgaagagggattcccacttgcaaagactaacgatgaaacgattaacggttattttgccacagcaaactaccttgatacagctcttaaatcattttttgaatatctaaaagctgctggtgtgtatgataattctattattgtaatgtatggggatcactacggtatttctaatacacgcaatcctagcttagctgaattattaggtaaagaccctgaaacatggtctgaatacgacaacgctatgttacaacgtgttccatatatgattcacattcctggctattcaaaaggttttatcagtaatacatacggtggtgaggtagataatttaccaactttacttcatattctaggaatagatacgtctaaatatactcagttaggacaagacttattatctaaagataataaacaaatggtcgctatgagaacaactggtcagtatattactcctaaatacactaactatagtggacatctctattacactgattcaggacaagaaatcacaaatcctgatgaaacaactaaagctgaaataaaagctattcgagatgctactaataaacaattatctacaagtgattcgattcaaactggagatttactacgatttgatgaaaacaatggtttgaaaactgtagaagttgaaaaattcaattacacacattctcttaaagcactcaaagctaaagaacgtaaattgaaagatcgttcaacaagcatatacagcaaacataacaacaaatcaacagttgatctcttccatgctccaagttacttggaattgcaagatcctaataagacacataaaacatctaaaaaataatccttgccatttaaagtttaatccacacctcaatccaacgattgaggtgctttttatacggaataatactataaaacaataaaaatcaaaaaggaaaattataacaataataaatatatcgaaataaaacaaaaaagtttcattctacatatatagaacgaaacttttcactaaaattataatataggtactttctttctagtaattaaaaaaagttaggcaaacccaacttttttaattcttatttaccaagtttagctttagctgcatctgcaagagctgtgaaagctgctgcatcgttaactgctaaatcagcaagcattttacggttaacttcgatttcagctaatttcaaaccgtgcatcaattgtgaatatgataaaccattcatacgagcagccgcattgatacgagtgatccataatttacggaagtcacgttttttctgacgacggtcacggtatgcatagtagtaagaattcattacttgttcttttgcagtacggaacaagatatgttttgcaccatagtaacctttagctaatttaagtacgcgtttacgacgtttacgtgaaacaactccacctttaacacgagccatttatatttcctccaaataatcctttataatatgtagtaaatgtttacagagaccttattatttaaggcgagtaagcattgctttaatacgtttgaaatctcctgatgaaaccatagtagctttacgaagatgacgacgttgttttttagttttaccgtggaaacggtgtgaagtaaacgcgcggaagcgtttcaatccacctgaacctgtgcgtttaaagcgtttagctgatgcgcggtgtgttttttgttttggcattttaaattctcctcttaaataatactataaagtcgacaattatttcttgtctggaattggtgcaagctgcataaacatttggcgaccatccatcttagctctttgctcaataatagcgatatcttgtgtcgcttcagcaaattccgccaatacctttgctccaatttctttatgagtaatcatacgtcctttgaatcggatagaaactttaactttgttacctttttcaaggaacttacgaccgttacgaagttttgtttcaaaatcccctttatcaataactgggctaagacgaacttccttaacagtaacaacgctttgttttttacgttgttctttttgtttcttttgatactcaaatttgaacttaccatagtccataattttcgcaacaggtggtgtagcttgtggctgaattaaaactaaatcaacattagcatcatctgcaattgcttgagcttcagacaatggtttaatacctaattgttcaccctcgagaccaaccagacgaacttcacgaacgcgaatttcatcgttaatgaatagatcttttttagctatgatcttcacctctttatttttttagagaaaaacgaaagcggacttgataaatcaagcccgcacatataatcttcctagatggaatcttgacatgttgggccagacaacctaagtcgcaaggcgagaagttctcacttctgcttttctcattgcaactagtatatcatgactaattcttcatgtcaattattttttctgctttttcttgaataaaagttacaacaccttcaattgatactcctgtagtatcaaattcaatagcatcttctgctgcctttaatggtgaaacttctcgatggctatctttataatcacgagcagcaatttctgatttcagtgtttcaaaatcactctcaatgcctttttcttgattttctttaaagcgacgctcagctctttcatcaacagaagccactaaaaaaatcttcaattctgcatctggcaaaacaactgttcctatgtcacgaccatccattataatagcaccatctttggctatacgacgctgctggtttactaactcttctcgaatctctgggatagcagaaacccacgagacattgttagtaacatcgttttgacggatagctaaagtaacttcttctgtgccaagaaagactgtctggctgccatcttctgctttaccaaaagaaattggtctttcagctaggagtcctagaattttcgaaacatcttgtgcttcatatccatgctgtaaagccagataagtagcacaacgatacatagcacctgtatcaaggtaagtgtaattcaaatttttagcaataatcttagcgacagtactttttccacttgatgctggtccatcaatagcaatattaattgagttcataatcctccccttaatttacaaccacaggatcgcctggattagcataccaataccctgaggtcatatgactgggattaagttcttgtaaacgagcaactgagatacctgcacgagcagctatggaggctgctccctcacctggttgaactacgattgttccaccgtttactgaagatgatgtcgatgtctcactcgaacttgctacagtactagaagatgttgttgatttatcactagttttagtttttgatgatgacgttgttttcttacttgtagatgcttttttcgttttagaactattaactttttggcttgaagcaccataaaaaccagaagtttcttttgctctgtcttctcctctatttgaagtataaaatactataaataaaatagcaacgacaataacaaagaatgcactcaagaaagcggtaatccaaggagtacttgacaccacacctctactcgttcttgtaattttgtcttttctatgactattgttttccacaacttttttttcccatggttttttcgccatgacttcccccttgttaatcgtatcaataagtattacaataatactatgaaagttgcactaattccagaaaaatgtattgcctgcgggctttgccaaacatattcaaatatttttgattatcaagatgatggtatcgttaaattttccgatacagataacctagaaaaagaaattccaagttctgatcaagatactgttttagcagttaaatcatgtcccaccaaagctcttacgattttgtaagagcttttttatcgtagcgataacattcaaaataatccattttaatcaaattatcgagaagctccacttctcccttaaatgtaggttcaatagctagtgcatctaaaaaatattttttaggccattttcgcatgtaaaaaatacgctcatggttattattaaatttgatagtaacacttgatttagtgacctcaattttagcaatatcttcaattggaaacttagttcgtcttaaaaagttaaaagatacaatcctaagatatccgtcttcttcaataacaaaatagcgatgaaatccaatgcccactaaaacaataaagatggcaaatagaacaaatacctgactcggaatctcagttctttcatatagcagagataaaccaataaaaattggtgcaatggctattgaccaataaataatagcccaagaaagttcaggttgccagtgataacgtatcttcccaaataattttatcatttaaccactccaatctgatatttctttactaatccttagcaacgatgcctaaaataacatcaactgctttttccattgtttgtagactaacgaattcaaagcgtccatgcatgttttcaccacctgcaaaaagattaggagtagggattcccataaaggaaattttagagccatctgtaccaccacgaatcggttctatgattggcttgatgtctaactcttccattacttctttagcaatgttgataggtgtcatgtctttttcaataactttcttcatgttgtaatattgatcgtatagtttaacctttacacgttcagattgtaatgcttcattcatattatcagcgatatcttgagccaagtgcttacgctttaagaaatcaacttcctcaaaatctcgaatgatatatgaacttttagcttgatcaactgttccacttaaatcatataagtgataaaatccttgatagccatctgtttgttcaggacgttcattttctggtaattgactatgaaaatccatagcaagctgtaaagcattaatcatttgattttttgcagttccagggtgaacgtttcgtccttcaaatgtaagctccaaaccagctgcactaaaggtttcatactgtaattctcctagtggtccaccatccactgtataggcaaaatcaacatcaaaatctttaacatcaaatttatctgcacctataccaatttcttcgtctggtccaaagccaactctaatttcacaatgctcaatttctggatgcgaagccaaatattccatagctgtcatgatttctgctataccagacttatcgtctgctcccagtaaggttttaccatctgttgtaatcagtgtttgcccatggtaattatttaaatttggaaaatcttttggacttaaaatgtaacctgagtctccaagttcaatatctccacctttatagtcaacaatttgtggagtaatattttcagcattgaaatcagctgtatccatatgggatataaaacctattttatggcgtaagcggtcgcttgtagcaggtaaggttccaaccaaatacccattagaaggtaaataatgaacatcttttaaaccaattgcttccatttctggttttaaaactgttaaagcaaagtcaacttgactttgagttgttggcgtttgtgtactattaggattacttcttgtatttattttgacgtatgttaaaaatcgttctaaaagcttttcgtaagacatctttcacctcatatttctccatttaattataacataaaaataagctcactatattgtgactaccttaaaatttcacaaataattttggtcgtcaaaaaactaggttaaacaattctgtctaacctagtttttcattagttaaggtgcaactttcggcgtaagtcttgagcacgactaccaatcattttatcaagtagatgggtggccagtgccataaagccatatacccctaaacctattgcaccgataacgataatgtaaactagacttaccagtctactatcgggtacaataaccagattcattaaccatattatcatagaaataataaagctcatcaatagcgttagaataaggactaaagcacttgtacgacgaatagcttggcgtttaaatcctgtaatttcatgtattttcaaatacataagaattactgggatacaaagagctactgtcgttgagaaaagtggtccataggcatggaaaaggaaaatggagggaagttgtaaaataacttttgccaccagaccatataggaagtaaataatagctttacgattttcaaacaatgcttgtagcattggtgctaaaacagtataaatagataaaataattgtttgaataagagatatgacaaaaagtcctaaagcttgtccctgcggtaacccataaaagactgtatacaaaggttttgctaaaataacggatcctgcaacagctggcagtaaaaacattagtaacatttgtagattattaacaaccaaacgagcggcggcttttttatcattcttaacaaaattctctgttaacaatggaataccaactccagcaattgcggtagcaacagcaattagaatcatcgtaactttaccagggttgcttgaaaagtaagcaaacataacccgtaattcttcacttgaataattcgtaaagagcgccatcgtattcccaaatgaaaactgatcaatcagtttgaaaatttgaattgctgcaccagtaataataaaagggattgcttccttaatagtctcaattaggatttctttagtatctaatttaatgtgctttggagttttaccaatcaaggcagatagcatattataacgccataagaaataaagcagcacagctatactagcaaacataccgacaaaggcggcgaatgttgactgtgtcacagcggcaatataatctcctgatcctagacgcataatatagaaagcagttaataacatccatatgacacgtataatctgctcagcgacttgactaatggcatacggttttaaattattaaaaccttgaaaaaaaccacgtaaaacactcattgaaggaaaaactaaaacagctagagttagactacgcaatattggaacgagttcttgccctcctttactaagtgaagcaaatagaggtgaaccaatatacataattaatgcaaaaattccacctaaaatcagcataaactgcaagattttccgaaccagataaatgctcatctcttctttacctaaagtgttatacttagatacctgttttgcaactgctactggaattccaacagttgatatcaaaagaaataaagcatagatttcatatcccatcccaaataaagcatttgcttcggcagcatgctttcccatccaagcataccaagggataatatagatggctcccagcaagcgactaatgaaattccctgctgttaaccaagccgtccctttgaccatttgttcttgctgactaacttttgttgttttttgtgacatggtaaactttctattttcaatattatttagcatttaaaagacaaaaatctcagaaatatcactttattataaacttttaccttagacttgtaaaacgagaacataaagtctaaaataaggagtatgattacaatagataaaattttagaaattttaaaaaatgaccataatttcagagagattttgtttcatgagcattattattataactggacacaaaatgtaacttttaatgccttatcatatgatagtcgtcaaatttcatctgatactttatttttcgctaagggtgctacttttaaaaaagaatatctagattctgcaatcacagcaggcctttctttttacgtttctgagacagattacggcgccgatattccagtgatattagtcaatgatatcaaaaaagccatgagtttgatatctatgtctttctataataacccacaaaacaaacttaaacttctagcttttactggaacaaaaggaaaaacaactgcggcttactttgcttatcatatgttaaaagtaaaccatcgtcctgctatgctctcaactatgaacacaacattagatggtaaatctttctttaaatcacatctcacaacccccgagagtcttgatttatttcggatgatggctacagccgttgagaatcaaatgacacacttaattatggaagtatcaagccaagcatacctaaccaaacgtgtttatggtttaacctttgacgttggcgttttcttaaatattagtcccgatcatattggtcctatcgagcaccctacattcgaagattattttttccacaaacggctcttgatggagaatagcaatgctgttgttgtaaatagtcagatggatcattttaatattgtcaaagaacaggtcgaatatattcctcatgatttctatggagattattctgaaaatgttatcacagaatcaaaggccttttctttccatgtcaaaggaaagttggagaacacctacgatatcaagctgattggaaaattcaatcaagaaaatgctatcgcagctggacttgcttgtctccgacttggtgtttcaattgaagatataaaaaacggaattgcacaaactaccgtccctggccgcatggaagtcctaacacaaaccaacggcgcaaagattttcgttgactatgcccacaacggagacagtttgaagaaattattagctgttgttgaggaacaccaaaaaggggatattatattagtactcggagctcctggtaataaaggtcaaagccgtcgtaaagactttggagatgtcattaatcaacatcctaatctacaagtgatactcactgcagatgatcctaattttgaagatcccttagttatctcacaagaaatagcaagccatattaatcgtccggttactatcatcattgatcgagaagaagcaattgctaatgccagtactcttactaattgcaaactagatgcaattattatcgctggtaaaggagcagatgcttatcaaattatcaaaggaaatcgtgacaattactctggagatttagaagttgcgaaaaaataccttaaacgataaaaaaagctaaacaataatgattattgatactattttgaatcattccaaataattatcattttgttcacatttttcttaattaatgctaaaaaaggcttttgtaagtcttttttctatgttataatgaacttaattttttgctagaaaggttctctatgtctcacataaaagcagaaaacattatcgtatcttacgatcagaaagaaatcatcaataatctttccctcagtatacttaaccaaaaaataacaacgattattggtgccaatggatgtggaaagtctactcttttgaaggctctcacacgcatccataaaataaaagatggtactatcactattgatggtcatgatattgcacatttacccacaaaggaaattgctaagaagattgcacttctcccacaggtgttagaagcaactgaagggataacagtttatgaactaatatcttatggacggttcccacaccaaaaataccttggcaatttgacaaatgacgatcgcagtaaaatccattgggcgatggaaatgactaacgtagcgcaatttgctaatagagatgttgatgacctttcaggaggtcagaggcaaaaagtatggattgctatggctttagcacaagatacagatactatctttttagacgaacctacaacttatcttgacatgaatcatcaattagaagtcttagaattgctcaaaaaacttaatgacgaaacgcaaaaaacaattattatggtcctacacgacctaaacctgtctgcgcgctattctgattatctagttgcaatgaaaaccggtaaaattatctatgaaggtagtcctagtcagatcatgactaaagatattatcaaagatatttttaagattgatgctcatatcattcaggaccctattagtaaacaacctgttttgttatcttatcaattatcaactgatcaaaattaatattatttaggagatgttatcttatgaaaaaaattggaattattgtcctcacactactgaccttctttttggtatcttgcggacaacaaactaaacaagaaagcactaaaacaactatttctaaaatgcctaaaattgaaggcttcacctattatggaaaaattcctgaaaatccgaaaaaagtaattaattttacatattcttacactgggtatttattaaaactaggtgttaatgtttcaagttacagtttagacttagaaaaagatagccccgtttttggtaaacaactgaaagaagctaaaaaattaactgctgatgatacagaagctattgccgcacaaaaacctgatttaatcatggttttcgatcaagatccaaacatcaatactctgaaaaaaattgcaccaactttagttattaaatatggtgcacaaaattatttagatatgatgccagccttggggaaagtattcggtaaagaaaaagaagctaatcagtgggttagccaatggaaaactaaaactctcgctgtcaaaaaagatttacaccatatcttaaagcctaacactacttttactattatggatttttatgataaaaatatctatttatatggtaataattttggacgcggtggagaactaatctatgattcactaggttatgctgccccagaaaaagtcaaaaaagatgtctttaaaaaagggtggtttaccgtttcgcaagaagcaatcggtgattacgttggagattatgcccttgttaatataaacaaaacgactaaaaaagcagcttcatcacttaaagaaagtgatgtctggaagaatttaccagctgtcaaaaaagggcacatcatagaaagtaactacgacgtgttttatttctctgaccctctatctttagaagctcaattaaaatcatttacaaaggctatcaaagaaaatacaaattaaaagaaagctcctcttatgtttaaagcttcaaaaaaactcgttcaaaaaaataagtcaaatcatttttggcttgtttttttcataacacttatactatttcttattggttgttacgccagcttacgatttggtgctatcaatttcaagactagtgatttaataactgttttaaaaaatcccttaaaaaactctaatgctcaggatgttatttttgacattagactaccacgcataattgcagctatcttagtaggtgcagctatgtcacaagcaggtgctattatgcagggagtcactcgaaacgccattgctgatcctggactactaggtattaacgccggagctgggttagcccttgttgtagcatatgcttttttagggagcatgcactatagtacgattctcatagtctgcttactagggtctgtcatttcttgtcttttagtcttcacactctcttatacaaagcaaaagggttaccaccaactacgactcattttagccggagcgatgatctccacactttttacgtctgttggacaagtggttacattatactttaaactcaatcgaactgttatcggttggcaagcaggtggtttatcccaaattaactggaaaatgctaatcataatagcacctatcattattttaggtttacttatttcacaactcctagcacatcaattaactatcttgagccttaatgaatctgtggccaaagcattgggacaaaaaactcaattaatgactgcgtttctattacttattgttttgtttttatcagcttcatcagtcgctttgataggaaccgtttctttcattggattgattattccacattttattaagctttttattcccaaagattatcgtctgttattacctttaataggattttcaggggctactttcatgatctgggtagacttatcatctcgtattataaatcccccttcagagacatcaattagttctataatcagtatcgtagggcttccatgtttcctatggttaattagaaaagggaaaaatctatgattcaaaaaaataaagctccttttgttttaatatcatctgtcattatcctactattattaatactagtatcaatttcacttggctatgctaatacttccgttattgacgttttaaaactaataagtggaaaatctgatgatgccttcctttttatcattactaacattcgtttacctcgtattattgtctgtatctttgggggagcttctttaggaattgctgggttgctattacagacgttaaccaaaaatccactagctgattccggtattcttggtatcaatgctggagctggattagtaatcgctctaaccataggaacatttaatgttagcaatccaactatattatactttttacccctatttgctatgtttggagggttggtaactatttttcttatctatcttatgtcatacagaagaaatcacaatattagccctacacgattaatcgtcactggtatcggaatatctacaattatttcaggcgttatgattttgattattagtcagtctaataatcaaaaaatggatatgatcgttgaatggcttagtggaaaaattacaattagttcctggactaccattatcacttttatcccgattctcattttgttatggggattagcatatagtcgcagtcgccaccttaatattatgaacctaaacgagcagactgctctcgctctaggacttcatttaaaaaaggaaagaatatatactttgatgctgacaagtagcctcgctgctattagcgtcgtcttaattggtaatattacttttataggcttactcgctgggcacttaagtagacgactattaggaaataaccataaaattatactacctagctgtcttcttattggtgctattatcctattggtatcagatactataggtcgtctcctcttagttggtacgggtattcccactggattggttgtatcaataattggtgccccctattttctctggttgatgacaaaagttgactaaaaaagactggacaaacttccagtcttttttatgttaagtaaatctttaaagcttcaacatcaagtttagcatttaaacgataggtagtatcttggtttaagctaatatatccaagtaattctaaagcttggataaaaataactgtacgtttttgcttaacactatccttgcgaagaaatttcaatataaagcttgacatatattttaaagcatattccgaattaacatctcctaaaagttgataaagctttttttgttctcttgaaagtggataaccgttagttagtttatagaaataattagaaagagtcaaagtgtttctttcaaaatctgtctcttctacaaataccaagtgattggttgggttatctaaatttgtcacaaattttcgcttctgtaataactgatagatttgactatcagaatctatgaaaaccaaatcatctaatactaatccatctagcgaactcagaaaaggaagattaaggctgtagcgtttattttggcgaaggatatatccatgattaatatattcttctaacaaacggtcaattttagaatagtctgtaaagtgggactttatttttcttagtgttacatcatcatgtatccaaagatagttaataagctccttaaaaaactcttgtctttctaactttcctggattaaacgttaatatcataaaagcgctcctaaatgtatgactaaaaaaacgggacgcagcccgttttacatgattaattaagcattgtagctttctgtcaattgaggaacaacttgttttttgcgtgatactgccccagcaagaaaagcgtggttattttcaagtgtaaattcaaaagctgcttcaactttagccatatttgaaccgagagctaaaatctctgaatttgaattaacaatgtcagtaatcatcaatacaaaatcagaataaccttctgtgacaattgcttcttgaatagcaacttcaatctcttcttgacgtgctaaaatatcgttaatgtccacagtattaacttgtgcaacacgaacagcttctccatttaattcaaatgttttagcatcaatatcaatcaactccgctgcagtcttacttgagaggttagtacctgctttaagcatttctaaaccatattcttctaagtttacacctgcaagctctgctagttcttttgcaactggaatatctgaagcatgagttgttggtgatttcaaaagaagagtatctgaaatcaaacctgataataataaaccagccaactctttgggtactgatactccattttccttaaacatacggtaaacaatcgatgatgctgagccaactggttccaaacgcatatataacggattggcagtctcaaagttagcaacacgatgatgatcaacaacaccataaactgtcacatctttaatatcagaaatagattgttggaattcgttatggtcagttaaaatgactgtctctacaccctctgcttttgcagattctactactcgaggtgcttgaacaccaaaataatctaaaacatatgctgtttcttcatttggagttcctaaagcaacggcctctgtgtcaagcccccaagcttctttagctagatatgcaaaagcaactgatgatccaatagcatctgaatctggattttggtgaccaaagactaaaattttagacatgtttttacctcttcttttatattcaccttattgtagcaaaaattgaataacttagcaaaaaatcttactaggaagccctttgcaactaaaaaagttgaataaaattcaacttaaaactaattttgaatcctttttagatattctgtataggattctgttttcatgatatctttagcgtttttaacacgttctggagttggtggtttcacaccagctaatggatacggaattcctaattcacgccatttgaactctcccatagtatgataaggcaatacttcaaatttatcgacattatcaagtgtttggacaaattcacccaaacgttttaaatggtcatcaatatcagtcaatccaggaactaaaacatgacgaatccataccggagtacctctatcagataaatatctagcaaactgtaaaatatttttgttagactgacgagttacaattttatgttgttctgaatcaatttcttttaagtcaaggagtaccaaatcagtaacatctaacaatttttcaaggatagcatggtattctggtgttgctcgataagcaaaaccacaagtatctagcgtcgtatgaatacctagtttcttagcctcaataaagagggctgtaataaagtcaatttgcagcattgcttcaccacctgaaactgtgatacctccatcttttccccaaaaatgtttataacggagagcttcctttagaacatcctcaacggtacgttcctttgaattgttagtttccatttcccaagtatcaggattatgacagtattgacaacgcattttacatccttgcataaaaatgataaaacgaatacctggcccatccacagagccgaaactttctgtagaatggatcattcctgttacttttttatagtctatttctgccatttcatcaccttgtaaccgtttttatgactttattatatcattttcatgaaaaaaagactaagtaatcttagtctttttcaatattctgttctatatcagacaatagcaccttcaattttgttatacgaccatctttaactttatcattaatcaaagtgatgtgtttatctttgctgtctacttcgtaagctactttttcctcttggtttggaatactacccacaccagttaaataataacccgcaattgtatcaacatcatcactttctaactctgtctcaaaataatcattaaattcattaagcgtcatagttcctagaacaatatagatattctcatcgatttccctgacaaattgttcagctgtatctgtttcatcatcaatttcgccgacaatttcttccaataaatcctctagagttactaaaccagcaacgccaccatattcatctagtaaaatggccatttgattttgagtgttgcgtaatgcttttaaaaggtcatctacaaaaatcgtttctggaacaaaaagaggttcctgaagtatttttcgcaagtcgatagtatcaaaaccagttttaaagcccgcttccaataagcgcttggtatgtaaaacaccaacaactctatctttatcgtcatcaaaaacagggacacgagaaaagttttgtgataaaattccttcaatatttgattgtgcatcattgttgatgtcaatcatgaaagcatcagtgcgcggaaccataacttcacgcgccatcatttcatctagcgagaaaatcccttgcagcatctcaatttcttcagcttccaaagtttcttcactattcgtcaacatatattcaatttcatcacgtgtcatcttctcgtcagcatcatcaaaagtcatcggagtgattctactcaataagttagttgaagctgagagcaaccatacaaaggggcttacgattttccctagaaagataataatgggagctgaaacaattgctagacgatctttcaaattcatagcaatacgcttaggatataattctcctagaacaatagagacatatgttaaaaagattagcgcaataatactccctgctgtacgggctgttgctgaatttcctagccaccctgaaatcacatgtcctagtgaggcagataaactagccccttgcaaaaggctaataaaagtaataccaacttgaattgttgataaaaaattattgggattttcaagaacgtccaaaagacgtcgataccttttgtccccttcttcagctttctgttctactttagagcggtttagcgatactaaagccatttcagatgctgaaaagaaggcgttaaatagggttaatattaataaaataacaaattgtagtaacaaactctgactgccagggtcttgcatggaaaattactcctaaataaaaattatttgaatttagctgatagcgattaactctaccaactgttcttctattagataatgctatcattatatcatataatagcactgagcgcatagtcgataatattgtttatggcattttatagaaattatcattttagctaattgcctaaagatagttacacctcattttcatatgattgtaacttttctaccataattaaaaagggaggcgtattaacttgattgagtggttgataaagcattgtagcgaaattattctgtggtaattgttccacgaatgctatcaccgcatctttctcactttttccaccatcatgaccataataaaccataagtgatagacgtccacctacttctaaaatgtctaaaacgtttttgattgccttgatagttgtgtgtggttttgtaataactgttttatccgctgagggtaagtatcccagattaaatatagccgctcttaaaggtgtatgaacatattgttccaaattttcatgcccatccaagataagttcagcgttagagatcccttgctccgtgagctttgctttcgtttttgctattgcttcttcttgaatatcaaatgcataaacttttttagaacttttcgctaaaaaaacagtatcattcccatttcccatagttgcatcaagcgttattgcttctttatcaataacttctgctaaaaaatcatgagaaagatgaattggtcttttaatcatgttttacctcagctttacatccttgatatgactgtcttttctccatttctttgtcaatggcattaagcacttcccatttattaaggctccacatcggtccaattaacatatgacgtggcgcatcaccagtaattcggtgaataacaatatgttttggaataatctccagttggtcacaaataatcgaaatatagtcttcttgacttaacaaacgtaaacgaccttcatggtaatctctctgcattcttgtattagtcataagatgcagaaggtgtaattttataccctgaatatcattatccgtaacacatcgacgaacattttccaccatcatatcatgtgtctcccctggaaggccatttattaggtgagaaacgatttctactttaggagctaattctcgtattctcttaacagtttttttgtaaaggtcatatgaatgtgctctatttattaatgcagaagttgcttcataagttgtctgaaggcctaattctaaagtcacatgcattctttcagaaagttcagcgagatagtatatagtttcatcaggtaagcaatccggccttgttccgatgttgattccgataactcctggctcattaatagcctgttcgtaacgctctttaattatctctaacttagcatgggtattggtaaaattttgaaaatagactaagtatttattaacctcaggccactttctatgcatgaaatcaatttctttatagaattgttcacgaataggagcttctggagcaactatagcatcccctgaaccagaaactgtgcaaaaagtgcaccctcctctagcaactgttccgtctctgttaggacagtcaaaaccagcatctataggtaatttaaatattttttctccaaagagttctcgataataatcattaatcgcacgataacgttttttcataggataattgtatcacaattttaactaaaataacctcactactacaataaaactaaaaaagattggaacgtcagttagtcccaatcttttatttacttcactttctttaaccaatccttggctaaaaagatatacgcagttagattcaaaataccataagcaagtataaaaccagctaaaacatctgtcggaaaatgaacccctaggtaaatacgagataacccaattaaaaaaatgagcaaacccaaagtaccttggcacaacagtttccatatactcttaggcatatagtactgcaataaaataataatactcccaaatatcataaatgttcccatcgagtgcccactgggaaacgaatagccacctgcaaatactaaatgggttaaagttggtcttactctttgaaaaataagttttaaagaaagtatacatataccagagataatagcatttactgcgataaatctagcttgaggataccacttcttaaggtaacagaaagtgacgctcataatcgcaatagctatctggcttacagtattaccaatcacagtgattaacttgaaaaatcttgtagaaagatttggcaactgtcctctaacactttcttgaatagtttggtcaaatgaaattacagtgtcgggccaatatttgatgaccaatcctaaactgaaaaataagataatagcaataaatgcttgaataagtttactattttgacgagataacattagtctttttatatctttctaatattggcaaacaagccacgtaagttagatagaaaacaatcgaaattaaaattccctcaacgatattaaatggaataaccattgttaaaaggtaattgcctacaccaataaatgttctgatatcaaagttagcaaatatagcatacaaaggaatcgcaaagacatagttgagagctaccatagatacggtcaagctaactgtaccaaatagactagctttaataaaatcttttgcactctctctatttttccagaaaatagcgaaacttgctaaaaataaagctagagcaaccatattcatcggtaaaccaataaacgtttctggaccacgattagcaagtataacttttaaaagtgatcttaataagagtacaccataacttgatttcaaatcaaataaaataaaagcaactaacatcggaaggattgaaaaatcaacctttaaaaattctgctcctggtattaatggaaatgaaaccatcatcaatacaaaagataaggcagaaagaatggcgattgtcaccattttacgtgtatttgtcataaaaaaattcctccaatttaaataaattgaaagaagctccaaaggtaagcgtatgtacgcgaaaaaacctttgtcttctcccatccagactttactgtcggttgtggaatctcaccacatcagctttcgctcgcggactgatgcttcacaactgacaaataagttggaagcgattaccgccggtcgggaattacaccctgccctgaagacacctatagcataacaaaaaaaacttgcaattgcaagttttttaattactaattagtagtagtgattaaaaatcatattaataccaaattactatactgtatcgtttctttcagatttgctatttttagtttttcttaaaaagataaacaaaattcccaaaataatacaaccaagaattgtcagtcctccaccaataatcattcctgttttaggaagaaatgattgtggaaaaagcggttgtgatggtttaggatttgttggtggaggagtttctttttcgttttctacctctacttcctgtgttttattagcaactacagcaactacagcatccttcatagatatacggtaaccagttagtgcttttgcttctcgaaaaatatacttaccaggtaataaaccttcaacctcaatttctcccttatcatcagttactaatgaagtaatcccatcttgatcggtcgtaaatcgtccatttttaaagcgaactggctgattctggttatcgtataatacaaatattactccggatagccttttctttatctttccttcttttgtatatttaataagttttaatcggcctgtttcaacttttcgcttaggatttatctgtaattgatttgataacttatcatctggtaattcaatataaaaaggtactattgttgaaacgctttgatcagctttataagcacgaccaaagtacgaaccatttgggagtgctatctttgtctgaccattagtatcagtaggagaagtcaagatactcttatacttctggttcaattcgctatctgtcatttggctcaataaatcaacttttaagttgtcagtcacagtccataaacgataagaaatcccctcctctgtagtatttggctgaagtcctatctgtgtgattgttagttgattaggggtatcagcatttacactggctaccgaaaaaaacgctaattgtaccaatcctaaaaagcaacatagtagaagtcctaaactttttctaatctttttcatttttgatttccctttctctttctctctttaaattttcgttttaaatataatagtaaagcgactaatataagaataactaggattgataagaggaaataaagtttatagtgtgtttgcaattctttcattaaatagttcttttctttaacaggaggtacatacttgattcgatgccctctaactagtaaacgatgtgaattaatcgaataaggtgtacatgttagcaaagtcgcataatccttacctttaacaaccaataatttagaaaaattatctggctttacaacacttatttgatcaaccttataggctaaaacttctttgatattatgaatataaaaaatttttccttttttaagtttatctaaatctgtaaataacttagctttaggtaagccgcgatgagctgtgataacagtatgtgaactttttccaccaattggcaaggaggttccttcaaggtgtcctgctcctttttcaagaacactactggtagtccccgcatagataggtaatttttgcttgatagacggtatatcaatatatccaatcatttcagcaatctcaagcatgtgggcgtattcagcaataccttttttttctttttcagtatagggatctgataggcggcttgggtccagtgttctattataagcttttgctaactcaaatcgtctattaatctctttagtatttaatttttgggtttgattatcaaagttagttacttgattattagctttaatattatagtaccaatttgaaataaaaggatatgaggttatcaaaagaccaactaagaacaatagtatcaagcctacattcatccatcgatttaaaacgaccgatttcttaaggtttttctgaaattttcctcccattatgattcaattccttttctaacacttgctaaacgatttttttgacgttgacgttttattaaccaaagtaaccaagcaataataactaaagatatatagaatagatatctataaatcgtgtttaaatgaccgtcttttattaatttttcatcaataggacctttataagggatacgatgtccccttactaaaagtctgtgtgtattgatcataatcggggtgcaagtcaataaggttgcataatcatgtccaggaacaaccaacaaatctgaaaagttatcgggtgtaacgacttttatctgatctacttgatatgctatcgtttcttttatgttttgaatataaaacttatctcctttttttaactttttaaggttagaaaagagttctttatctggaattcctgaatgcgctgttataacagtatgtgtactattgcccccaattggaagagaggtaccttctaaatgccctgctcctttagatagaacttcttgacttgaacctgcaaatatagggagtttttgacctatcttaggaactgaaattgttccgattttttcacttacctctaacatacgggcgtactctgctacccccttttgaattcgttttttctcataaggatcttcaagatggacattatttaaagaatcattataagcttgtgctagagccatacgtcgattgatttctttctgactaagttttttagcagctctctcaaaatcctgtgtttgattattagattctatcgtatagtaaaaacgtgataccactggatacaataaaatagatagacctattagaaaaagaatgataaaaggaagatttgacttcttctttttttttgtttttttgatgatttttttagtcttcacgtcatctcctagataatggctcttgcttatgatctaagagtacttctactgaaatacccttagatcataagcacagctttaactgcgcttatacatcatcaaagactagccttaagcttcctttgattggcgtcttttcatgataactactgctccaagcataatgcttaaaccaataattgtgaaaagaattgtaccaataccacctgtttgtgggattgttacctttttattttctacacgtgtcgcatctttttggttgctgttagcaacgtagtcaatgttaccacctgttatgtatgacccttgattaactacaaacttaatattacctgccaacttagcaaatcctgctggagcaagtgtttcttcaaggttgtaagtaccgtctgcaagacctgtaacttcaaattgaccttgatcgtttgaagtgtaggtaatggctctagccttatctgttatccactcataagctgtacgagcctcaatgaaggctgcatcgtaatctgcttgtttagttttgataagttcttttgcagtaattcctttttcacctttttggtctgttgcagacaacttgttataagcagcgatagcttcatctaaagctattttcttagcagctaaagttttttgaccttctgattgatctgctttaagagcaaggtatttacctgctgagtttttcacaacgaattgtgcaccagccaaacggtcaccttgttcattagttttgacaaatttcttaccatgagtttcaacttttggttcagttgggttcaatggtgttgggttatcagaatctttggtattggtaatggttactttaccattttctagatttattgcacttccgtaaccagaaacacgttctgagatcatgtatgatttgttttctagaccagtgaatttacccgagaagttaccagatacttcaaatttgataccatttccaaggtcgattgtacctttagatgtttttgtcaatgatactgaagcaacagttttatctttatctttcaatgtgtaaacaacgtttacaccatcaggtgcaattccgtcagaccaagttttagcaactgttacttcaccctttgaaggtgtaacaggaagttcagtcaagtctttacctggtttgttaccatacgacaatttgatatcattggattctggattatcaataattgcttgaccattaacagtagcactataagtcaatgtaaattcaatatcagctgttttagctgctttttccaatttgcccaatccatcagctgtgaattttaatgtgaaaccacgggcatcaatgctaagttcatagtctgtatccttagcaaaagtttctgtagttcctgaagctttaaggctaacagttgaacccattgtcaaaccatttgacattatatctgtccaaaccaagttttcgtatttagaacctttgtgaatttttgttttaacttcataaggaacaactttaccgatttcagcagtagcagttgctttgtcacgtgcataattaccataatttgcgccagctgtcaaaagtctattaacatctgtcaatgctgtcaaatcgtttgttttagcaaagtttttatcaatttctggtttttcttcagtgttctttggataaacatgggcatcagcaacaacaccatcttcatttaccaatggaagagtgatgttaactggaaccgcttttgaagcagccaggagggaaccattattgttgtaagtagattttgatttaacttcaacaattttaaactcgcctttcaatcctttggtgttgaaaacaagtccagtatctccctctggtgtcaatccagacacggcctcatcaatatttactgttatttcaggagtaccatctttattaattaaggctggtgttaatttgttaccttcttttgccttaacatattgcactttaccacttttatcttctttcaaagctaaagcaaagaacgcaccttcgatttctttagatccctcgccaaagtaaccagcaaggtcagaaatagctccacctttgtagtcttttccgttaagacctgtagttcctgggaagttacttttgttaagatttgattcggtttgcaaaatcttgtgcaaagtcactgtattagttgttgcttcatccgcaaacgctggtgcaactgagagcaatgacgttaaagtcagtaacaatgccgagaacattgcaaaatatttgttgattcttttcatttctatctccttcttattttagttaatcaacatgattaataatatgcggattttaatacaccgcagcaccactcccttcaagtcatggaattttagttaattaattaagaatactaaagcgcataatttttaatcttttttgatggacatatcactagatttcttataccttttccaaatataaattccacctgcaatagacatcatagctccacctattaaaatgaaagatagaattcctttcccacctgtcataggaataattccttttggtggaatatgcgtgttggtaattaaatgcttgtcaccttcctcatgatattcagaaatctgtttattaacagctattatattttttatcgatcctttaaccacttcaaaagttaaaattggtttattagtaattttttgataatcctccggcgaaactgcttctattaactgatatttgccatctttcaaatctttgtaagaaattttgccgttttctcccgtcactacttttgaattattattttttattggtaaataaagtttataatcttcattaaattcttgaagttcaaacgtagctcctttgagaagcaacttattattatctttatcaacttttataaattcaatttcacctaacttcttctcgtttttaatcgttattgtaggatattctctcacatcacgaattttagggattggaaaatctctaagtgtattaggatcctctgacttaggattcaatgttgttctaccattagtgtcatagaatttgttacttataaaactgtcatctagtttcacatcatatgtgagtgttactttttgaccttctcctaaattcaaacctctaacatagagtttatttccgatgtattctaatttaacccccttaagtattccaccatcattattaggcccaccagttgcaataccatccttcattacacttccatcatttccctgtaaagtataatcacttggctgtaatgtttgtccattaccaagctgtaaattgattttatcacccataggatcttcgatagttccattaacaattgagttttcttttgttaaaatcgtttcaaattgttgctgaattttagataaaatttcattgttagatgtatcggctgaagttacgataggggtgtagtactcaggtttggaagagaacgacctcattagttctgtgatttctccatctgaaagtttaaaagcttcctctttcaatttttgaaaagtaccatcttgatttttcttatactcctcattataaacttgtctaaaaccagatatatcgataccaaaattaaaaatgtcataatttttctgttttaaactatttatataaagtttggttggtgttccatgttctttcactggtccatttcgataaattgtacctttagggtaattaagatttaaatctaaataatgaagtttttgtaagtttccagagattatctgtgtttgataactatctaagggaaacaaaaagtaactctccccatttccttttatatcctcgggcttatcagtaagtagaaaattacttttatttagatatccattttttttcatttgttcaaattggctttcatatgatgcacccagtttaaaattattaatagcatatgatctcgtaggaacaccatcagttacatgaacaataattttttgactatttcgatttacttgactcaaaatatcatctgcctccatgaaggctttcatagtaaatgtttctcctactttactaagatagtactccttttgttgctctggagttaatccattggtagtagatccccacttagctttaggagcttctgtcggaatcctttttataatctcttcagcattatttgttaattgtttatgactataattctctgtctgaattgtgaacttagtttgaaggccataatatttatcatcttctttaaatccttttacgacatctacactcctaccatcaaaaatatctgaaccataggtaactaatgcaaccctattatcactgtttgctcctaaaatatcttttactgcggtcccaagagcttcggcagctttcttggctttattatgcctttgaaaatttgggccatcgttattcattgagttagaattatcgagtacgaagacaacatctaacggcttttgtttgtccactggttttactatggtttttccactgacagttaactcaattttatatttattatgagctaaatcacctacttctgaaatacgtttagataatgttccctctggaatttctcttatatgctcaccttcacttgaatatgggttaactgcttttgcctctgactttccatttggaactgaacctttaacatgctcaagtttataagattcctttgtatcttcataaattcctgtggggggatactgcttatctagttcttcctgattttgtccaattgtggaatttttatcaccactattttgtatcgtagtttttccattactctcaaccttaacttgccaagtctggttagtctttttataaccttcgggcgctgtttcttctgataaagtataatctccaggtatgagattatcaaaagtagcttcacctgttagctcagcagttactttttctattttactttctggatgagcagtagtttttaaaacaaaggtagcttttgaaagtggtttgttctggtcatctgtctttttaacaactaactttcctttagcaccattttccggtacggtactttcccctaaaacattggtattaagcggtatttgcgacaaacaaaaaagacttaacgtcaatattttagaaaatttttggtattttctcattttacaactcctattgtgccgaaatgtcgtttctaaatctaagatcagatacagaatatcctagaatatacaaactatcacttattatgatatcaataatttcttattataaggtatggaattttaatgttttttcccaatttttgaataatttttctttttatttgataatcttattttttattatcttagaaatatttcaatgagcttaagtagttgatttttctttttttatgttttaaaatattgcttaaaaataatgtttgagagagtttactgaattgattgaaaattatttagaaaaagacatccttaatcaaataaaacttctaactttatgctatgattactacccttccattactctagacaaatcatgtcatcaacttggtttatctgaactacttattaggaaatattgtcatgatttaacaactttatttaacagtcaactctctctgaatatcgaaaagagtacaatagtctaccaatctaatggtgtaactagagaacaagctttcaaatatatttatcatcaatcacacgttttacaacttttaaaatttttgatcacgaatgattcaggcaggttacctttaacttactttagtgaaaaatttggactatcttgtgcaactgcttatcgcatacgaaaacatattagtccattactagaaaaacttggatttcagattgtcaaaaatactattaccggtgacgagtatcgaattcgctatttaatcgcatttttaaatgctcaatttggtatagaagtttatcccatgtctaagatggataaattgctcatcaaacgattgttattagaacactcaactacttttactgcttctcattacttcccaaatacatttattttctttgatacattgttgtctctatcatggaaacgtattaattataatgtagttgtcccttactcatcccttttcactgaactacaaaatatatttatctatgatacattacaatattgtgtcaaaaatgttattatagattcctttaaaattaatttaaaaaaagacgatatagactatatttttcttgcttaccttacttcccataactctttttctaatccaaattggactgagaagcgtatcgataatgtaatagctattttcgaaaattatcccaaattccaaaaattattacagccactcaaagatgctcttcccttatctggctcctatcatgatgagttggtaaaagttgctatctttttttccgaacatttattttaggattaaatcaattaatccctgaaacaatttcatttccttcatggaactatcatagacatgataaattaactactattctccgaccgataattacaaattggttaagtaaaattggagaatacacgtttaaagaacaacattttcttctcctttgtactcatctagaaagaatcatcaaaaatcatattcctccgatacagatagccgtactaactacagactttattaataaccaaattttaacagaatgcttattacagagattttcttctaaaaagattcatttccacccttactatttattaactgatgatctttccaatattactaatcttaatccagacattattattaccaataaaaagctttctccctttatcaaacatgagatttcttcagagagtttaattacatatattgatctgattaatacttcagaccaaatcaatcaaatccaaaaaattatttcatcaatacaggaagaaaaatattgcaaactttttgcaaaaactaatgaaataactaatcgtagctcctataactcttaaaaattaacattaaaaagctagagcattgtgtaatgctctagctttttaatgttaatttttttgaataatataatccaacttttcaactgttttttcccatgtgaaatgttctttaattcttttagcaatattctgttgtagtttctctcttaatgccttatcttttactaataaatcaagagattcatggagtgactgagtattttcttccatgatgattcctaactcagggctatcaataacttcaactgttccaccgcgatctgttgcaataatagcacttgaaagtagaccagcttctaaaatagaggttggtaatccctctggatacattgaagggtaaacaaagatatcagtctgtgccattaaagacatagtctgttcaaagtttaatttccccaaaaagttaatctgtttggactgatatttctctttcaaatgtgctaattcaggtccgtctcctgcaatctgtaaataaacattttcagagtactgtgacatcgaaaatgcttctaagagcaattcaatgcctttttctttaataattctaccagcataagtgatgaaaatatcatcagcagatttttcaaggtaagccgtaccagcaaaatcagagcctagactttcagataccgaattataaataactcctttagcttctatattaaaatgttttaaccattcaacgcttctcttggataccgcataaaaatctggacgataatgcttaacacgcgctgtgagaagatgttcatagatagctccaaagaaatctaaaaaacgattattgacagaaaaatgacttgacccatggtctaaaacaatactaggtaaatggtgattctttgcaaaagatagcccttctagcgttgttaactgaaaacgtgtattacaaatcacaaaatcaatattttcatctgaaacatatttcatcagcgtgttgtattctcgatttttgttaataataggatagcgctgcttgacaatatttttggtcggtaaacggtaaatttttctacccttgtcttcatctataatcggtaaatcaccatgattagttgttacaataacaacacggtagccacgcttaaccaaatctgctgtcattttatctgtataacgttcaatacctccgaggaagggtagataatatcctgagaaaacagcaactgtttttaccttattttccatatttatccactttcatcaataagccatcttttaagcctttaatcatagcaactatttttttgctcttttgctcttctgctaccaacactcgaacaaattcatttcgcataaatactaaatatttgtatcgcttcttcttaccatatttttttataatatagatcgcattgcgtatcatgtaatattttcgaaatggtgaatgattcaatacatgaaaaacatggccaaattttttaactcgtgaagagtgtccaatttcgtgtaacagaccaataaaattaacctgataagtcttatatcccatctctgacagacgataattcatttcagagtcaacaaaatcaataaacatctcttctgcaaagccagatgtttcttcgaaaacgctcgttttcattaaagcagccgaagtaatacactcttcaatttctttatagtcaaattcttgcatcactaaattttcacggttcatatcttgatacaaacaagataacataccgaccttaggtaaatgaaggtaattttcataattatctatcaaatcacctaggacaaccgaatcttgatctaaagtcaagaaccaatcaaattcttgtgctactgcaaattgaccgatacagttcaaagcatatgcaatccctttattttctgttaaataatcaacagttaggtgcccctcttcattataatcggctactaattgagaaatttcttccttatttttcgagccattatctacgatatagatgtggcttacttgaggataaattgctcgaatgttctgatctaagcgttcaatattggggttaaaggtgacaatacccgctaaatatttcatgttctatgctcttttctaaaatctctaaataactgaatgactggtgctttggttataaaaacgataccgacatagatagttactgctactaaactttgaatgacataatttaccaatgatactgacatttgagtattgatataatagagtacagctccactaagagtagcagcaattaaatagcgcagcattcctcttgttaattctttaaaagtaaatacatctcttaaagagatagcttgatatagggagacaataaattcagtaataactgtagagataatagctcccatagcacctaaaattggtattaaaagtatattaagcacaacatttgccacaagtccaataactgcagacattgtgtaagcttttgtacgtcttgaagccagtagatactgtgtccctaaagcgttaccataagaaatgcaaatgatcatcaaagactcaacagccattagcggaccgacagcttcataccctttcccaaaaaagaagacggcaaatgtcgacgaaactcctaccactcccgcaatcattaacattgagatagcattgcttaaatcaacaagtttcaaaagtaaagccttagcttgcttttcttttcctgaagaaaatagactggagagccttggtaagaaaactcctccgattgctgaaacaatggtaaataaaatacgaataattttatcagattgatcaaaatatccagcactgaccacactatccattgctcccagcatactcttgttaagagagagataaatctgcatggtgatttggggtaaaaataacattaaagttggtcttagatgtattaagatatctaatctactaaatggtatcttgatgatttcatgctttaaatgatgccagactgttaaatttccgagtaatgatgcaaatgcaattaaaaacatataaagtgctaggtcatctggcgtcttcacaactaagaaggtcaaaacaactgtaataagcttaacaatggtattacgaatgacaattatcttaaagtcttcaactccaataaaataccacgaaatatcagttgcagtcgctaataaattaataccttgaattaaatagaataattgccattcgtttgtaagtaagacaaatccaaagaataataacgttgctatagatacagaggcaagttttaatacaactaattcccaaaatatcttacttctcttatacttatttgactgcacaaaagctatctcacgattaccgtacaaagatatccctaaagcaccaaataaagtaaagtacatgacaatggagctcgtataggcattaataccgatgccttgaggagatagtacacgggaaacataaggaactgttactaaaggtaacaacaaagtcaataactggtatgaggtattataaaacatatttttcaaaagtttcattagtttctcctcataattaaactaataacagtatcaaataacaataaggcatttgatacaattaccaagccagttaacgcatacggcaccactttccttcctgcctcatttagacgcgctggaatacttgatgcaaaaacttgtaccaaaagcaatgtaacagtaaagtaacgtccttgaactccttcaatgtagcttgttggcgctccacgatattctaacatgataaaaaagacaccaagaattcccacaaagaaactagctaagaaaagaaatcccatattttttgacttaacaaatttttcttcagaaaaccatactagaaagaccatgagataccatactgatgatacccaagtgggaataaaattctgacttggatatggagaggcaagccaggaagtaatgtcattacttaaaatattgataccagcataattatagccaaatgtcattacataacgtcttaaaacagcaaggacaccaccatgtcttgcggtcagaacataaactatagcaagtgacaaaaaggttagacatagccaaaatagctttttagatttaagaccttgaaataaatgtgatagcttctgattatagcccattaatttaggattgttaacctgcaataataccggtattactagcaataaaaacagccagtaattctgcttacatgcaacaatgactaaaagaatcaatcctataagagcaatactaagatttttagtcaacgatttatcaactaaaagatttatcaaaagcgataaaaatgctccaaatacaatatatccagtcgagtcataagatagactagcaaatgaatttagaactacgggactgaggaaaatagcaaagtagattaactttccttttttcacataccggataatgagggcaaccaaggtgattgagacaaaggaactaaataaccttgctactgtaatcattacccccatagaaggatacacaaatttgcctaaaaataagccaactgctggcacaagatgaccccaaaaaacaaagttatgtttagaatagtttatctcacgaggcaaatgattaccatcaacaaaattggctttatttaaatagtatttttcaaatctagtaccatctctataggaggtcgattgtcgtctcatacctgaatcaatattatattctccatagtaagaagtatcaataatgttatttgaaatacgaccagacacagctaaatggtattgtccatcaggttcattgaaaaatggcattaataggctcaatacaatagtaatcgttaagcctaatataaaatatgttttatgcaagttcttgtctagaaaaaacttttcaaatagacgaacttttttgaggttcatattaactcctttttatatcttttaataaaaacaccaagtcacgaatgcgatttgaaaagctatcatagaaccgttttttagtcatcatttgtttaagtattgctacaaaatctttattttgagcatttttataacgttgctgattaaaatccagataagctttagcttcccttaattgactagagctacttttttctaaaaatggtacaaggatgatatagtaactcaaaacaaaatacagttcttgtaaatgcctttcgtaacttgagctcatattcaagatattcccacttgcattctcagcatgtcgcttatgttcaccaacacttctgtttaaattgtaacctgaaccaatgacaccagatacccctgcaaaaagattatcatgtgacaaaattaaattatcactgtaaaaagtcattacttgatcaacaaacgacttgcgtaaacaaaaagtccaaccttgacgatagttatgatatgaaaagtctaatggatacttagaaattgtttcctcaccattgaacttaaaattattgggaatagtagcctcttctgataactttttgatatcaatatcggcgctaagaaggtttatatcttggcgttcttccataatatcaacttgcatcttatttttatgatgataccatgtgtcatcttgatcactaaaaaagacatagtcaacctcataggctaacacatcaataagtaattgacgaaaatttaaacgccaacctaaatttttatcattactagttattgaccaaccatctaaacggtgctcttttatatagtcttcaaccacctttacagtatcatcagtagagccatcgtccctcattaagacatagtctggtctcaacgtttgatttctaattgaatctagctgatcgtggatgaaaccttgaccattatatgttgccatcaaaactgctgtttttaccatattattccttactttttaaacgcaaataataaatctctcatacgtccactattagagttatagagtcgccaatttttaatcacaaaagcactattatgaattaatgacaatttagaagcttccaatctttctttttcaaaggctaagcgttgatttaaagcgacatcattttgatatttgttgacaaccttctgcatggtttcgtaaaaatcaacaaatgtttttaatcctgtgatatgttgtgttttaggcgacttccaattcaaaacaaatttgctattaccacttgcgtttcctccatatcgaatatgaactcctacgctttcgttaaggttataaccatttccaataatactggcagttgtctcgataagattatcgtgcgaaatattagctccaaaagtccaattatcagcgatagcttgcgcaaaatctctcttcatagcaatggtccatccgggacggaatgtttgataatcatatactttaggatactgactgattctatcactagaagaaaaagttagaaaatgtggaacactggcttctgtagacatcgttttgatatcaacgtctgcactcaaaacctcaatttgaggtttatctgacataatggcaaactgtcgttcgtttttatcaagataccaaatatcatcttgatcactaaaaaagacatagtcaacctcataggctaacacatcaataagtaattgacgaaaatttaaacgccagcctaagtttttgtcgtttttaacaattttccagccttctaactcatgttttgcgatatagttattgacgacattgactgtttcatccgttgaacaatcatccctcaataatacataatctggttttaatgtctgttggcgaattgaatcaagttgttcagatataaatatttcgccattgtatgtcgccattaaaactgctgtctttaccatattactcctcaaatgcttgtactgtttttaatattccagattcaagagaaacttctcgcttccatcccaacgcttctaatttggccatagtgagacgtgttctccccattttgctataacctgcactcatagttttaggaatatcgaatactactgaaatatttttatcagaaaagagatcaactaacttttgtgccaaatccttaatcataatgggttgatcttcatttgctacattgtaagcttgaccaacttcaccatttaataaaatagtaaataaccctgatacagcatctgctaaataacagaaagcacgctctgctgtaccactactttttaaaacgatatctttgccatcaatgacattcgataaaagatcattcataatacgaccatcgttaccaagctccataccaggaccaaatgaatgtgcaatacgagcaatagtaaagggtaccttatattgatcatagtaactttgcagtagagtttcagccatacgtttgctttctgggtaacaagctctagtagctaaaatatcaaatccaccataagcttcttcatcaatcacttctttaatagatgttccatatacttcacgcgttgataagaacaagaagttttcaattgttttttcctttgcaaagtctaataaattcaatgtaccaattgtattagcttttatgatgctaacaggattactcaaaatagcagttggactagcattgcttgctgcatggataatgtaatccacttttccatcatactctaggcgttcttctacatcataaggaattaaggtgaaataatctttcccaactaaatctgaaaatttatcacgggctttttcaatgtttctagctgtcgcaataatttgcgtttggtaatttcttgtctcattgagataggctagtaaaaataccatataactcgctaacatactattagaaccacttattaaaacgcctttattagcaattctttcccaattaatataattttggttactaataagtgctaaatcttcttgtacaattttattactaaatttaatcatcattacatcccataaatttgttcattttctctagcatcatacaaagctttaaacatataaaaatcatctggtgttgttatcttgatattttcatatggtccctcaacaatagtgagttcacgattgtacatacccatcaaagtactagaatcaattgcatcagtaatccctttgctaatggcatcacgttcaacagaaaggatatctgatagataaaaactttgtggcgctttagcaatgaaggaacgagtacgatcaacaacttcagatattttagaagaatcattgactagaacaactgtctctttagcacgaactgaagttaccgcacttcctgtttcttttactgactgtatattagcattaataacttcttcattaatcaatggacgtactccgtcatgaattaaaacaacggcatcatctgtagccagctgttcagcggcttcaagccccttaaaaattgacatttggccagtttctccacctgcaacaactgcttttactttcgtaaggttgaaacgctctaccagattattcatataatctagccagtctgatacacagacaactactacagcatcaatagcttctgtattttggaaaatatcaattgtgtgtacaataatgggtttaccatgcacttctaggaattgctttggtttacctttggtattcatgcgacgaccaacaccacctgcaaaaataactccaatattcatcattaaccttctttccagtaccaagtgtaataactatgactttctctcttactttctggaggtaattccatataactacccccatataattgattcagataagcatgctcatttttaatttttcgggttttaatgttttcaaacataacatcttcatactcagaaaaaatttctcttggaaaatattctttcaagcgatatcttgaatcggtataacccatgtaaggaacctcttgattattatatgtttccatcacttgatcaacaatttcagcacgttttttagcttggccgtgataagcgatgaatcggggtagccccaaaattagccttgcatttgcataaagctttcgggaaccgctagcaaaattggggtaagtcgtacacatcaaatttgcagcagcagagtgaacttttttaaagaatctttgacgttcttctgcactctctggtaatcggtcaagtgggaagatatcaataaaaatccctgtccaaggatgaattctatctgttttacttaagtacattgactttgtgtgatacagcttggcaaatggccatagatttttttcaacagaatgatgtagcaatttaaaatcgctattattagcatcagctaatgctttcatcaaacgctcatactggcttctttctagcatcaaatcaatatcgtcatcccatggaatgaatcctttatgtctcattgctcccagtaggctgcctccgcctaaagaatattcaattttattatcacgcgcaactttatcaatataagctaacatttcaagttgaacttctcttatttctgagaccgtcatttctttcataattacctctgtctaacagttaactcacattcttttaaatacaaatcttatagctgtaatatagaaaataaataaagctactgcaaaaagaatcactagggtcatgggtttgaaagttttctttgttttttgaccttttggagtgtttgcaagtgcattgtattcttgtttgttgtactgcatgtccattatataaccatttatattatagttaccaaattgtgctttagaaacactatctttatttactgtaaaataaaatggtttattgctttgtaagtagccttttggagattttgtctgtattaagaaatacttatatttattagacaaacctcgtaatttaaataatgattggttacttttcacttgttttttatagttataagcccataacctaggattcaagtctatgtcatttgaatagccatcaatacctataatgttatttcctctaatatggtaagcattttggttaagatattctttatttaaactcttaatcgttttttgagtatttatccaaaagccattaggttgatatagagatacttttttatctgcattcaatcttcctaaaatatactctgaaccttgtaataatctattttgattgtcgtcatacatggcaaaatttataccataactgctcaaactaggtgtctttatatagcctttagaatcctcgacaaaaatcccttgatcttgtttttgattatcaacagaaattagactccgtttagtctctatgacgcctttcttttcctgagcaacagacaaattataatctctttttgaagcaacatgtcctgtaatctctaactctttaatatcagcatttgtcaaatcaaagtctaacttatcaatagagtgaagtttatacaggctattttgtaataattctttttgctctgtttcatcaccactactatttaaaacaattttatcaccatcgacactaatactgctatctattggatacaaacgtccctctttaccttcttccgcaataataggcgcttgagaaagtcggtaattataattagtactatctactacaaaattagggctaactctgacagtcagctgctttgaataaattggaatcctataagtaatacgtttaccgtattcaactcctatagtatctctttttttgttattaacagttactcgaggattatctactcgggtattaccaagataaatcgtttcgtttttctgaatatttttcaacacatattcttgagtttctgcgctgttttcaaaagcagttaaaccaactggaatattaccaattgcttttcctttgttatttgtgaacttataacgtttattttctggattatataaaacacttggctcttctaagccattcatgtaaattaaataatctttattcttttcaagcagtaaccttacaatagcaatagcatcctgtctagtattttttataccagaaccaaatctatagttattatccataaggacttttttaccactaacttggtacttccgcttgatactatcaaaagtatagtgtgtaaagtctttgctctcaaactcccccgtcctcactttatccaatgctgtttgtaaatgaatagcattaatctgaacactgtattgcggggtattattatgataataataagctgtaatatctacttttttatctgtttttacttttttattattttggcaacctactaaaaaaagcatgaaaaacagacaaataaaaatatgttttttactcatctaaagtgctatcctctatctcttttttcaacaaagaaacctcttgaatcaggcgtttaatttgctcatctcttttggtattgctactagtatcaaataattctaaacaaaacagaaataaaatagcaccaaataacaagaaattcatcgttaaagcgaatccaaggtgatgagcgataaatgagaccaccccaggaaatacactaataaagactagaattaaaccaactaatagccaaggtaaagaacgtttaacagaaaatgtgtttttattaaccattcttataatcatataaagtaggacaatggctaaaataaacatttcaatttgcaatgctaaactcatttatcatcctccttaataaaccctgcaataataattgatgttaaaacatccgtcatataaaaaatcgattttagggaacttatacttgaagtacctgcctcacgttcaaacatattagctgtgacttccttcaaacgatagccttttttcaaaatccgagcagttgattcaggctctgggtattgtactggataatgacacgataaataagctattagcgccgcgttggctgccctataaccacttgttgtatcatagactttgtgtcccgtcgttaattttatagcagcagatattaaatttatgccaagacgcctcattgctgtcgattgaaaattttgatgttttttatcaacaaagcgagaaccaataacaaaatctgcttcgtcatttaagattggcataacaacatcttcaatgcttctaatatcatgttgaccatcaccatcaaattgaacggcaacatcgtaatgattacgattagcgtataagtatcctgtctgcacacagccaccaatacctagattttgaacaaggtcaatatgatttaaacccaatctatctaataactctggagtaccatcggttgacccatcgttaataacaatataatccagctcaaaaggtagtgagcgagacgccttaaaatctacaatagtctggactgtctttgcaatactaccttcttcattataagcaggtatcactagtaaaatttttttcatcatcttatctcttattgtaataatttgttgcaatcaaccatttaaacacaacttgatgcttaaattgatttttgctataaccatatttccataaccaccttaatcttgtcataaaaggctgtttgtcaatttttataaaacatttaatgagctcaagatcattagctgtcataatatcaccatacttatcaacaattaaggaagcttgcttttgtgagtcatggataagtttccaataccttgtaaatatagatttaggaccttcacgaagtatcttaaatctcttatccattgtcctcgcccccaaaacattattgtcatgttgacggtatagttgagttggtaaatccaaataaatgatttctcctaaacttgctgctaagagtgctaaaaaccaatcatgcattaagatatcattaggagtaaaccacttctcagctaatgcatgatttatcatcatagtcccaccagtaacagtattctcagttagttctggtaataatgtcgtattggcatggtgcgattgagcccgaatcatgctgtcttgtaaaatatttaattcttgattaacaactttcaaatcagtataaacaagtaatggtacatcagatgctttatgctttgctgcctctaaacttacagataacttttctggcaaccatacatcatcttgatcactaaaaaaatagaaatctgcaacttcgtaattaactagcgtaaaaaatgatttaataactcctaaattatggtgctcattttcattaatgaaacgaattcgagaatctttagcagtaaagtttctaataatatcacatgtcttgtcacttgaaccatcatctctgattaggaggttccactctttaaaggtttgcttttggatactttcgatttgctgcgccagaaacttctctccattgtaggtggccattaaaatattaactttcatttaaaaacaaatcctcatattcttcaacaatttttttccaagtatagttttcttgaataatggcttttgctcgatcaccgtaagtagataaatcctgttgttgatcactatcgttaataagcttagctaaatccccctcttttttagcccagtaaaaacttgagagacctgctactgatttgttgaaatcaacatctagaacaagattcaaatcagtattagctaaagcctcaagcagtcctggattagtaccgccaacttcatgcccatgaatataagcaaaggcttgttgacgaacataatccagcagatctttttcatagagcgtacctacaaacttaactcttttatcttgttgaaggtttgtctttaaggacaacttttcaaagtaggggttattttgatggttacagataataactaaatcacgcttagtatctgaagccatgaactccctaatagccgtttcataattgttttcagggacaaatcgaccaacgattagatagtaacccttagacttaatattccattttttaaacaactgtttgacacgtggatcatctgacgataatttcctagaattaatctctgtaccgtaagcaatgaaccttgtcttcacattagagtaggtagattgaatgtaattttcaataccaatattatcagaaataattaggtctgcatttttagtcatacatttttcggcgtattttaaataacgctgtgtgggacgagaccactttgatcgcttccactctaaaccatccggattaacatacaataagccaccgactttatgtattttattggcaaaatgccaaataaaggcaccaattgtatttcctaaaatataaaaaataggctcttttaaatcatgtgtcttaaccaagtcaagggcataattaatggccataatatcataagcaatcacacgtgctggccctaattggggaggatttatagtaaaacaatcagcgtcagcaaagttaaaatgagtatgatgttctttatcactaaggcatgcaacatggtattttatgtcgaaacttttttgatgattaatcaattctgaaacaaaagtttcaaaaccaccgtaacgagctggcaaccctctacttcctataatgaaaacatcttgcatcatcttctccattctagctaaacaatccatacaattataccataaattagaaaagttagctaaaaagagcagtaagctaaaaggattctctagccttactactctttgttttgatcttattttttaacttcctgcttgtagaactcttttaaagcatcttgccaagtaggaatcacaaatcctgttgctttcgctttttccaaactcatagttgaatttaaaggacgttttgcttttgctgggaattgactagaatcaacaggcttaacctccacatctgtgtcttttaagatttcaaccgcaaaatcataccatgttgtatcttctttagcatcatttgataaatgatagtaaccaaaatctttttgattttcagctaaataagtcataaactcagccaaagtacgtgtccatgttggtcgtccatgttggtcgttaacaacagttagagttttgtgtgtttttgcaaggttttgcatcgtaaagacaaagtttttaccatagttaccaaatacccacgctgtgcgaatggtatagaattttgaagtatatttttcaactaactcttcacccatacgttttgtacgaccgtactctgttttgggatcaggcagatcatctacttcccattcttgccccactggtttttcaccatcaaacacgtagtccgtcgaaatgtaaacaagtgttgcatcatgtttagcagcagccttagcgacattctctgtaccagtgacattgattgcaaagtctagctcttttccttcatcttctgccgcatcaacagctgtgtaagctgcacaatggtaaactaaagatggcttcacctcttcaaagactttgtccaccatctcggcatttgtaatatccatttcagctacatcaacagcaacatactcttgagttcgttcgtctaaaaggtgacgtaattcactacctaattgcccgtttgcccctgtaattaaaatcattccttgctcctttaaaaataagtttaacttttaattcttcgtttattgtacactaaaaaagggaatatttcatccctttactctttatcttatgaacgaattcccaaagcgatacgagcataacgactcatcttatcaacagaccaggctgggtaccataccaatttcacctcggtttcagttacctctgggactgttttcataacatcatgaatttgatctgtcaataaatctgctaacgggcatcccatagtcgttaaagtcatatcaatttcagttcgaccgttatcttcaaagcgaatctcataaattaacccaaggttaacaatatctattcccaattcaggatcgataaccatctccaaagcttctaggatacgatcttttatttttccaacttcttcttcgctatattgctttacttctgacattataatacctctctgaaaatattaataccgtctttaagataactcctttgcaaatcatttttattagaaactaaacttcctattctaaaaacgattatcgagaagcaatcaatcttccatgaaatctttaagttgcttgctacgactaggatggcgaagttttctaagggctttagcttcaatctgacgaatgcgctcacgagtaacattaaatactttacctacgtcctctaacgtacgcattttaccatcgtcaagaccaaagcgtaaacgaagaacattctcttcacggtcagtaagagtatctaaaacctcatctaattgctcacgaagaacaacacgtgtagtataatctactggattttcaataacttcgtcttcaatgaaatcacccaaatggctatcatcttcctcaccgattggcgtttctagcgataccggctcttgagcaatttttaggatttcacgtactttatctggtgtcatatccatgcgttctgcgatttgctcaggagttggatcttgaccaagttcttgaagaagattacgttgttcacggaccaatttattaatcgtttcaaccatatgaacaggaatacgaatcgtacgtgcttgatctgcaattgcacgtgttatagcttgacgaatccaccatgttgcataagttgaaaatttgaatccctttgaataatcaaatttatcaacagctttcatgagccccatgttaccctcttgaattaaatcaagaaattgcattccacgtccaacataacgttttgcaattgagacaacaagacgaaggtttgcttcagctaaacgttgtttagccattaaatctccctcagcaaccgcaacagccaattctttttcttcttcattcgttaaaagaggaacaacaccaatttccttcaagtacatacgtactgggtcattgactttagcagaattacttcctatgagctcttcatcagtcaattcttcaggttttggcccttctaccacatactttgttgaaggattgccttctttatctgtgattgaaatgccaccgtctgtcaatcgttctaacaaatcatcaatttgatctgcatctaaaacaaaaggaataacaagtttttctgttacctcatcatcaattgcagtaccttgttttttatgattgcgaataaaatccgcaacttgaacattaaaagttgtatttccttttttctctgccataggttcctcattccatatttcttttttgagcaattaaattttctaatgcagccaaggctccttcttcatcaccttgattactagattgtctaattaactggctttgttttcttaaatcacgttctttcaataaacggtcacgtgccttttcgacggcttcaatctctccaatagatacttctacaggtaattgttcctctaaaattatataataagtacgattaactttgtcactttcttgtgataaatcataagacgtgatctcaccactttcttttagcaactcatataaaacttgtatttctgttgtatcaaaataaaaattatccctattacggaattcatttaacaggtagggatgattcaataatcgatgaaacaattgcatttctgttttagtgatagctgataacttacctgtctgtggtaattgcactgtagcacttgtttgtactgaagatgaagcttgctgttgacttctatgatgcaatcgttcgttattaaccgattgttctacttgaaaataatcaaaatctggcaagagttcagccacttttgtaatatatgaattttgtgctgttatcgatggagatttagcaattaatttcgctattttttcaacataagcaatttcagattgtaaattatcggtgttttcaggctttaagtagtggatataaaactctgtattactgatgcgcccattttctaagagttgtttaaaatcttctgctgaatttgcttgtagaaattcatcagggtccattttattaggtatcctaacgatatcaacagtcatatctgatagcagttctaaagacttgtcaattgcgttttgaccagctctatcaccatcataagtcagaacaactttcttagtaaatcttttaaggtgtctaacatgttcattggttaaagcggtccccatagaagcaacaacattctcaattcctgcacgataagctgcaataacatccataaagccttccattaggtaaacttcgtgtgctttattaattacagcacgcgctttatctaaatggtaaagctcgtaagacttattaaaaataggggtggcacgagaatttttatatttagcttgttttctatcaatgtcctcttgagtccaaactcgtcctgaaaacgcaatgacttcaccaatatcattagttaacggaaacataattctattattaaatgaatcgtaaaactgattgctattttctgaataattgaacaaaccagaagacatcaaagttttttcatcaaactcttttgccagacgacgatatagaaaatcctgccctcccggcgataatcctatttgaaaatgtttaattaagtcctctgtcactccgcgctcggcaaggtattgtctagcgcgttcaccatcattagttgtcattaaataggcatggtaaaatcccgaagcaactctatgaatatctaaaagcgactgattagctttaggttttttaggaacttgccccttaaaattagtatctagaggtattcctgaacgttcagctagaacttgtacactatctaaaaaactaatatgttggtaatcttccacaaatttaaagacatcaccagagcgaccacaaccaaaacaatgaaaaaactgcctatcttcgataacattaaaagatggcgttttttctttatgaaatgggcataaaccaagatgattgcgtcctgtttttgtcaaaccgacaacttcaccgatgacatcaacaatgttaacactgttcttgatttcagaaattttttctttatcaattgccaagtcatgacctccacagaaataacccattatagttttacatttgattatatcattttttcttttctgtgtaaattttttcaaaagctttttcaaggatttcttcttcactgatttaatataaaaatttacagataatttgaaacctattacttggatttctcaaaagaaatctgctataatgaacgtgaattaaataatattaaggagcttgttcacatgattaaagaactaaaagaatttttatttaagggtaatgttttagaccttgctgttgctgttattttaggtgcagcttttaatgctatcatcacttcacttgttaaagacgttattacaccgcttatccttaatcctgtattaaaagctgctggcgtttcaaatatcgcacagctttcatggaatggtgttgcttacggtaatttcttaagtgcagttattaatttcttaatcgttggtactactttattcttcatcgttaaagctgctaacaaggttatggctaagaaacctgctgaagaagaaattattgaagttgttgaaccaacacaagagcaattacttgctgaaatccgcgacttactcgctaacaaataataaaagactcggattaccgagtttttttattaacttatagttataatatatgaaaaaacagctcaattctgaactgttttttcatattctatctaattagaattttttacgtttgcgagctgcttctgatttacgtttacgttttacagaaggtttttcgtagaattcacgtttacgtgattcttgaagagtaccagctttagtcacagaacgtttgaaacgacgaagtgcatcgtcaagtgattcgtttttacgtactactgtttttgacatatgtttcacctcctcaagatattgtaacattttcacgttcacttactaggatacccaaataaaagcagattgtcaatatttttatgatactttctctgggttattatttccctatacgtgatttcaatttttccacaaaaaggtatgccgctggacaagtaagagtattttttatcgttaagttattaatttgatagattttcttacgatcagtatgtggaaattcacgacaagctttaggtctgacatcgtatatactacataagttatcatcgcctaaaaacggacaaggcatcgctttaaatactttatctccatcttcatctacttctaaaaataaatcttcaaaagccgataacttcatccggaaatgtttagaaatcctagaaatatcagcttctgtaaatagaggacccaaagttttacaacaattagcacatgctgtacaatcaatttcttgaaaaacctcttgatgtatctgttggactattttatctaagtttttaggagctttcttttttaaacttgctaaaaatttacgatgctcgccttgtttttggagcgccaaatctttatatttttcaatattaattgaaccctgaaccatatattcctctgcctttatgctattattcttagtcaagccatattataacatccaaaaaagcctatgactaggctttttaatattattcaacttgattgccagttaatttagccgcatctgaaatataaactttatatttatcttctttttcaagtctctttatcactttgttaacagtcttcaacatttttccactgtctttaggtaaagctacagccttagcatccccttctcctgttttaagggcaaacttagcaagaacaaggtctggattctgggccaagtaaccttcagctacggttttttctaaatcaacagcttctaccttgcctgattttaactcactaatcgcttctcccatcgctgtcagtgacacgacgtgagaatttttgaatgatttcttagaaactccctcttcgatacttcctttttgtactgctatttttttacctttaaggctttcgattgaagtatattttcctaaatcagacttcctaacaagaaccgcattttctgtagtgtaataaggttttgaaaaatcatagactttagcacgctctttagtatatgataatccagaaatagccatatcagccttacctgtttgtaaacttgataaaacattgtcaaaactcataggagatacctctagtttgacatgaagctcatcagcaatagcttgagctaactcaatatctgcgccgacaactttatctttcccattaacaagcgctttaaactcaaagggagcataatctggactcaccgctaaaactaacttcccttttttctcaactttatcttgtagctgtttgtctgatgaaccacacgccaccaaagtaacgacagataaaagagataaaattcctaatattattttttttgacataaactatcttccttttattatgataggaacaagtataaatcatctttatacataagtcaagtttttttgaataaaaattcagtaaattacaccgataactatgcttgctgttagacgatttttaataacaactataactaattaaaacaatcaccttttaaaagtattccaattcttaaaaaatgctaactatcattaataatcaactaactttcagaaccttgtacagttgctgtctagtaagaaaatgataataattcgatttagtcactctccttgctaaaataataaataaggttgagatgtacatctcaaccttatttattattttctaaaaatcgctttagatatgatataggtcattataattgacaaaagaattgtggtagctaatgctaacagttgaactggcatatgtgataatttaaagagaccaactcctaaacttcccaacaatcccccaataccattcattccaaaggaggaaacgacatcatcaatggcaaaagctttcgcaacgtaatccgttacaaagtaggtgaagagggatgcaaagaatgttacagctaataattgccaagttaagagatacccaactcctgctgtactcgtcacaagaccaacaataatgccattcaataagcttcctgttttctcttcctcaccattccacttagcagccaatgtccacgccaaaccaccacctataatagcaaatatagtatttaaaagtatcataatggcttgtgaattccactcaccaactggacccatattaaatccaaaccaaccaaatgtaataagtatcattcctaaaaagagactatcatttttaaccttattgtgctgatgttcactcttgccaataacatgagctaaaatatacgaagaaagccctgcagataaatgaacgatcattccgcctgaaaaatcaagtactcccatctttgcaaaaacaccctctgaattccaaattaaataagctaagggcgtatacaccaagaaaagccaagaaacaacagctaataaaagtcgcttcgtctgaactctatcaataattgacccaataagcattactactgcgtaaagggcgaaacaaagttgaaataaacaatttacaatttgtttaccatctgcttcttggaattgaaagacagttttaaaatgaccttcaaatgctaaaaaataggcacccatgaaccaagctgttgtcgttagcaaaacagtaagtacaaactgataaataatccttgaagtcaatgattgatgtagcgacccaaagtaatagaatgcaaccccaaaaatcatgagccacatcgataaaatacataatagtaaaaacacaaatagtcctttctttacaaacactcttttatttgttaaactgtattattgttaactggttaagtattttatcttacacatttatttttgtcaaggagaagacatgaaacattatcaaaccataattatcggtgcaggcgctgcaggaatcggttttggttctgccatgcaacgattaggacttacaaattttcttatcattgaaaaagggcacattggagaatcttttttaagatggcccagaacaacacaatttatcacaccttccttcactaccaatggctttggttttccagatctaaacgctgttattccagatacttctcctgctttctcatttgaaaaagaacatctttctggagtggaatatgcacgctacttacaattagttgctgctcattataatctccctatccaaaacgaaacatctgttctatctattgataaacgagatagcctttttgttattaaaacttcaaagggagatttttctgctgattatcttattatggcaacaggagaatttcaaaatccaaataccattgatattaaaggtgcagatctaggaatgcactatggtcaagttgataatttccatatcaaatctgacaatccatttatcatcattggtggaaacgaaagtgcttgtgatgcactaacacatctagtatatttgggaaatcaagtcgaattatatacagatacgtttggtcgtaaagagagcaatcccgatccaagcatctctttatcccccctaactaaagaacgtttaaaacatatacaagaccacaaaaaagaatattatagtatctctgaaggcaagaaagccattgagattaaacaaattggaaaacaatatcaagttacttttgatgacggtagtactgcggagtctttccataaacctattctttccacaggttttctaaatacctgtcatctcattgacggaatcgctttatttgaatacgataaaaatcagttgccaatagttactgaagatgacgaatctactatcgttaataactgtttcttaattggtccaagcttacgacaaagagatactattttctgctatatttataaattcagacagcgctttgtccctgttattaatcatatcgcacaacgagaagggattatattagacgaagatacccttgaattctttaaagaaaatcaaatgtaccttgataacctagcttgttgcgatgtcaattgtgattgctaaaaaatcgctagctttattgctagcgattttttaatattaaacatttgctacttgaggtaaggattctccaatagcttctaaacgttctgcccattcttgacgtgataaaccattttcttgcacatagcgattacgttcatgtgcacgacattcaggcgagcaccctcgaacatacttcgcttcgttttcttctgaagcaaaaatttgtttgttacaaaacggatttgcacaattgacataacgttcacaaggtgttccatcaaaataatctttactaataacagttggattaacatgattaattggcaccgagatacgatcatcaaaaacatacatcgcaccatcccaaagttcaccttgaacttccggatcttttccatatgttgcaataccaccgtgtaattgtccaacatctttaaaaccttctcgaaccatccaacccgagaatttctcacaacgaacaccaccggtacagtacacaacaacacgtttttccataaacttatctttgttgtcacgtacccattgtggtaactcacggaaattgcgaatatcaggacgaattgctccacggaagtgacctaagtcatactcataatcattacgcgtatctaaaacaacagtatcttcatcaagcaaggcttctttaaattgtttaggatttaaatactcacctgttgtttccaaaggattaatatcgctatcaaagttattatcttctaacccaaggtgcacaatctctttcttataacgaacaaacattttacggaaagcttgttgattttcctcgtcaatcttgaaccaaagatcagcaaaacgctcatcgctgtggacccaatccatatacttctgagttgtttcataatctccagaaacagttccattaatcccctcatccgcaatcaaaatacgacctttaagcccaatagatttacaaaattctagatgtttcgcagcgtactcttccgcattttcaattgaaacatatttataatagagtaaaactctgattttttctgacattttttctcctcatctgcaaaataagttagtatacttcattatataacgactccttacaacatagcaaaaaatacgcttaggacatattctttgctttaaagacaaattattcttcttaagaacacacatatgttaaaatagtaaaagactaggaggacttttatgacttatgaattatgtctagaatacggtacttatccacttagacctgtagatgcttgggctgatgaaatcaatactgcacctgcgtttattactgaagataaaaaacttttagaacttttagaagaagtcaataccttattccatgagctctttttaacgatagaatgttccttccactatattggtcatgacttcccagaaaaaagagcaaaaatcacacaaatttatcatgtgattatcgaacatttaagcatacactaccctgaatatgacattaaaattgaatcattattaatggggtagttttattttaactaggtagaaactatctattaaaaacaatcgatatcactaattacttcaacaaatagattatctaaaacaaaaaaggtctctttcaagaggccttttttcataacttatctcactaaatattaaatgatacttttaccaaataatatcaccaatactctagactcttatctcttgaaagcaaggtacagacaatagccgcaaatccagaaataccaaatattataaatgctactccccaaccaaagtggtcaataataataccaatagctagagtagcgatcgttgctcctccgacataactaaatgtgccagtcaatcctgaagctgctccagctgctgcttttggaactaactccatagcatacaggccaaccatcataacaggaccgtagattgatgcccccaaacctagtaaaataatgaagtctaatgccatatattgaggtcctgctggaataaaccaataggcagctagtaataagattgctacaactaagaaggctacattggttaaaggtttagagtttttaaacactttggcagatagatatcctgctgttagcatcccaataataccacctatttcaaaaagtgaaaaaccacccataccagctgttgcagtaataccttttccaccatcttgcacactcgtcgctaaaaacttaggagtccatgagacaataccgtaacgtaaaatatatacaaatattgaatacaaggatgcccacatcagtttagtatttggtagaatatatttttttataatttcgcccatacccaaaacttcaggctcttctaaaatgtcacttgaatccacaacattagtatattgctctttatgatactcttctataggcggaagtccgatagattctggagtatcttcttgtaaaaagtaaacaagaacagccaaaagacaagccaccacccctggaaaccaataagcagcacgcgcttgattaagagaatcattaccagcaagagctagacctacaccagttaaaatcggcgctattgctccaccaaaattgtgagataaattccaaatggtagcatatttaattctttctttattatcataccaatagactaatgtacgcgctccaggagggtatcccatcccttgtaaccaaccattaataagatacatgatagtaaagagccagatactagtaattacagatggaataacaccgattaacacattaactagtcctgtaagaaacaaaccaactggaaggaaaattttagaattcgattcatctgaaatcaaaccagaaataaatttagagagaccataagcaatgtagctagcacaggtaataataccaatctcagtagcagacatattaaggataccagataaaattgaagtcgtattacgaacaaaatagtatcccatataacctacaaaaatagaaataaggacttgtacacgataacgaggatatttatgcttaatttcctcagctgataaacgttctcttttctgagggggtgcaaatagttttttcaacatagcaaattacctttccgatttttagatgtgtttaattatacaactatgaattcacactgtcaattaattaataatttattttttatcattttatcttatttttttaaatgtggataatactctttaaagtgtggataatactatattataaagctttttatctgatttttctgtattttgaaatcaaattatattttttaattttagtttatatttcaaaaattaaaacaccctataaccaagtatcacagggtgcatatttttatattatatagaatataaatacacatgcaattaaatatttagaataagttctgctcagttctatttttaaagtctacggacaaaaataaatacttatagttttattagacaagaaaaaagtaaggttgaaaaccttacttttagagactttttaatttgaatgccaaatatcttgattatattgttcgattgtacgatctgatgagaagaaccctgctttagcaatattgtgtataactttcttattccatgattcataatcttcataatcagcaagcacttgttctttaacagcaatgtattctttcaaatcaatcaatgtcatgaaccaatctttacctactaactcatcatgcaatctctttagtcgttctgcattaccgagtgacactatatcatcactaatgataaaatcaacagcttcacgaattactttgtctttatcatagtaatcttttgaacgataaccagatgtttcataaagattaatgatagtatcagagtctttaccaaatgtgtagatgttctctttgccagctaattcagctatttcaacatttgccccatccatagtaccaagagtaagagcaccattcaacataaatttcatgttacctgtaccagatgcttctttggaagccaatgaaatttgttccgaaatatctgttgcagggattaacttttccgctactgtcacattgtaattttctactaaatggacattaaggtatttattaacttctggatcattattaattaattctgataagcagagaattaagtgaatgatatcctgtgcaatagtataggctggagcagctttaccaccaaaaataactgttaatttacgtgatgggaaatgcccacgtttaatttctaagtatttatgaataacatataaagcattcatttgttggcgcttatattcgtggaatcgtttgatttgtgtatcaataattgagtattcatccaattcaatacctttattttccttaaggtaacgtttaagagccagtttgtttttaaatttaatagcagctaatttatcatgaacttcattgctatcagcataagttaacaatttttcgagctgagtcgcatcagtaagatagctatccccaattagttctttcaagtaatctgctaaatcttggttagcaaactccaaccagcgacggaatgtaataccgtttgtcttattgttaaacttatctgggtaaatatcatagaaaacctttaattcactatttttaaggatttctgtatgtaatgctgctacaccattaacgcttgttgagaagtggatatccatatgcgccatgtgaacacgtccagcttcatcaataatttgaacctctggatttgtttgctcttcacgaatcatttgatctaattttttaatgattgttactaggtggggtactacctcattaagatactctaaaggccatttttcaagagcttctgcaaggatggtatggtttgtatagccaaccatattgcgaacaactgacacagcttcgtcaaattcaaaaccatgtttttctgtcaataaacgaatcaactcagggatgaccatagatgggtgagtgtcattaatttgaacataagcatattcagctaaatcatgaaggtttgaaccacgctcgattgcttcatcaattaataattgagcagcatttgaaaccatgaaatattgctgatagatacgtaataattctccatttttatctgaatcatctggatacaagaacaaggttaaattcttcttgatttctgtcttatcaaaagtgatacctttttcaataaggttataatcaagtccatcaatatcaaaaaggttcaaataatttttagtatctttcttataacctaatacatcaattctatctaggcgtgattttaaagtaaagtcacggaaaggaacatcataagaaatatctgttggtactaaccaagaattattctcaatccagtagttagcttctgcttcttgttgattgttgcgaaatacttgtttgaaaagcccacagtgatagtttaaaccaacaccttcaccattaatacctaaagaagaaatcgagtcaataaaacatgatgctaaacgccctaaaccaccattaccaagtgatggttctggctctacatcttctatttcagcaattgatttacctacaagttctaactcttttttgacatctttataaatccctaagttaatcaaattatttgaaagtaatttaccaattagaaactcagctgaaatatagtataccttacgttgagagctattttttgatttagcggcagcttcttcttttacaaaatttaacaattcaacgtaaatctcttcatttgttaattctgataatacttttccttgttgtccaacgtaagttgtaaaatttcttgtcatgataatattccttatttattccctctattataaatagttgtaatctcttttaagaatgctttgcgattttctgttaagtcttcttttctcatacgccattgccagttacctccaacggtatttggcatgttcatacggctatctgcaggtttatctagtagatcttgcatacatgtaatcgttgtttgactaacggttgcatacaaggtacgcagtacagtctcagtaatgggctcatttggcaaacgacgcatgtaattttctgcataagctttctgttcgactgtaagattttcaaaccagccattaataacttcgttatcatgagttccagcatatgcaattgtattttctgtgtagttatgaggaatatcaatactatttcctgttgtatcataaaaaccgaattccatgattttcatacctgggaaccctgttccagccagtaatctctctgctctctcatcaatatagcctaaattctcagcaataataggtaaatcacctaatttttctttgatagttgcaaataattctggaccgggagctggttgccatgagccatcattagctgtttgataatctcctcgaatttcccaataatctgaaaaacctttaaaatgatcaatacgcaaatagtcatacatcttaacaccagattgaatacgataaatccaccagtcaaaatctgactctttgtggtaatcccaattgtaaataggattgccccaaagctgaccatcgtcagaaaaatcatccgctggtacaccagcaatagcaagtggttgtttgtcgcgatctaatttaaacagttcaggcattgtccaaacttctacactatcggcagaaacgtagattggcatatcaccgataatttgaatccctttatcattagcatattcttttaactcaaaccattgtttgtaaaagaaatattgcgttacttcatgatattttatcacttcactaagcttttgacgatatcctgctaaggcttcttcttcgcggcgtataatagccttgtcatcccattcttgaagcgccttattaccaaaatgttctttgatcgccataaattcagcaaaatcagttacccatttttcttcttgcaagaaatcagatagcattctcgtagctctctcttcttgcaagaaatttttaactgctttttctaaaactggacggcgtttttcaaacagaccagcataatcaacaacttctggatcctgtccaaaactaatattttggtagtcatctttcgaaatgaaaccttcaagcgttagcaaatcaaaatcaattaaatgtgtattaccagctactgcagaaaaagactggtaaggagagtccccgaagcttgttgttgttaagggaagaatttgccaaaatttttgatcagtttcgaccaaaaaatcaacaaaagcgtaggcttctcgtccaaatgttccaatacctaaatcacctggtagagaagtgatgtgcattaagacaccacttgcacgttttttcatattgattctccttttcgattacttactttactcctccatcttaacgcaagcgattgcataagtcaagcataatttaaaaaaacttctatcgaaaattgatagaagtctttatatcatagcttaattattatttttagaaatatctcggacactttcacgctcttctaaagtaaaaggcacaataatagtctcactaaagactttgtctggagatttaatgatgtcaatcagacgacgaacgcttgtccttcctagattattaacattaatatcaaatgtgcttaggtaaggatgaatcagatgtgagaagagagaattattaaaggtcatgatagaaatgtcatctggaacttttaatttatagaaagaaagaaattgcattactctaacagagacagtatcaccaataacaattaaagcagttgtttcttcttctttgactctatttataaattcctctaaaacttgcggattgcctctgtcaaataaaagagctggcttttggtttaaacctaactttctagcacctttaaaataccctaaatagcgctcttctgatacttctgaatttaaatcatctgtaacaaactggatgcttttatgtccttttttatagagataatcaatggcagatttccccatcagctgattatcattatcaatataagtaatctcattttcatagccattagcagcaccaacaacaacaaagggcagtttatattttaataaatactctctgataggatctttttgatccgaatagagaacaataaaaccatccactcgtttttgtagatgcattaattttacttgttctaacaactcctcagaagacatacttgttgcaatagaaactgtaaactcatgctcttttgcttcattagttaatgtagaaagaatctccatgaaaaagggttcacttaagcggtctggtaaaaccagtggaggaaaaataactccaatattttgcgttaaaccactagccaacatttgtgctgcaacattaggaacatagcccagctcttccatagcttttttcacgcgctctttcgtcttacttgaaatagatgcattatcttttagtacacgacttactgtcgatggattaacaccagctttggcagcaacatcttttatagttaccatcctacgacctcttcattctaatcattttataccttttggtatagtcctttgtctattatactctaatctaagaaaaaaacaaacgtttgccttctctgcaaatgtaatactctcactaaaataatcttctcatttagtattaattgatattatttttttatttttcttattttttttaaaaaaagacttgactttttttgcaaacggttgcataatataggtgtaattaaaatattctctaggaggagaaccaaaatggaaaaaaatacttggaaaaaattacttgttagtactgctgctctttcagtagttgcaggaggagcaattgctgctactcactctaactcagttgatgctgcttcaaaaacaactatcaaactttgggtcccaacagattcaaaagcgtcttataaagcaattgttaaaaaattcgagaaggaaaacaaaggcgttactgtaaaaatgattgagtctaatgactccaaagctcaagaaaacgtaaaaaaagacccaagcaaggcagccgatgtattctcacttccacatgaccaacttggtcaattagtagaatctggtgttatccaagaaattccagagcaatactcaaaagaaattgctaaaaacgacactaaacaatcacttactggtgcacaatataaagggaaaacttatgcattcccatttggtattgaatctcaagttctttattataataaaacaaagttaactgctgacgacgttaaatcatacgaaacaattacaagcaaagggaaattcggtcaacagcttaaagcagctaactcatatgtaacaggtcctcttttcctttctgtaggcgacactttatttggtaaatctggtgaagatgctaaaggcactaactggggtaatgaagcaggtgtttctgtccttaaatggattgcagatcaaaagaaaaatgatggttttgtcaacttgacagctgaaaatacaatgtctaaatttggcgatggttctgttcatgcttttgaaagtggaccatgggattacgacgctgctaaaaaagctgtcggtgaagataaaatcggtgttgctgtttacccaacaatgaaaatcggtgacaaagaagttcaacaaaaagcattcttgggcgttaaactttatgccgttaaccaagcacctgctggttcaaacactaaacgaatctcagctagctacaaactcgctgcatatctaactaatgctgaaagtcaaaaaattcaattcgaaaaacgtcatatcgttcctgctaactcatcaattcaatcttctgatagcgtccaaaaagatgaacttgcaaaagcagttatcgaaatgggtagctcagataaatatacaacggttatgcctaagttgagtcaaatgtcaaccttctggacagaaagtgctgctattcttagcgatacttacagtggtaaaatcaaatctagcgattaccttaaacgtctaaaacaattcgataaagacatcgctaaaacaaaatagtacgtctagagtaatgagatgaggtgagtactcttcctttcaattgagagtgcttcccatctcttattttgtaaaataacaattaaaggagaccattatgaataaaaaactgatctcacttgatggtatgtccctaaaagaggtctttcaaaaaggtgatttagcaactaaactatcattcttaattatgggacttgctaacctcaaaaataaacaaattgtcaagggacttttatttttaatcagtgaaattctgtttttaattacctttgtttaccaagttatcccagctgtaaaaggtcttatttccttagggacccaagaacaaggtatgacaactaaaactgtggatggtattaaaatccaagttgcgacacaaggtgataactctatgttaatgctaatttttggattagcttcgcttatcttctgttgcgtatttgcctatatttactggtcaaacattaaaagcgcagcacatttattgaccttgaaagaagaaggaagagaaattccatccttcaaaaaagatattaaaagcttgacagatggacgcttccatatgactttaatgtctattcctttaataggggtgcttctatttacaatccttccgttagtttatatgatttgtttggcatttactaactatgatcataaccacttaccgccaaaaagtttatttgactgggttggttttgctaacttcggtaatatctttagcgggcgtatggccagtactttcttccctgttctatcttggacattaatttgggctgttttcgctactgtaacgaatttcttctttggtattattcttgccttactaattaatacaaaaggtttgaaattcaaaaagatgtggcgtactatttttgttattaccatggctgtccctcaatttatctctctcttaatcatgagaaacctcttaagtgacgctggaccggttaacgccttgttaataaaatggggacttatttcttcagcacatccccttccattcctttctgatccggtctgggcgaaattctcaatcatctttgttaatatgtgggttggtattcctgtaacaatgcttgttgctactggtatcatcatgaatttacctgcagaacaaattgaagctgctgaaattgatggggcgaataagttccaagtctttcaatcaattactttcccacaaattttgttgattatgactcctactttaattcaacaatttatcggaaatattaacaacttcaacgttatctacctactcactcaaggtggaccaacaaactcaacatactaccaagcaggtagcaccgatttacttgtcacttggctatacaatttgacagtaactgctgcagattataacttagcatctgttgttggtatcttaatctttattctttcagcagtatttagtttactagcttacacaagaacaaattcttacaaggaaggggcagctaaataatgaataagaaaaaacgtcttaaccttacttttgtttatattttattgatagtactatcaattatgtggctctttcccattgtttgggtcgttctcacaagcttccgtggtgaaggaagtgcctttgtcaactactttattcctaaaacttggacattagacaactacgctaaactcttcacccaaaacacattcccatttggtcaatggttcttaaatacattatttgtcgctacatgtacttgtatactatcaactttaatcactgtagcaatggcttattctctcagcagaatcaaattcaaacaccgtaatggtttcctaaagctagctttagtcttgaatatgtttcctgggttcatgtcaatgattgcagtttactacatcctaaaagctctaaatctagaccaaacattaaccgctttaatatttgtctattctgcaggagcagcattaaccttctacatcgcaaaaggtttctttgatactattccatactctttggatgagtctgctatgattgatggggcgacccgtttggatattttccttaaaatcaccctaccattgtcaaaacccattatcgtttatactgcattaatcgcttttatgggcccttggatggactttatctttgcaaaagttattttaggtgatgctacgagcaagtacacagtcgctattggtctcttttcaatgttgcaacaagataccatcaaccagtggttcatgtcatttacagcaggatctgttattattgcaattccaatcacaatacttttcatgttcatgcaaaaatactatgttgaaggtattacaggtggatctgtaaaataatcttcagataatttaaagacacgacatttttatttcactgtggtttcttttctaaaaaaggcttgggttctattgaattcaagcctttttctaagctagatagttaaaaaacttggtttaccaagggtgttaacctctacaaaaaaataacttgatagtgctaagtaatttgacagttgcttctatttactatattattaatagtgttatctacaaaaggagcgtttttcatggaaaaaacaaaatcattctttggacatcctcgtggtttgtccactcttttctttactgaaatgtgggaaagattctcatactatggtatgcgtgctattttgctgtactatatgtactatagtgtttctcaaggtggccttggtatggacaagactgtcgctgcatcaatcatggctgtctatggttcactggtttatctctcatcagtaattggtggttttgtcagcgaccgtattctaggtagtcgtaaaactgttctgtatggtggtattctaatcatgctaggtcatattgctctagctacaccatttggtcaaacagctctattcatttcgattgctctaattatccttggtactggactattaaaaccaaatgtatcagagatggttggtaatttatatggagaaaatgattctcgtcgtgatgctggttttagtatctttgtttttggtattaaccttggtgcttttatttcacccattgtagtggggtacctcggacaagaagtaaatttccatcttggtttctcacttgctgctattggtatgttctttggtctcctccaatataccttagatggaaaaaaatatttgactgaagagagtctcagaccaaacgatcctttaagtcctgaagaaaagtcctctctatataaaaaagttgggcttatccttattggtattgttattgtacttattctacttcacttgatgcatatgctaacaattgaagtaattatcgatatttttagtattattgcaatcgccatcccaattatttattttatcaagattttaagtagtaaaaagatttcttctgttgagcgttctcgagtgtgggcatatatccctctctttatcgcctcaattctattttggtcaattgaagaacaaggttcagttgtcttagccttatttgcagatgaacaaacaaaactttaccttaacttctttgggcatcatattaatttcccatcaagttatttccaaagtatgaaccctctcttcattatgctttatgtaccattctttgcttggttatgggctaaatggggaagtaagcaaccttcatcacctaaaaaatttgcgtatggacttttctttgctggagcttcattcttatggatgatgctaccaggtttactctttggagttaacgctaaagtaagccctctttggttaacaatgagttgggctattgtcatcgttggggaaatgctaatctcaccagttggattatcagcaactagtaagctcgcacctaaagcattccaagctcaaatgatgagcatctggttcttaagtaatgctgcagcacaagctattaacgctcaaatcgttaaattgtacacacctgatactcaaactctttattatggtgttgttggtggtataacagttgtatttggatttatcctcttattttatgttccacgcattgaaaaactaatgtctggagttaaataaagacatctaaaaagaactaggttacattcctagttcttttttgtttaataaaattttcttataaaaccatcttcaagtcgcttactataaaacatctctgagatgtcatcttcgtcaaatactctcaaaaagttaagcatatcatatgctagttcaatcttatcaagttgtgaacgttcaatccatacaacatcaccttcatctgacgattgtaattcacctgaaaaatcatatgttttataaaggaataccaaatagcggatgccttcatctgtgtaccaatgcttcataccaactaatttgggattacttattgttaaacctgtctcctcgtgaacttctcgaacgagagcattctccttcttcaatatggccgcctggtaaagcagctcctgaccaagaataacgtttaggatcacggatttgcatcacaatacgtcctttattatcttcaataagacacatattagttaaaataactttttgactgcgtgacattttttcctctagtatataaatttagtgatagagttacaataccatttatttatcaatttttctacaaaataaaggatagtaacttaactactgtaggttaagaaaaatcgaataattccgataatagacatgattaaccctattaaaatagaaataatcagaataagctgcatgtcaaatcgttttttctctcttttttctttaggaatttgatatcgctcttcagatagacgtttattaatactctcctgaagtaaattcttttttttcaaaattttccccttaattaattacagattgatactgagtagagcttgaaacatgacaatcttcaagctgctgttttaatgctttttctatattacatttattgccaattagtggctgcaagtgcgaaataaatgtaaaaatatctttttttggaaaaatatttttaggtgatacaaaacgaatttgatgactagtctcttcgaaagcaaaaattaactgttgatgttcaaaagcagagcgaactgctgataatatctcattatgatgattaatatcaagataaaaagcacaaatatttgataaatattgtatttgatttgttgtgatatttgggtagagtacaacattatcatatttgccaaaattcatgagatcactagacatctcggtcaaagcacctatgttaaaagtcaaattaggaagagaagtcactaaactttctaatgcttcgatttgatcagaattcgtcaaaataagagcttggttatgtaatttttctgtctctttaagaggatacataaatcctaaaaagctaacttgtttttgttcttcgtcagttaataacctcatagcattagcataagcttcataactttgaattacaattttagtgtttggggaaggattgttcaataataagcgcatatttcctggaatatcatctacgagaggctcctgccaaaagagaacatctttactctctagacgattaaggtaaaagcttactaaaaatggtgttgacagagaattatagaagattctatctaagttaaattttgcttcttgaagataatttatgacaaattcaactttagatttaaaaaccttaaactgattattatcatttaaaatataatcccctgtcatatggttctctgatataacctcttgcctatccttattataatatgacgtctgaatcgcttgaccatccgcgttataaaaggtttgtgcaaaacagaacccaaacttattaaagcgatcttttaaaatgactctaccttgctcatcaaaccagtctacctcttttattagacgcttatgatttgggtttgcataaataattctgccctttttgacacctaagtcaacaatatcagcaccactactaaaaccaataatttcccatgtatcaggaactctaagttcattgtagtaaagtgggcggccagcacctgtctttgcaaaaccagtgtaatataaatagggtgatgttacgtcgtctggtaaaaaaccatcatcattcaaagctatagtagggttaatataacctgattttatcaaggaaaaatgtaaatcccaacttgattgagtgtaactatcaaataagttaatcatcttgtaccaactccttaactaagttataccattttccttctacttcatttgttaagaatccttcggcaatggcgtaagaagcttctcgtaaagccttttgatcctgttggaataattgtaacactttctctttaaaagcttctacaatagcttcctcatcatccatatcaaatcgaggaattagataaccattttctccgtctttgataaaagtttgattaccataacgaacatcaaacccaatcaaaggaagtcctgcgccaatagcttcaagtaaagttaagccaaacccctcacttttagaagctgtcaaatataactcataattttgataaacattcgagagatttttatgtcccatcaatcgaatgtattccgttgcattggctgcatttataatatttctaattttttcttcttctccacctgatccatagatatcaaaggtcacttcaggaagaatttctcttatcctaataactgcacgtactaaccaatctacatgtttttcactagctaggcgtgaagctgtcaaaatagagtacggacggcgattgtccattggcattttaagattgtcaattgagcctaccgggatagttataattctaggattatgatttgtaaattgtttaaattgttgttccaaaagttctgtttgtttatcagtggaggtaataaaaaaatcaaatctattagcgttagtaaactgataatcgtaatagttattccataaaatagtgtcagcagtcacagcattctcactaaaatgttccgcatgaacaacagtccctagcttagcgggtttaccatggcgcaaaagactctgagcggtatcagttcctctatccaaaagaataatatcttttgaagtgaaagtcattgattccaaaaaataatcaaaaaaagctactttggatggtaaaagtctgccattgataataaaacgacttgagctattttctaccatctccaaaaaggctgtactttcatcttcattgtagaatctacgttgataaaggtgagctacaccatctttaggatagtaatactctgagaaagtacgtgtataactataataatcttttctgataaggttgttatttgaaacgatttctacacgatgcactttatccttgttaaaattatcaaggtaaactgttaaatagatattttcatcttcgtagaaaaacttgattacccgacctttatcttcttttcgaacaagttttccaagatattgtttttgcaaatcttctatactaaaagttgtcggggcaagctcaatatctgaaaaaaaattatataaccaaataatttctttatcctgaaaacctatatttcgcgtgaggctaataatattatcagctgaaaaaaaatctgtaaaaataaacttagcatcaattccaagttttctcaaaacagaacctcggtatgcttgagcgtactcaacaccgctgcttgcccaaccaattccatggtttatattataaactgtcattatctttcatctcttatataaaataaatttgaagatctccattctcattgaaggatacttcactcaaaagtagatttctaaaagtttgttcacgaatttcttttttcatgatattgtaggatttatatgcttctttatgatattcgaaaaccgggttacgctgtgccgtttgacgagctgttgccacagtacgtaattgttgtagataatctacttcttcaatccaagcttcatcaatcgcttttaaagcagcagtacgttcaaagtcaccaaaactatcaccaagcaaattatgcttttctcgaagaatctcatcggctattttgaataaatagtttttaatttcttcaagtgacatctctttagaaatcccttgaagattgtaagacatattatcaaatataaaacgatttacttcaaaaatgagttcttctttttctacttcaccatctaaataagcaatgaaggaagaaatcactgtatcaataatctgtcttggactaaaatgtccactttctccattgatcaaagcatttctctcacgataaacatactctcgctgaagctgtacactcgaatcaaactctatcgtttgactacgtgcagactctcccttaccgtcactagcttcctgagtttgctggaataacttctgaaatcttctctgacctaaggctttaggtttttctggattaactttgtcacgatttttcctaaagtaatcttgcgcccatttaggacctgattctatcattagatcatcttcaaatgatacaaaaaattgactaaaaccaatatcgccttgtcgacccgaacgtccccttaattgtaaatccattctttgactcttcattctctccgttccaataactgcaagaccacctaattctgatactcccttacctaacttaatatctgtaccacgaccagccatattcgttgcaacagtgaccgcacctttttgccctgcttctgcaatcatctgtgcttccttaaccgcactttgagcatttaacaggctatgagggataccacttagtaataataattctgagaatagctctgacattctcacagaaccggcaactagtaggattggttgtcctgtatcatgaacctgtttaacaaattcaatcgttgcatggattttctctggtaaggttgtataaatcttatcaggatagtcaattcgtctaacaggagaattagttggaattctaactacttccatatcatagacctcaataaactctttttcagcagtttttccagttcctgtcattccagccaatttagtaaacattctaaaaagattttgataggtaatggaagccattgctcgagactctggtgtgacattaagatgctctttttgctcaatagcttgatgaacacctccttgaagtttagtaccttctaaaacacggccattagtcgcatctagcaacttgatttcaccatcgtcaaccacataatcttttcctcgttcaaataatttatgtgcttttaaagataagttcaaatgtcgcacaagttctcgattagactgtttataaaaatgagggattctaaaatatctctcagcttcacgaacaccctggttttttatccacacttcctgacgctctttgtcaaaataataatcaacttgttcttcaaaactaagaattagttcatctgctattttatagagattagattgtactcgaggtgaacctgaaataactaaaggagtctgggccatatctagaagaactgcatcagcttcatctacaatagcataatgtaacttgggcatatatttttgagatttagatgaagctaggttatcaattaaataatcaaagcctagtgcactacttgtactatagacaatatccgaactataaacagctcgcttagtcgcagcatctctatcctcttcctcattatcagaaactcccacaccgacactcaatcctaaaaaacgatatacttttcccatttcttccgcatctcgaatagcaaggtaggaattattagtcagcaacattgcccccttcccttctaaagcattgagatacaaaggcatagtggcagttaatgtttttccttcaccagttttcatctcagcagtatttccttggtgcagaacaagaccaccgattacctgtacatcatacggaaatagacctaatacgcgctcatcagcttccctaacaacagcaaaagcttcagcacaaatatcatctagtgtttccccattaactaaacgttttctaaattcagttgtcttagcttgcaactcctcatttgatagtgttgccatttggccctttaaactattgatagtatttaaagtacgctgaagtttttttaaacgtttcttatctaacgaaaataaactattaaaggctatcataattgtcgtcctgcttttttaaaagtgtgaggtaaggtagatgttcattaccagataagatcattgatactaaatttaaagaggaattttctgaaaccaatccatagtgctttacatttggagacgtctctctcgtatcccagacttctctaagaaatatttgttgtttggcagtcaagtgtggtaaggatttaagtaaaattccgaaaggagcaaaacaatcattaatataggcagttattctgggaaattttttagcataatataaagcagcaaaattaccttgtgttccatacgcaatgacattaatcttaatgttaggaaaaacttttaatgcatcttctaaccccttttccaactcaggtaatatcaaactatcagaatttaatgagggattgctgaccaactcgactttctgttgcaattgagaaatgctttctattttattaatatatacactatcttttttctcgaccaaaagaagatttaaaacgtcttgatgttcttcaatagtaaactctgtcgatagatttttctcctgaataacgctatctgtaacttcctcaagtttcaaataatgaaaagtaaaatcgctacaacctgcattaatcaaactaatggtataggtataagcctctttaggatagataaaaataatactatctttttttaacagttcaaaaccaacagactcattaaagcgattgtaaaattcaatgcgaacaaaaagagagctaactaaatcgagttctgcatttaatgacaagctataacgagttccctttcttagtaaaggtaagttaggagaaattctttttgactgataattagtctgggagctccatgtatacaagtttgtgctagaaggagctaatggattttcaaagcatactgattttcctaaaaattgtaattttgttccaaaattataagaaaaccttgaaaaatcatcccaataaatgtagcttatcgtactcattcttctttccttccaaaatcattagatagcattcgcctatactgacttgtaaaccatgcaccaacttctgcagaacaatcaccatgtcggccatcccaacctctgcctaatatcttatgcttctttcctctaaaatattgcaataaatcagaaaaggcagtcgcatcatagtcatcgtttttcatataggctaaggcaaaagtcgtatttgaaaaatctccttcttctatagatttccaaaaatagttatttaacttctcagaagaggaactggtcaagtcaccttgattgagtagttgaatatctaatgaagtagcaaatccatctggtctctctaatctttcacgttgagcaactgttcctaaattaaatattggtttaccaataataatagcatgaggatttagcttagcaccatggtaagtagcaccataagtccccattgaaagtccggataaaattaactgatcagaactaaaatttaaaaaggccagtttttcttgaatagcatcaactattttttgttcatattctttgcttcctatataaaaggcaccaccttgtaatcgtggatcacaaattaacatgaatggagtcttcatactcttcatcatccagaatccctcaaagccttcagctgaacgaaatcccgaaaaataaacagttagaggtggtttgaaatctactggatcaaaataagtcataaattcatgacctatagcatctatgtgacgttctcctcctagtagaaatgtgcccaatcctcctctaccattacgacggtgcaatggacctaacttaacgataccctttcccttagcaaaaagtttaactgcaaggctaccactaatatcggactctaaagaaataagttgatttaggtcttccttctcaaagtaccactctttagcaatatcatcaacagaaccatcaacaatcaacgagataaccaatcgaatatctatatcaccctctataatgtgttctaaaaataactcattataaaaatccgatgaaaatggaatattgtaagcaaaattaagcaaaaaactatagttctcaccaaattgcccttctaattcaagatagttatttccctgatagtttactacaccttcaaaatcatttctaatttgtatttgtgaaacttgaagtttctctccgtattgtcctataaaaagccctttataaaattgacgaattagctgatctggagagctactatcatatcgttgggccattttcgagcgtaaaaactcttctgttatccccgtagcatgtttatctttaggataaaatacttcataaacctcaaagaatgacgataaactagataactctggtccataagtttgctctgtcaacaaaagagcagatatttttcgaggtagtttttgcaataactttgacgatgtaagataattattttctgtagttacaaagtcagaaatttgatctggtttaataaagagccattccatattattagggatattctctttagttgcccagttctcttcaccaacttgaagaattgtaagttttatttttgacatatttatttaataactatttataattctttctaccaattgaccacctgtatagtcattgattttatcaatagaataaattaaagaacggttccaattagttaattgttcacaataataaggaattgccttttccaattcttggatctcttcaataatgtaaccgtttttcctgtgttcaacaaattctgttaatattgtatttatctgagggatacctgaacttatccctgcaatttgcgtgtataagtctggtattttcgagatatcaataatcaaacggacatactctaaccggtttatgatatctgtttctgacaaaggatgggtaaaagaaaggcgtgttttttccttttctacttcatcagattgcataagaacttgattggcatcatcgtctgataaactaaagaatttctgatcaaaaacttttgttgcttctttaaggtagtcatatgtcaattgccgactttcaaattctcgttcgtagctgacaaatgttacttttatatcattatttttgagcataaccttatataaggatgttaaagacttttgcaattctttatgggaaagtctatctacgacaaaatatatttctaaatctctaacttgattactttttcccaaagctaaacgcgtatcaaagggagaaacatgaacaactggtttatctattttttctttcaattgtgcagcaatatctagtctatcacaaataatagcgtctgctcgagataaggaagagtaatcctccaatacattgtgagcattattcctctccgagaaaacagataatattaaatttcctttactagtgttcccaacaataaatgcgttatgaacttgattaaagctaacaatgatagtatctgatttactaacttctttatggagataggtcagatatttctctctaatcaactcttcaatatcggagtaagataactttaaaaaatgaatagctttcttaggattaatttcaacatggtggtcaccttctcttaggtattctctcatgatcctttcccctgatggtgctaaataatcttgataggcttcaccaccattatcataatagagaatactagatagaaatcctctatcatcaaagaggtatttcttagctatttgttcatttgcaaaataatcaatatgcgttaaatttccttcttcaccaaattgaaccttagcaattaaatctcctgacttttttaccaaaactataaacggagtataggtaaagtccaccccttcaggccaattgagttgtcggaagtcaatcatttgctgtcttacattcccaatttcttgaatatcatcaaaaactgaataataacctgattctaacaagtcatagcgatgtaaataataacgtaaattgggcatatagtttaagacaactaatctactctcttttccagcataatcaaacatcttcatttggttgatagtatcatcaaaaccgacattagtcggcttgaaataccacaagtaattattatcataccaagtacgattttcattataccaagatggaataaaatgaaacattaattctcctcattttcaaatacagaagtgtattgtttacgaatacgaataacttggaattcatccaatatcataaatgacatccctgtgatcatcataaaaatccctgtcatagatgaaactgtcctaagatcatcatttccaagagcaaataataatggtacccctcctaagaaagccatgaaaaaaccactaaaagttccaaataaataacagattttcgataaataactttgtgtttctttaccaggtctataattaggaataaaatcaccactttctcgcattgcctcagaaattttagtcggatcgatattcacaaaagtaaatgcaactgataaaacaagcattaaaatcatataaataaccactccctgaatagaagataaactaaaatagtcattgtatgatgtgatatctggattagttgggaaaatacttcttagtaaaataataatatactgggggaacattagtaaggtataaacatacataaatgccatcccccccgaagcatttacttttattggcatgtaggcatcatcaacgagacgattatggattgaagtacgcattactggtatacgatattctgaacgttcaaaagttatcattaagtacattgctactagtgtccacaaaagaaataagatgatagcaagttgataaccatcttggaataattcaaaaataagaggaatattattaaattgcccaacaagcatacctaccaccactaaaatagtcattccaccaaacccgtattccgcatttagattaccaatccaggaaataatatatgcaccagtcacaagtatcattgtcgcgagtaataatttggtcagagaaaaaccattatgatattgaaaagatatggttatggctagcccttgaataattgctatgacaagcatcaccacattttggcgaaactgttgaactttttgagatactccactagagtatttaccaatcgtaaatagtcttagtaaaatcattgtggtcatcataggaccaatacccaatgaaaagaccccaacctgagacaaattaccaccagttactgttgaataaagcgtcgcaaagttattgtcttgtcccttataagcagaaatcaagacaccaggtattggaacatagcgaccaagtaaaaaaatgattattaatgaaaatgttatcaatattttacgaagaataatatttttttcaaaaatatatagtaatttcaatggaatttctctttctctatcaatttgttctcttcaagataagtaactttatatcgtcaacttcgttaattttaaaatcaagaaaattgatttcaatattcaagtaaccattactcttcttgactatctattttgtttaatagtgtcacacaaatattcaaaatcatccatggttcgctcaaaagaaatatattgattatcttttcttgcccgtctgattccatatatagttttaccctcagttatacatctatcaacaacattccaaacttcttcaccatgattaatatctaaatatatatcgctatttaataggagtacttcgaattgctcttcagtaatagcttcatgtaggtaataatttggataacctactaactgcttaagtctatccgaacaataaactggggcagcaatatgaaaatcagtattaggacatctttgtaataaatgttctagctcccatatatcatctgttaacgtcactgtcaaagcgtactgtctatctgatgtaccaatttttgatacaatttgattttcgtaactattgtcttctattaaagtaatatcttcgtcaaaattatgttctgccgtatgtttatgagaaagtttcaccttagaaactgctcccatcttaaaccactcatattctgaatcgatatgacctaaatcaatagcttgatgtcctagctgcgataaatcttcagctaatagctttgcagttggaccaagcataagtaaaattagcttacctctactatgttcaagtatagtttccttgatttcataaaaagatgaaaatgcatctttcgaaggacaaatgatacgcgaaatagtattggcatcattaaataagtcattgccaacgcctgaacgagaagtctcaccctcgacaattaaaatatctttatttttccataatgcttttagctgttcaaagtacgttactgacaaactcttatccagtaaatccatatagggtctagaaataaaagttgaaccataccattcagcctgacaatttttttggtacaaatcattatactgatatagatgatccctccaaaattgttgtgaaaaatcgttgtatctacctaaattatcaaaaacatcacttacacagataactaacttctcattactctgtcgatttaataaacgttctaatcgcttagcaagttcagaatcataaacctggtaaggaatagaattccccgcaataatatcaatttctccatcaccaaaacgcgctaccgaagcggtatgtttagaaatataatctaaagtttccgaaattgtttttactttaataactctcataactattaattcttttcaactctctttgcaagattacgacaaataaaatggtatttactgttaccttgataaccgatttgatatcactttatatattattgttttctgtaaattttcttgttctaagcgctgtttatagtcacgcattaaccaaaaatatctctctacagttgcagttgaatccaatcctgatagtataatctccgacaatttactatcaaaaatataaataagatcctctgctcttttggatgaaaacgccgatgtcataatgctatttggacgaattctatagccataatagcttccattaactaaaattgtttttttactttttataaaaagtaaaacacttaccaactcatcttcaaatactttatctattgggaaggtgatggtatcaaatagttctcttcgatataatttcccccaaataacgatgaatactgaactatttaaatgccaatgcacttgtctatcaatagctgtttgagcagagatttcttcgataacaaaatctttgtcagtgatgtagtaaccaaaaatatcttctgtttctctgtagatatagtaattactgataacaatatcagcattatatttttcttgctgagctagcagtacttccaaataattttcctttacccaatcgtccgaatcaacaaacgtaacaaattggctctctggactaattcgtgctaatccaaagtttctagctttagaagcaccgccattttcgatatggaaaactctaatacggttatctcttagggataattgatcgcagatactagcagatgtatctgtagaaccgtcatctatcagtagaatttcaaaaacttggtatgtttgtcctaaaatggtatttacacacccctctaaatatggtgctgcattatagactggaataataacagaaactaatttatcagtcactattgcctccatttttacataaaaactgtcgcatatcctccaaattaataaagcaatgacttaactccctatattcaaatgtcactgcttcattaaaactcaatatcggaattgatttctcaatagctttttgacaaaattgtatttccttccaagaagttgagatatcaaggtaataatttgctttagtcattagttgttcaaaaagtgggctggttattgaaggatacagacgaacgttagagtttgtggctaacttaagtaatcttgggccaaaagaggtccaagcagctatatggaagcaactattggggaatagttcaaccaattcttcaatataaagcaaatccacggacgttgtgaaagtaaagaagtgtttttcaaatgttggctcaggtaacagatacgtttcaaaattaaacacctcattccaatctagttgctcatattgccaccatgtctccctaaaccttgaagaagaaaaagtattccatggtttatcatgagtacagtaatggataatagtaggcgattcaaagttacgatcaaaatacccttgccaattttcataaaaggcacctaaatcatttccaacttgagcattatacttatcttctaacttaagccaattattatcaaaaagaagattgagaaccccttggtctccaaaaattccattatccaattctcgttctgttatttccagaagtttttctgttactcgatatctcatccagtaaagcgagtttattagcataacacctgagttaaaataaataccgtctccatctaagatagctgctatcgggtagtcccctaattctatctcaaacaacttatctaagttatcaacaaccaaagtatcaatatctaaataaagaactttctctgcatcaatcagttgcggaatgtagtaccttgcataagccatataggtaatatgggcacgggcgttttaaattccttaaaagtatcatcaaagagttttatatcaaaaatacaactatgactatttaataaacgtctttgaatatttctaaaccattctgaagctatatcttgatttaaaatataaatagacttcctgcgaaactaaaatcctagttcacggttgatcattccagcaatcaaattcattcgtaatccaaaccgtttgcgtcgatttcgataggttgttgaaaatattttaaacgtttttactttggcaaaaatattctcaaccttgattctctctttggatagcgtatggttataggttttatcttcaagagttagtggcttaagtttgcttgatttcctcggagtttgcgcttgtgaatacatcttcatgatcccttgataaccactgtctgccaagattttagcagcttgtccgatgtttctgcgactcattttgaacaacttcatatcgtggcaatagttcactgcaatatccaaagaaacaattctcccttggcttgtgacaatcgcctgagccttcatagcatgacatttctttttaccagaataattcgctagttgatttttttaggacgattgatttttacctctgttgcatccacaatcaccgtatcctcagcactaagatgagtttttgaaatcgtaaaaccactttgaataagagttgattcaacccattgacttcgacggattaagttgctttcgtgaatgccaaaatcagccgcaatttgttcataagtgcggtattctcgcatgtattgaagagtagccatgaggagatcttctaagcttaacttaggggttcggccaccttttgcgtgtttacgttgataagctgtttttaacacagctaacatctcttcaaaagtagtgcgctgaacaccaacaaggcgcttaaatcgtacatcagttaattgtttgcttgcttcataattcatagaactattgtaccatattttgtttcgcaggaagtctaatacttactctatcattgtgacataaaatcgattttataactgtttggatctgatttaaagatttattatcacctgccaaacaaataacgttatttttcacaatattcctttctaatatgttctttaaatcgttcattctttaaataatcaataatatccgtaactctctcaaattgtttgccttgaccatgataagttgtagaaagggataaaatatctttacctaatttcttcacttgctccagaacctgagtatctgcatcaccatgattaatatcaaggtaaatatctgaattttcaactagctcatttaatttgaaacgataaacaagtggataaagttttatatttgaatgcatttccaattgtttcaatttttctgaaatttgagtataggcagcaatatgaaattgccagtttggtaaatccttagccaacctctcaattccttcaattgaatctgagtaagtaaaaatgaaagctcgatggataggttgtaacactttcttcaatgaaacatctacaccatcattgacttgccatcttgtaaaaatatcgcgccattcaagtctattatattcccaccatatatcgcgccaacgaacagatgtttcaaggtatttccatggttttgtcgctgtataatgaataactttaggtaaatctttcctgcgatttaattgacgttcagactgttggaataggttatataacatatctgctcctgtatgatagttataagtttcatcaagttctagccaattatcgcacagtacatcattcaaaacatcctggtcatgatattgaagagccccttggttttctctagtataatctaacagtcgctgactaatcccttgttctcgccaaaaaatattattaattaatagcaaacctgaattaaaataatcttctttaccatcatattcttcgagcaaatcatctcgaacagccgctacaccatattttgaaatatcaagagtaaatatcgatgttaaatcactggtgataatcatatcacagtctaaatatagtaccttatcttcatgaataacttcaggtataaagtatcgaaagtaagtaggatagggcatcggtttttgaaatttaaaatgtttaatttcttcattaaaaattttagtgttagatattgtgcaatccattttagataaatgatattccatcatttgaaaccattcaactggaaaatcgtcatttaagatataaaaatcaataaattgattatgaaagcatattgatttaattatagtcttaacttgctcttgatagccaaaatctgccgctaacgcgatagcttttctatttttcatctaagaggacctacttcccttattcttttaaccatcaattcaggcattgtttctgagataacttctatattttttgtcgtatgtgctgtagaatcaaaggctaaaatcggtttattctcttcttttattttatctagaataccttctacttcgtaagaatgattaatatccaagtacacatcacagttacgtataagctcttccaagatagggttgataactaatttataaactttaatattgctataagtttctagattagctaatttctctgaaatatcactacgtgctgcaatatgaaactgataatctggtagagcttttgcaagtacttcaatatgttctaatgtatctgaggctgttaatgtaaataaattcagtgttttacctgttaacctgttcaaatttttttgttgttgagcataaataactgaccattctaaaccaaaataataccaccattctgaacggtatcgcgattgactatatttattccacggtttatcttgactattataatgaacaataacaggttcgcaatcatcataaaaatgatacaaatctggtcgcccatatgcattaatattgacatcttgaccaatctgaacattatattgtttaccgatatctatccaacgattctgagtcaaaatattaaggtattcttgatctcctaccccaacagcagaacccttatcagcaatcctcataaggctattataaatttcttcttttttccataatgaattattgattagcataacacctgaattaaaactaactggtgctgtatctccatagtaaagcgttgaaaaatgatctgctacagctcctaataaattctcttcaaggtttatgtcaaatagaggatccaaagaacccctaactattacatcactatctaaatataaaactatctcttcttcaaggtgaattggaataaaccatctgaaaaatcccgccacactgatatggctcagggtaggtatcccctcaaagacatctgaacttatgggaatattttttactctacagtcaaactgttctaaagaatggttaaggatattaaaccattctacgggaaaatctgtgttaatgatataaatagttaaatgttgattatgactaacaatagattttatagttgtcataacttgatcacgatattggaaatctgcacctaaaacaattgttttcttcatcgctacccctatctataaagcatatgcacagcatctatcaacaattttttagtgatataaccatttcgcaagagagttgctatcttctcaacattttccacatagctgtcataagtctctttttccatattattaattttttcaacagcttcttctagcgtttcaactgtaaatcctaatccgtgttgtttgataaagtctctacttgaaatatcatggttagcaataattggaagtccagcagccaagaaagtagataatttatacgaggcattcatcctcgaataacgacgctcgactaactcctctctatcttcactccaacacaggccaaatcctccccgcttagaaagacttagcatcaattctacatcatctttccatccctgagcatgaacatttgcctcagaattgagtctgcttccgtctccataatagatgagcgggatattttccttccagtcattgacaaagggaaagcgttgaatatcgcctgcaaaactaaggactttttgacattctggacgagggaggtctatattaactggatgatcccatacttcttgataaagaactttagaggtagtcatccctttttcaattagataatcatgcatcgcttttgtaggtagaataacaacatccgaacgattatacatgtcaattactctatctaataaataaaaattagactcaaacattaagggaacaatatcatgtacaaaagttataattctagcaccgtatgcctgtaatttatctagaaaaagttcatcaaattctgttgaattccatgtaggtacttgaaaaacaacaatatcccctctgcctaatcccgcaatgataccatccatcctagtacttctttcaccatgcgtttcagcatgatcattataaaagtagattcccatttcatcataaccaagttgacgtccgacatccttaactagtttttgtgatataagggcaatgctacgcggtgactgcccatatatacttgtaatatgtactcgcattttagttaatctctctttaaaactctctcttatccagaccatatcataccagttaaataatagttttattaacactcattgtactaaaatgatccaaagcttttttacattatttttgagtttatcgtaattgataaacttattttcagaaataaattccacttcttaattttatcatattttagcagaaaaacattgcttgtcacttgataaatatagatttacaaggctttttacaaacttctacaacaaaaaggcatatctctctaaaaatattaagagatatgccttttaccatgtcatttagtactttaagaattcaaagtaggtttagtctttatcttttttagatttttttcgtcccaaaagggttgcaccagtcattaaacctaaacctaaggcagtagcagttacagaataatcttggtcacccgtagaaggtaaggcagaatacaccttctcttttgatgaattagaagtcactgagcttgaagaacttgtggaagcgctggtacttgctgatgtcgatgcactcgttgagacgctggtgctggctgacgtcgtggcactcattgaagcgctagtgctggctgacatcgaggcacttgttgaagcacttgtgctggctgacatcgaggcacttgttgaagcacttgtgctggctgacattgacgcactcgttgaagcgctagtgctggctgacatcgaggcactggttgaagcactggtgctggctgacattgacgcactcgttgaagcgctggtgctggctgacgtcgaggcactcattgaggcgctagtacttgcacttgtggaagcactggtgctggctgacgtcgaggcactcattgaggcgctagtacttgcacttgtggaagcactggtgctggctgacgtcgaggcactcattgaggcgctagtacttgcacttgtggaagcactggtgctggctgacgtcgaggcactcattgaggcgctagtacttgcacttgtggaagcactggtgctggctgacgtcgaggcactcattgaggcgctagtacttgctgacgtggatgcactggtactggcacttgtggaagcgctagtacttgcacttgttgaggcgctcatacttgctgaggtggaagcactggtactggcactggttgaggcgctggtacttgcacttgttgaagcactcatacttgcacttgttgaagcactggtgctggctgacgtcgacgcactcatggaagcgctggtacttgctgatgtcgaggcactcatggaagcgctggtacttgctgacgtcgacgcactcgtagaagcactttctgataaaagtttaatttcggcattcgcatctgagtcaccacttatattcgtatgcccataagaatatttagaaccatatgtttgatttatatcagaaacagttgaatacaatacaccactttgtttaggtattttgaccaaaacaacataagatgtagtggaagaaatagaatttgttttccaatctatggtaattttagaaccatcgttagtataactatactgggaagtcacatcttcaaactcaggcgaatcataattttgatccatactatctgtaagattttttgaattagtttttagaatctttacttccgcatttaataaattaactggtgaacctgatgttccatctgaaccgataatagtatatagattcccaagtcctgatgcgaaatacatttccttaccttcaggattaatttgagtaatataagtttctgtctgtctttcatcatcaagcttcatgatccgagatcttacatttgtcttaacattagtatgttctgtcactgaaggactattatactgaacacgttcctcaattgaagcaacttgattgttcaatgttgcagtaaagcactgcttatctgaagttgttttagaaattattctctggtcaggccaaactggcatattgactctagctttaatattattcaacgtagaagcataccttgtccaggtgtatgtaatattatgtgttaaaggactatatgacccagtcgctaataactgccccgtttcatccattatatcttgaacttttagaatagtaccaatcccttgtgtgtcaaggttatcagaaagctttacagtaaagacatctccctcgttaacagaagcgattgaaaaggcaaagttcaaaacaaggttttctgaactatctaatttaactgttccaggctcactaagagtgttatcttttaacgcaatattaactttctgcaactcgcttgatacatctttacctaacatttcagtatcagacacttcttctagtggtatcaagtccatctccgaactcaaagtcatcaagttcatactccttggctgaataactgattttaatctaattgtcggagttagactctcattcccagttttatcgcttgcaatcattacttgggatttctctggagttataagcgactcatttgacattttggaagtctgtaactccgattttggttttgtaatttcaattaggctagatactgaagcatttttaccagcatcagtaactaagctactttctgttactatctggtttgccgaaaacgactctcttcctttatcagttaaagaagcttgagtttcaagaatatttgaaacctcactaatacttgtagattttgaaacactttctgaggctgacgtgcttatcgattctgaagcacttgttaaagcagatgtacttacagattcacttacacttgttaaagttgaccctgacatagacatacttacagattcactagtacttgttgaggctgactctgacatagatacactattagaatcaataatgtttttcgatactgtcccatcttgatgattttgaacagtagttgttttaacagtcacttccgtttgttctgccagtgttggtacagaacttgattgttcttgaacaactggagtctcatctgcataaacacgactggttaaactcgctccacctaccagagctccagcagctagtattcctttgagataggtcaaatttcctgaagatagtcggtcttctttttcaacatcttgaatacacacatctgcttcaacagttgctctccctttaatcgctttaaatagattaaaatgcgacattactgttcttacccagtttttttctgatttatgcatcttgactctactcttagtatctacaactgttaactgcttgccaaaagtcttttgggacatgtttcctccatatataaatattttttatattttgttttggtttaaaaacataacagtaaaattaagtgattagaaatctatcttagttaaacacaaaaataatgataccgttaagcacgtagatacatcatttttatacagatataaaccttacaattgatttttagtatgatttcataagaatctcaactgatgcttaataaacctttatgaggttatcactaattatgactaaaataaatatactttaacccctcattttcccaaaaaggcatttaaaatatttattttttgagaattattattttataaggttaaaatatttgaaacattttatattattccttattatagtattaatgagtgaaaggagttgtgtaatatgatagaaaattttttagaaaaaaatattcttaataaagttaaattacttactttatgttatgataccccctcactatccttagataccgcctgtaaccgactccacttatcaccagttgagcttaaaaactattgtcataaattaaatgttttatttggtcataaactttctatccatatccaaaaaaaacggattttatgtaagctaaataaacttactcaggaagatgccttaaaaatagtttataatgagtcaaacactttacaacttcttaaatttttaattgatgactcgtctgataaaaaatctctagtagcttttggaaatgatctcttcttatctcgttcttctgtctatcgtctgcgagaaaatttaattcctttaattaaagatttaggattatctttatctaaaaataccattgtaggtgacgaatatcgcattagatatctcatcgcatacctcactactaaatttggtattaaaatttacgatctgtctgctctagatattaagattattcgacaatttttatttgagagtggtactaatataagacctactacgcacctttctgatatctttgttttttttgatacgcttttcattttaacctgaaaacgtcaccatcataaagttaaaattccaaactccaaacttttctcttctcttaaaaaaatctttatttatgaggagctgaatacatgtgtaaaaagtatcgttcaaccttacttcaatgttatttttaattcagaagacatggattatatttttcttatctatcttacaagcgctaactcttttgctgctcaaaagtggactgaaacacatgtcgatgaagtgttagctatttttaaaagtcttcctaaattccaaatgctactacaacctttgaaagaagctcttccatactctgacacctactacgatgagctagtgaaagtcactatttacttttctcgaaacttcatagttggtctgaatcaattaattcctgaaacacttagttttccttcaacattctatcctggaaataatcctaaactaatatccattatcgaaccaatagtcactcattggctaactgaaattggagaatcaaagttcaaaaaaacgcacttcttcttgctctgtgctcaccttgaaagagtaataaagaatagcatgcctcctataaatattgtgttgctgacaactgattttattaataatgaaattttaaaagactatattttgcaatccctttcaacagataaaattagatttcattcctattacttattgacagataatattagtcaaatatcgaccttaaaacccgatttaattatcactaatcgaaaactgtttacctatgttacaaaggaactagctacaaatagtttagtcgctcatattgattacaacgatacaccctctcaaatcagtaatatccaaactattatttctaatattaaagaagaaaaatatcgaaaaatctttgataaaatataacatcacctactgtattcttttgatttcaattattaataaaacgactagagcacttcattaactactctagtcgttttattaattctgttcatcgtattaatcgattgcttttagttctaagataacatctcggatttgtgcagctagctcaaagtccaataattcagctgcttcttgcatttgctgttgaagagctttaatttcagcttgcctttcttttttagataaactactgtaatcgacaactttttcaggcttatcgctgtcattacttttagtaatagcaattaaatcacggatttcttttttaattgtttgtggcacaattccatgcttttcattataatccatttgtaaacgacgacggcgagcggtttcatccatagctctttgcatagaatctgttattttatcagcatacataataacatgaccattactgttacgtgctgcacgtccgattgtttggataagaccacgctcattacgaaggaaaccttccttatcagcatctaagattgcaacaagggaaacctcaggaacatctattccttcacgtaagagattaataccaattaaaacatcaaacacaccaagtcgtaaatcacgaataatctctgtacgttctaaggttttaatatcgctgtgcatatacttaactttaactcccatttctttgagataatctgttaagtcttctgccatacgctttgtcaatgttgtaataaaggtacgctcacctttttcagtcctcaaattgatttcaccaagcaagtcatccatctgccccatacttggtctaacttcaacttctggatcaagaagtcctgttggccggataatttgctcaacaactgtatctgtttgctccatttcatagtctcctggcgttgcagatacatagacaatttgatggacatggctttcgaattcttcacgacgaagtggacggttatctaaggcagatggtaaacggaaaccgtaattaaccaacatttctttacgcgaacggtctccattatacatccctttgatttgccccattgtcatgtgactctcatcaatcataatcaaaaaatcttctgggaagaaatctaacaaagtaaaaggtggctcaccttcacttctaccatccatgtgacgtgagtagttctcaacaccatttgtatatcccatttcacgaagcatttcaatatcatattctgtcctttgtcgaatacgttgcgcttcaatcaatttcccttctttttcaaaaagttctacttgattttccatttcagcttgtatttttgaaatagcttcttccatatgttcatcatttgtcataaagtgtgttgctgggaaaatagctaaatgttccacttctcctagcacacgccctgttaacgattctatttctcttatacgatcaatttcatcaccaaaaaattcaattcgaaaggcatgctcatcacgactcgcaggaaaaacttctacaacatcgccacgaacgcgaaattttccacgttgaaaatcaatatcgttacgctcaaattgaatatcaacgagattgttcaataactgatcacgtgaaatttcttgacctggcctaaggctaacaacactgtctgcatactctttaggagaacctaaaccgtaaatacaagaaacagatgctacaacaataacgtcatttctttctaataacgaagaagtcgctgagtgacgtaatttgtcaatttcgtcattgactgaactatctttttcaatataagtatccgaagaaggcacataagcttctggttgataataatcataatatgaaacaaagtactctacggcattgtcaggaaaaaattctttaaactctccataaagttgacctgctaaggttttattatgtgcaatcaccaaggttggcttgttaacttgggcgataacttggctcattgtgtaggttttaccagtaccagtagcaccttttaaaatctgagctttttctcctccttcaatattgtcaaccaacgtttcaatagcttgaggttgatctcccgaagggctatatttggaaactaatttaaatcggttagtatcttttctatctatcatttctttacctcgattactttattttaacatagaaaaaagaaaaagactgagctgcaacactcaatctgtttcttcagtcttaattagccatagaaggtatataattgctgctaagagaacaaaaatagaaatcaaacttccttctattccgaatgcaccacctgatatccagtccggtgcgttttctttaacggtaaaatgcaaaagagatgctcctgctttctgaccacttacggcaataccatagagattaccttggctaaaattccaagctccatgtaaggctgcaacactccaaatattaccacttttaatcatatacaaggacattaaaactcccgaacatataatacttacaatagaaagaaaagtgacatgggcatttaccaagtgcaaaatgccaaataaagtggatgagacccctatggcaacagctaaatgaaaacgatgattaattagaggaagaagccaccctcgtgttagcaattcttccgtaccgctttgaataagccaaaaaggaaggagagttacaacatagaaaatcgttgccttagaaacatcatagctatgaaagtcaagtcctcccaatatataagcagtgatgacagaaattgaaaatagaataaaacctatactccagccttttataagtgaccacagagttcttttaaactttgtagaaaaccccaattctgaaaaaggtcttttttctacgaattttacccagataagcaaaaggaatgctgaaaaactaaaggttcctaattctccatagatattattaaataaattaataaactcaaaaaaagtataggaagaaaacttatagagtacagaagacactagaacaattcccacaccacctagagttagaccaacgaaaaaaaataggtataccataaaacaagcaaataacaataatagccatgacggccagtttttatagacagcgaactgactatttaaaatccttttattcataataatcctaaatcctttttgtgtgataacactagaacgattatatcataatactaactaaagatatatataaaattaacataacatacatgttacgttttctaacatagaaatgacattttgttgctctatcttatttattttgatataataaaacacatatttataaaaaggagatttacatgaagcacaagttaaaagcttttacgcttgctttactctcaatattctttgtgtttggtggaaaggtcagtgcagagactgtgaatattgtttctgatacagcatacgctccattcgaatttaaagattctgatcaaacttataaaggaatcgatgttgacatcgttaacgaagtcgctaagcgtgctggctggaatgttaacatgacgtacccaggttttgatgccgcagttaacgctgttcaatctggacaggcagacgcgctaatggccggaactactgttactgaagcacgtaaaaaagtctttaatttctcagatacttattacgatacttccgttattctttatactaaaaataataataaagtcacaaactacaaacaactaaaaggaaaagtagtcggtgtaaaaaatggaacagctgctcaaagcttcttagaggaaaataaatctaaatacggctataaagttaaaacatttgatacaagtgacctaatgaataacagccttgattctggttctatttacgccgctatggacgatcaaccagttgtgcaatttgcgataaatcaaggaaaagcttacgccattaacatggaaggcgaggcagttggtagctttgcatttgctgtcaaaaaaggtagtggacacgataacctaattaaagaatttaacacagcttttgcacaaatgaaatcagatggcacttataatgacatcatggataaatggcttgggaaagacgctacaaaaacaagcggcaaagcaacaggtaatgccaatgaaaaagcaactcctgtaaagccaagttataaaattgtttctgattcttcattcgcaccattcgaatatcaaaacggtaaagggaaatatactggttttgatatggaattaatcaagaaaattgctaaacagcaaggttttaaacttgatatctcaaatccaggttttgatgccgctttaaatgctgtccaatctggacaagctgacggtgttattgcaggagctacaatcacagaagcacgccaaaaaatctttgatttttctgatccttattacacatctagcgttatcttagcggttaaaaaaggaagcaatgtcaaatcataccaagatttaaaaggaaaaacagttggtgctaaaaatggtactgcctcatatacttggttatcagaccacgcagataagtacaactatcatgttaaagcatttgatgaagcatctacaatgtatgatagtatgaactcaggttcaattgatgctctaatggatgacgaagcagttcttgcttacgctattaatcaaggtcgtaaatttgaaacacctatcaaaggtgaaaaatcaggcgatatcggatttgcagtgaaaaaaggggcaaatccagaattaattaaaatgtttaacaacggtcttgcttcactcaaaaaatcgggtgagtacgataaacttgttaaaaaatacctttccacagccagcacctcttcaaacgataaagctgctaaacctgtagatgaatcaactattttagggttaatttctaataactacaaacaattgctatctggtattggaactactttaagtttaactcttatctcatttgcgattgctatggttattggtattatctttggtatgatgagcgtatcaccaagtaatactctccgcacaatttcaatgatttttgttgatattgtccgtggtattccactcatgattgtggccgcttttattttctggggtattcctaatttaatcgaaagcatcacaggtcaccaaagtccaattaatgacttcgttgctgctactatcgctctttctttaaatggtggtgcgtacattgctgaaattgtacgtggtggtattgaagctgttccttctggtcaaatggaagcaagtcgtagtttaggtatttcttacggcaaaactatgcaaaaggttatcttgcctcaagcagtacgccttatgttaccaaactttatcaaccaatttgtcatctcattaaaggatacaacaattgtatcagcaatcggacttgtggaactcttccaaactggtaaaatcataattgcacgtaactatcaatcattccgtatgtatgctatccttgcaattatgtatcttgtaatcattacccttctcacccgtctagcaaaacgtttagaaaagaggcttaaataatggcagaattaaaaattgatgtccaagatttacacaagtcgtatgggcaaaatgaagttttaaaaggtattgatgctaaattttatgaaggtgatgttgtttgtattattggaccttctggttcaggaaaatcaactttccttcgcacattgaacttacttgaatcaatcacaagtggaaaagttgttgtggacggctttgagttatcaaacccaaaaacagacatagacaaagcacgtgaaaatatcggaatggtatttcaacacttcaatcttttcccacatatgtcagttcttgaaaacatcacttttgctcctatagaacttggtaaagaatctaaagaagcagctgaaaagcatgggatggaattacttgaaaaagttggtttagccgataaagctaatgccaaaccagatagtttatctggaggacaaaaacaacgtgtagctatcgcaagaagcttagcgatgaatccagatatcttactttttgacgaaccaacttctgcacttgatccagaaatggttggagatgttctcaatgttatgaaagatttagctgaacaaggtatgactatgttaattgtgacacacgaaatgggatttgctcgtcaagttgccaatcgtgttatctttacagatggtggtcgtttcctcgaagatgggacacctgagcaaatctttgatacacctcaacacccacgtctccaagacttccttaataaagttttaaacgtttaataaaaaagatgacttcgtgtcatctttttttatatcctaatcacaaacaaattataataggataagttttcttctaaaattagcaaaacatcagctagaatgtttgaataatgttgcacaagggctttcagtatgataatatagcagtatgaaagactatattaacagaatattgcactttattaaagaacatatgacttatcatgtcaactttatagatgactttttagatattaaatgggaaaaggtgagtaacatccatttaaggttttggacaactattattgcttatttagttatttttatcttaagtatctctaccgtaattcttaaccttgtacttctttttcaaggattcttaacgcaaaaccctattatttacttactattttttataactttagtttgtgctttttattttgcttataaatttattacttatactccaaccattgtaaaaaatgctcttcagtatatcaaaaagctcaaaaacgtttaaaataataaagtaatctgtaccttaacactctatcaattatgttttagagtcttttttcataccaaaataactaaaaaggatagttacttaactatcctttttcttttgctaatttttcgcgttctaaacgaagtttacgattaggatttaatgtgttaaagagttcttctaatttttcagcattccagacatcggccgctgaaacaaaattcccatctttatcacgaaatgatatcggtttatctcccataaaaaacctccaatcaagtactgcattaatctacaaattcaaattcgaagttacctatacgaacaatatctccatccttagctccgcgctctcgaagggcttcatcaacgcccataccacgtaactgacgagcaaatttcattattgattcatcgcgttccatatttgtcataacaaagagtttttctagcttatcaccatacaatacccacgttgcatcatcatcacgtgtaatctcaaatggacgttcatcttcgttaaatccatagtatgcttcatcttcttgcatgtcagtttcgtcataaagaagaaactcttctgtattggctaataattcagccgtcgcatccataaggttttctagtccttgatgtgctaaacttgaaattggaaaaatcataggcatgtcatcaaactcatcatagtttgctgctaatttttctttgaatgctgccaaattctcttctgaatcaggcatgtccattttattggcaacaataatttgcggacgttccatcaatcgaagattgtaagtttccaactcattattaattgaaacatagtcatcgtaagggtctcgtccttcacttgccgacatatcaataacatgtagaataacacgtgtacgctcaatatgtctaagaaactgagttcctaatccgacaccttgactagccccttcaatcaaaccaggaagatcagccattgcaaagctatcacctgattttgtacgaaccatccctaaattagggacaattgtcgtaaaatgataggcaccaattttaggctttgctgctgaaacaacactaagtagcgtcgacttcccaactgatgggaaaccaacgagaccaacatcagccaaaatttttaattctaattgtaattcacgttcttcaccaggctccccattttcagcaatttcaggagctggattacgtggggttgcaaagcgaatatttccacgaccaccgcggccacctctggctacaacgaattcctgatcatgctccacaaggtcggtaataaccttacctgtagtagcatcacgaacagttgttccaggtggtaatgacacaataaggtcttctgcacctcgaccgtgcatacctttagtcatccctttttcaccagcttttgctttaaaattacggttatatcgaaaatccatcaaagttcgtaaaccttcgtttactttaaaaatgaccgatccgcctttaccgccatcaccgccccacgggcctccattggggacatatttctcacggcgaaaagcaaccatgccatcaccaccgcgacctgccttaacactaattttggcagtatctaaaaacatactcatttctaaaattcctattctttattctattcagtataaaaaaacgctttacagcgtttctcattacatgattgcactaatagcaccaaataccaaaccaccaactgttactagtaccatcaaaataacaacaaaaagagttagtttttcaaacccagttttttttcgttgtccgttatctccaaaagccactcatgtcacctcatttactgaatatatagttaagtctatattaacacgaaacgtcttatttcgcaaactacaaaccgttagcttaaatatatctttattaaatcaatatatctttattaaatcgcttccatatttccttgtgctttataagagtttatgataaattataaaaaatagtaaatttaaaggagctagtatggttttacaagatttcgacaaccttttaaaaaaatatgcccaattaattatttctaaaggtttaaatgtccaaaaagggcacactctcgctttaacaatcgatgtggaacaagtccacttagcaaggcttttaactgaagccgcttatgaaaagggagcaagtgaagttattgttgattatacagatgattttatcacgcgccagcgactacttcatgcttcagacgaagttctcacgaatgttccacagtataccgttgataaatctttagcactattaaataagaaggctagtcgattagttgtgaaatcttctaaccctaacgctttcgctactgttgatcctaaacgtttatctgaaacaactagagcaaccgctattgccttagaggaacaaagtagagcaatacaagctaataaagtatcttggaacgtggctgcagctgctggtagagaatgggctgcacttgtcttcccagaattaaaaacaagcgaccaacaagttgatgctctttgggataccattttcaaattaaatcgtatttatgaagatgatcctattgctgcttgggacgcacatgaagctaaattattagaaaaagctactagactaaatcaagaacaatttgatgctcttcattataccgcaccaggtacagatttaacgcttggtatgcctaaaaatcatatttgggaggcagccggtagtctcaacgctcagggagagacttttatcgctaatatgcctactgaagaaatcttttcagcacctgattaccgtcgtgcagatgggtatgtgacaagtacaaaacctctcagttatgctggcgttattatcgaaaatatgacatttacctttaaagacggtaaaattatcaatgtcactgcagaaaaagggcaagaaacagtccaacgcttaatcgaggaaaatgatggggcaagatcgcttggggaagttgcacttgtcccacataaaacaccaatttcactatctggactgattttctttaatactttattcgatgaaaatgcctctaatcacctcgctattggaactgcatatgccttcaatgtagaaggaggaacagaaatgacaagtcaagaattggatgaagctggtttaaatcgttcttcaacacatgttgattttatgattggttcagaacaaatggatattgatggtattcgtgcagatggaactgctgtcccaatctttagaaatggcgaatgggctatttaaatataaaaaggaggttagtcctcctttttatatttaataaagtttcattttcttattgtaaaaacttaatgataacagaataatccctcccgtagatgctattacagtatctgagtggctatctcctgttttaggaagttcctttttaggcttactgtggccttttttcccatcatttgcttttgaagatgatgattcatcgcgatccacttcttcttgatcactacttgctttactaaaattcttaatactatcttctgaaattaatacttttgttccactagaaatatccttattattgccaatttctgtcttcgttctaccatcaggcttgttctcttcactaggtgagggttgcgatggttctgttgtaggtggattagttgacggatttgtttctggttcacttgatgaactcgattcattttcagaagaagaaccagtactagactggtctagttcatctgatcttttctcctcagataaggtcgtagtcacgacactcgtgtcagtattcttatcacttgtatcagcataaccgattgatgaataagtagcacatgttaagacagtaagtgctaccatcgttaaaatcttatttttcactttcatattatttcctattttataattccttacatcttcattataatttattacaacataaaaatcgaaaatatgatactaaaaagtgaaaaataggaattattttacattacaatcaacttttctgattcttttttgttacaaagctaaaacaagctaataaaagggttactactaaaactggagataggcttgattctgtatcacctgttttaggaagtgctttttgatatgccattacggatggtttatttttaacagacgatttcatccattttttagagatagatacttgagtaacttgtgaattttcttctaaatttactaatgatgaatgagctttaaagagggagttagtaggctgtattaggccagtagatggtttcacttctttatctattattctttgccatttaacattaaaaccatgatgtttttcaaagaaagttgcaaatttaattaataccatatcatagtttgcacctgccattaacatcgtccctatgggtaaaccagactcagataagtaagtcgggatactgatagctgggagtcctgtcatattagcaatttgtgtaaaaggtgttctacgcaacataggctcccactggcgattaaagagagcaattctttcttcttggctcaagttttccatattataaatcgctcttttatcttcctctgttacatatggatctgtatttagaggggctaaacttgcggtcgttggcgataagaaaataggaaattgcttgtgaagcttctccattgccttacgataatcatccatatgtttttgggcttccataatagatttcttaagttcagccttatctgaattttgataaataacatgaactgcccaagtaataggatcaacgtcttctttagtaaaaccatgtttttttaagtctttttcaattgttgaaaaagctcctcccatgccaatagccaaggttgaataatcacgcattaatgctctaccatcaattggtaagtctatctctgttactttgaatccttgttttcttaagaatgtgacgttgtccataatagcgtttttagcatcttgactaacttctgttcccattggtgatttcaaagtataagcaattggtaaagattttaaatcattaactgatactagcgtttgatcgcttttctttagataagttaataatgtttctgcgtctctagatgacttagttaatggaaaatgaactgctgtactatacgaatctggcttttcattactcaccaatcctcttgttggttttaaacctaccaagcccgtccaagaagatggaatacggatagaaccaccagcatcactaccgctagcaattggcgtcattccgctagcaatggctgctgcacttccaccagaagagccaccagcattatgagcaagatcccaaggattatgcgttagaccgtataatttagaatctgttatattacgccacccatactctggaaagttcgtttgtcctaaaataataaatcctaaatctttatattttttgacatagctactgtcaaatgtgctaatttttccatctgcatagatcaagccattattggtttcaccacctttaatactgtgccctaaccccttgactaacaagggaacacctaaaaacggctgattggtatctttaagttttctagcctcttcaatagcttcttggcgtctagtagtaatgactgcatttaaagatgggttttctttagcaataatatcgtatgccatattaacgagttcctcactagtaacttgaccacttctcaccatgttggctaaatcttgaccatctttttgtttgtaagtctcttcagttaacttagtagaagtactctcaacgacaggacttgattgagttgtttttaaagcatctggagctgaaatatgatgaggcgtgtcaactgttgtaagcgccgcagaattatctggttttacttgacctattacagattgtcctgattctgatacaaattttgcggtaggattactgtcattagtttgaacgatagtatttgtagtaggaactactgaagcacttgtctcagtactattagcatagatactgctagtattcattgcagcagctaacgttaaaaccgtcaccgtattaagaataaagtatttacgtttcatttgatcttccaatctaaaaaagtatacgtttacattataatctaagtgttatcaaattgctaaaatattaactgttgttttatattattgcatatatttttctaatttttctatttcttttattgttagccgtctccattgtccactttctagctgtttatctaattgtagatttcccatccttagacgctttagctctaagacttccttaccacacgcagcaaccatacgtttaacttgatggaattttccttccttaatggtgattttaacaagactctgcttcttcacctgatttacttccacaatttctaataatgctggtaaacaagtaaaatctttcagaataatccctttatcaaatgccaaaatatcgtcttctgtcattatccctgagatttttacctcatagcatttatcaacgtgttttttaggtgataacattttatgcgctaattccccattattagttaataacaaaaggcctgttgtatcaatatctaaacgccccactgggaaaacagctttatctcgagcagttttgtctagcaaatctaacacggttttatgcgaaggatcatccgttgctgatataacacctttgggtttatgaagcatataataaacaaacttttcatatgacactagagttccattatatttaatctcatctctatattcatctacctgtacttttggagatgtctcgctattaccattaacactaatctgcttttttttcaatattaatttgacttgagtacgtgaaccaagtccgcattctactaaaaatttatcaagtctcatttagatgttataacctctttcgataatgatatattgtaaaggatttttccatactcatcctttattactacttttctagtaatactatcattaatatattctcctcgtcaatggaggtcttaatggttttcttaactttaaggaactatcccacataaaaaagatggaaatacatttccatcttttcttattaaaatgagacattatctggatctttgggtttaatacctgaatctagttgtattaaggtagcaatatcatcttcgtttaattgaaaatcaaaaatatcaaggtttgcttcaatatttttgggagtcgctgacttaggtaatggtaaaaagccattatcaagtgaccagcgaagagctacttgcgcaactgatttaccatatttttcagcaatagcttttatagattcattttcaaaaatagcacctgttccaaatggactgtaagcttctaataagatatcatttcctttacagaagcgaaccaaatcctcttgagcacaacctggtgctaggataatttgattaaccataggttttatttcggcagtttcaaataaagcctctaagtgatgtttcatgaaattcgaaacaccaatagcttttacctttccttctttataagcttcttccatcgctttccaagtgcctgcattcccagctttccacgcatcattttcacgaagagcttttggatttggccaatgaatcaaaagaagatcaatataatcaacacctaatttctgcagagattcatcaatagaagctttggctaaatgatagtcatgtttgtcattccaaatcttagttgtcaaaaagatactttctcttgccaaaccactgtctcttatagcacgtccaacactatgttcattaccataaatctgagcagtatcaatatgagtataaccaacttttaaagcatgagtcactgccttataagcttcttcaccttcagttagttgccatgtcccaaaaccaattttaggaatgttaagagtattcgataaagtatatgtttccataacaatctccttttctatgtgacaaaaatgaatttcatagtgaaaaacatctattttaaacatctaaatgatagtttgatatatggtattatcccctccttatgtaaaattatataactttcttcatcaaaaccctatcattttgttcattccctttatttttctgacagtcattagaattttgtagctctactttgctacgatatcgcctgctgagattttttctaaattgtgatatgatagcattaataacaggaggatctaaaatgacaaaagaagatatcaaaaaacaagttcgaagagcttttgattttcgtatggcgattcgtgtttataataataatgatattcctaaagaagatatggagtatattttagatactgcttggttgagtccttcttcagtcggtttagaaggctggcgatttttggtactagatagacaaacaattgcaaaatttcgagataaacttaaggaagttgcttggggagcacaatatcaactagatactgctagtcactttgttttactactagctgaaaaaggtgcttattataacgctgatagcatgattaacagtctcattcgacgtggtctaggtgatccagctgcccttgagagtaggatacctctctacaaatccttccaagaaaacgatatgaaaattgattctgaacgttctctttgggattggacagcaaaacaaacttatatcgcactcggtaatatgatgacggctgctgctatgatcggcgtagattcatgcccaattgaaggatttgactatgaaaaggtcaataatatccttagtaaagaaggattaatagacgataagaaagaagctatttcttgtatggtttcatttggttatcgtttgcgtgaacctaaacattcccgtgctaggaaagaacgccaagaagtcattacttgggttgagtaaatagacagcctaatttataatcaatatttttgaaaagacaattttattttgacataatacgtctaataaagaaataggagagagactatgccatttttacatacttgtattcgcgttaaagatttggacgcctcaattgctttttatcaagaagcacttggttttaaggaagttcgtcgtaatgactttcctgaaaatcaatttactttagtctatatggccctagaggacgaccctagttacgaattagagttaacctataactatgatcacgaagcttatgatttaggaaatgggtatggtcatattgctgttggtgtagacgatttggaaactacttatgatgcccatcagaaagcaggttactctgtaacaaaaatttctggattaccaggtaaacctaatatgttctactttattcaagatccagatggctataaaattgaagttattcgactcagtcaatttaaagctgactaataacatctcatcatattaagttaaggactgaggcaaaaacctagtcctttttatgattaccttataatctttctattttttcccatattatgttaaaatttaagcaagaatgatacggagaattacaaatggctttattatcagttattgtcccttgttataatgaacaagagactgtctcaacttttttaacagaaatcaaaaaagttgaatccgaaatggctcgttacacccattttgaatacattttcgtaaacgatggttctactgatcgtacactcgaacttcttaagaaagcagctaaacaatttgacaatgttcattacctttcattttcacgccattttggtaaagatgctgctttattggctggtttagaacatactactggtgattttatcactgttatggatgttgacttgcaagatccacccactttattaccagaaatgtacctaaaacttcaagaaggttatgatattgtcgctacaaggcgaaaagatcgtaaaggggagccgttgatacgctctctttttgccaagcttttttataaattaatcaatcaagtgtcagatactaaaatggttgatggtgcgcgtgattttcgtctcatgacaaaacaagttgttgacagtattctcgagctaaatgaagtgaatcgcttctcaaaagggattttttcctggattggatatgatgtcgcttatattagttatgagaatcgagaacgaattgcgggtaagacctcatggagtttctttaatctcttaaaatactctctagacggtttcatcaacttctcagaaattccattagctatagctacctggattggaacccttagttcagtactatcacttttagctatcatttttattataattcgaaaattactatttggggatcccgtttcaggttgggcaagcacagttaccattgtactttttatgggtggtattcagttattgtcgctaggaattataggcaaatacatctctaagattttcctagaaactaaaaaacgcccagtctatattgtcaaggaagagggatgaattgaaatctcttagctcacttagctaggagattttatcatagaaaaatattgtatagtaattattgcgaattttgcaaaaaaattatataataaaggagtttttcaaaaatagatggagtatttataatgtcaaaaaataataatgaccacactcaaaaatctgagaatggtatggtacgcggcctagaaaatcgtcacgtacagttaattgcgattgcagggacaatcggaactgggctttttcttggtgcaggtcgttcaattagcctgacgggtccttcaatagttcttgtctatgctatcactggcgctttcatgttcttcatgatgcgtgctattggagagatgctttatcaagatccaaatcagcatacttttattaatttcattaccaaatatttaggacccggttggggatttttctcaacactttcttattggatttccctaatatttatcggtatggcagagattacagccgtaggagagtatgttcaattttggttccctgaatggccatcctggattatccaaattgtttttttagctatcctaagttctatcaacttaattgctgtaaaagcattcggagaaaccgagttttggtttgctatgataaaagttattgcaattcttggtttaatagcaaccggtatctttatggtattgacaaactttgacaccggtcacggataccatgcttcaatctcaaatatcaccaatcattttgaatggttccctaaaggtaaattgaatttcttcatggctttccaaatggtattctttgcttatttagctattgaatttgtcggagtaacaacttctgaaacagctaatccacgtaaagttttaccaaaagcaatccaagaaattccgatgcgtattattttattctacgcaggttcattattagcaattatggccatcttcccatggcaacagttaccagttaatgagtcacctttcgttacagtattcaaactagctgggattaagtgggctgccgctttgattaactttgttgtcctaacgtctgcagcatctgctcttaattctactttgtactcaacagggcgtcatttattccaattggctaatgaatcaccaaatgctcttacaaaagcgttaaaattagaccaattatctcgtcaaagcgttccaagtcgagctattattgcatcagctgtaatcgttggagcttcagcacttatcagtgttttacctggtatttcagatgccttctccttaattactgcatcatcttctggtgtttacatttctatctatgttcttattatgattgcacattggaaatatcgtaaatcacctgattttatggaagatggttataaaatgcctgcctacaaaatcctttcaccaatcacacttctcttcttcctctttgtattcgtttctctcttcttgcaagattcaacatacatcggggctattggagcaaccatctggattattggatttggtttatatagtcacttcaaacataaatcacattaagtctatattattagtgaagttggtcaatcaacttcacttttttcgtccaaaaaaggttaggcaattgcctaaccttttgataatcatcgtgaattatagttttttaactgacgggcaatatcacggttttgctcacgacgtttgatagactctcgcttatcataatcatgttttccttttgccaaacccaatagaactttagcaaaaccatcttttaagtaaacttttagaggtaccagagtcataccagtccctttcagttcatttgatattttttcaatctcacgtttttttagtaataactttcgtgtacgatcaggatcttgattccatatgttaccttgatcatatggtgtaatatgaacattaatcaaccacgcttcaccattttttatttgtgcatatccatctttcaatgtaatacgcgctgcgcggacacttttgatttctgttcctgtcaaaacaattcctgcttctattgtttcaacgatagtatagtcgtgatgcgcttttttattttgtgctacaacgtttccttgacctttaaccatacttaacctttcttagatttccgtttctgacctttcttagcaacgcctttatagaaaggttttttcgtttttttcttggttgaacctgttgttctatcgtctttatgatgatgtgatttgctatccgagttccttttgggttttcgagatgcttttttcttagatgtatttttattcttattatcacgatcagaaattctatgctgatgttctcgtttagaacttctattaggacgaccctcacgcgaacttttacttaccttttcaacaatatcaaaatctgatggtaaataatcaaaatcgatatcaccagtttccttatcagaacgaatcaacttaaccttaatttgttgaccaacacggaaaactttcccagatttctcaccttgaagcgtcagcgtacgttcattaaagtgataatattcaggcaaggtcgttacgtgaatcaatccttcaatagtatttggtaattctacaaacataccaaatttaacaacgcttgcaaccacaccttcaaattcctcaccaacatattcttccatatattcggctttcttcattgcctctacaatacgttcagcatcaatggcacgtctctcaagactagacgtttgagttgcaatttctgggataaggttagcaaaatgatcagctttatccatcgctttatcatcataatcacgaatcatacgatgaactaacaagtctggataacgtcgaatggggctagtaaagtgagtgtaatattccgcagcaagtccataatgtccatggttgtgttcagaatatctagcttgttgcatcgagcgcaataacatcatagataacacttcacttcctggctgcccttgtacttttttcataaagtcctgtaaagcagattgggtgattttagttgctgttccttgaatctgaacaccgaaaacagaagcataatcgatgaatttttgtaatttttcagctttaggctcttcgtgtatacgataaataaatggcagttttagacgagcataatgttcagcaaccgtttcatttgccgccaacataaatgactcaatcatgcgttcagcaatgcctctgttgcgaataacaatatcaactggcattcccttatcattaaccataatttttgcttcagatgtgtcaaaattcagcgctccacgacgcgtacgcatagcttccaaagtatggtgtaaagtgaccatatgctgtactgaggacacaatagactcatattctgagcagatttcctcatcgccagcaataatatcatttacagcggtataagtcatacgataagtggtattaatcactgactgtgtaatttgatgattaacaactctcccattttggtcaatttccataatacaagactgcgttaaacgatcaagatttggatttaatgaacatataccgttagatagacgctctggtaacattggtacaacgcgatctgtgacatatacggacgtaccacgactaagtgcttcacgatttaaggcagagccttcagtaacgtagtatgatacatctgcgatatgaactccaagttcaaaatgaccattatccagtaatttaatatgcacagcatcgtctaaatctttggcgtccgctccatcaatagtgaaagtgacctcttgacgtaaatcaacacgcccaattaaatctttctccgttggagcatctgggatagcattggcttctgcaataacgtcctcaggaaattctgagacgatatccatactttccaagacttctaaaacatcaataccaacatctccttgatgtccaacgatatcacgaacacttgctacgaagtaatcatgtcctcgtgtcggatatttatcaatatctactttgataatttctgttccgtctaaaacgaccggttctttgcgtatataaatcttttgattgattttttgatttttcgatttgatatatcctgcgtatttagggcgctcatcgtctaagacaaacttaccaacaagcgtctttaaactacgttcaacaatattaacaacacgcgcttctgctgcagtcccgttaagacggtccgctggtttctttacaacagcttctaccgtgtcaccatcaatagcataagcaatatcgttttttccgataaacatatcatcttcgtcttggtcaatactaagaaaaccaaatcctgctttatttgctctaaaaagaccccttactgtgatttcctttttcttagcttctttcttttgaagagaaagacttccattatcgtcaaatcttaattgcctgtggctctccaaatttgagattgttttgattaattttggaaatgcttttgcgcctgccatatctagggcagcagctaaatcattaacgctggttttaccgtgttcttccaaatattttataattttttctttcattatttccttttctagtaactttagtcactttattattactctacaaccattctactaacaaaaagtgaggttgggctatcccccatcctcacttatctgtatttagctatcattaatgacttgataaaatagataatactaagccgattagtagccagaaaaagactaaaacacctgtaaaacgttgcataaaagcttcaaatcctcgagctttactacgttcaaaaagggcttcagaaccgctactatcaaaaacattactacttggattcttttgtggttgcatgaaaattgagataatcaataatactgataaaacaagtagaatggtgagtaataggttatacatgttaattcctccactatggtcaaagtacattctaacataaaacttattaagattcaatatgtagtgttacttttctctcctttgggcaatactttggaacctcgattttatcgggatgattacttttattcttactggttaaataattcttactaccacaagagctacactttaaattaattttaactctcacacaatttccttaactctaatatattttctaaaattaataaaacaccaaacaaaattagctaaaacgatgaagctagtcacaaagaaaacccatcggaatcctaaatgaatagaaactgctgaaccgacaaaaggacctaatacttgtcctaaattgctaaacatttggttataactgaaaatccttgataaaccttgtcttggagcaattttagtcaagattgaattaatactcggcatcaaggcacctgttccaaaaccatacaggaatctaataacccctagctgtaatgaagtctgtgccaatgaacataagacatacatgaggaaactatacagtagagctaataatagcaaacgatgattgcctatgcgatccccgattcttcctagctttggactactcagaatactagagaatcccataccagaaacaattaatccggaaacaaacatcaagttttcagtctgtcctaaatgacgaatgtaaagtgttaaaataggtgcaattgattgtgcagaaatttgaataatcatgcttgttacaaacagccctattaaaatttgtaagcttttaacgcttttgaacacttctgtagttggcatggtttcttcgttagaaatgggtttgaaatcttcctttaccataaaaatggtcattaaagtagatattaacaatatggttcccactaataaaaaaacttccctaataccaaaccactctgctaaaagtccccctaaaagtggaccaattaacatacctccagtcactcctgtcgctaaggttcctaaggcatatcctgattcctcttgaggagcttgacttgctatcaaagctgtagagttaggtacatagcctgcaaaaatgccgtttaatatacgtaaaatcagaagtcctgtaacactatgaatgaaagcaagacctcccatagtaaaagtcatcatcaaccctgctcttaccatcatcggttttctaccatatttatcagctaagcgcccccataatggggcaactaaagctgaagacaaggctgataaggatactgataggcctgcataccactctactttgttgctaggtgctcctaattgttctacatataataccataaaaggcataacaagtgaaaagcttgccccagtaaaaaaattaccgagccaagccacttttaaattttgcttccagttaaccgtttcaactgagataaaacatcatcttctttctaaacttttctaccactaactatcttagcagttttattgagatttaacatctatttgagatgttatttccattataatttcctttatgtaactaaacctatgttatcacatgcctctgttattataccacaattaaaattaactttttaaacggaaagtttttggagcaaatactacaactgctaaatagccaataattaaaataacaactataattcctaggcttactaataatattggcatcgttatagatttagtaaaggtaaatagcttatatcccatatagtatataataaaggttaaaatattatacatagcactctttgattttaatccttctgtaaaaggctgtaagaagaaataaagatacaaaaagtaaaaactaaataaaatcattgatatagcttgtgtaattactaatatgataatctgatcaatcttaggggtgaaaaaattaaaataataggttccaaaacatatgtttaaagctacaaaaatggggaaattaagttttatactataaaggaaacgtatttttaaggttgctaagatattttctctttcacgatagaaattatatcttaataatggacgatccaaatgatagaaacaaaattttgaataggattcaccgatatatattagatatcctggaactgcactcaaaaataggaattttgaaaaactatgctcattcatcggaatatttatcttttctttaaaaaatagcaggaaaaggagttctattccaaacagaacacttaaaacagctaaacgtaccaaaattttcctttgcaagtatatactcatccgttttaaaaagatagcgtttaaatatgaaatacctgataaattttcaaatagcaggggagaaagttcactgacatttatatccctatctttcatttcaatcccaagcagctctatattatcaatctttgcaattttctccttcatcgtctcatgcgttagggtaaggtaggtcaagtggttaagtttagaataagtttttaatcgatagtaactaactaaccatatgataagtcctgcaataccggtgtaccatgaaaaaaatggatatggagagaactgtttgccaagaagaaggaaaaagagagaaaggaagactcctataccaatccctaagtaaaataaaatatttagtaaagactctggattctcttggtctttacctctaccatataaaggtaaacagagcaccttgattccaaggcgactacctgctaaaaataaagcaaaagtcaaaccatgccaaaaagcaaagtgatttaaatggaaaaatatgccaaagctcaaacttctaaaaaatagttcactactggcttctaaaagttcagcggattggaaatacctcgatggctcaattctgaaaaggcgaatcatatgagtttgttgcatatcattaggttctataagttttatatagaaatttatgacaattaaaagagaggtaatcaccatcaatgttaaagttagggtaaaaccttcttgcggtaaaatatttaactgcttcatgccacttctaacaaaaaatgataaaacataacaatatagtacgtaacctatggaacgaccaaaacctcttaagaaaaagaaaatgatacgaataaatagtactacaccttttatatcatcggttttaaaccatcggttagggatttttcttcccaaccaggggattttctgaaggtaatataaaaaactattataagctctagcactatcaatctgtaatatagaccatattaatgctttacttgtcatattcatctcccttcaacacttgaagaagacgctcttcgaattgttcatgtttacgatcaatatctaatgtttggagttttcctttgtctaatacagccacaatatcacatagatcttctgctaaggccattatatgagttgataatataataatatgatcctcacttaattccaacaaaaggcgttttattgcaatacttgatacaacatcaactgcagtcagtggctcatctagtaaaattacttttggcttagaaatcatcaggcaaattaatgagagcttactcttcattccatcagaatatcctttgataattctatgacgctctgtttgtcctatttccataaaatctaaataatcatctattgtcattaaatcatctgaaggatgtaaatccatgtaaaattttacaaattcataccctgttaaaaattctggaaggtagttttcggaataaacaataccaatatccttatcggtaagaggatactcgtgattatccttcaataaacaaatggtcccgttgtcagctgcaagatccccataaagtatattaaataaagttgttttcccagcaccattcctacctaagacccctgttattttacctgaataaaatcggtaacttgctcctctcaagacctctgtttcctgaaaccgcttacgaatatctctaattactaactccataaaaactcctttgaaagtaaaccttttatatcattgtactattactgtggtttaatcgcaagttttttaaaactagtgtaataaagacaaaaaatggataaatacattatccatttagtagttctataaacgttgaagagcatccaatatttgctcttttaaagttattaaatcaccattattgtcaataataagactagcgaaactttttttatctgttaaaggcatttggtgtgaaagtcgtaattctgcttcttctcgactgtagttgttacgggccattaatcgttgtaattgtttttctttatcaacaaataccaaccaaatctcatcaaaccattttatatacttttcttcaatcaataaaggaatatccatgaaaaatatctcttctgtttgttttaattggtcgcgctgacatgctaactcttgacgaatgatactattttgtagcctagctgatgtcttcatattgtctggattagcaaaaatcatttgagaaagctttggtctatccaactcaccatcagcatcaagtatctcgggacccaaccattctaataaagcttggtaaagtttcccacccttagcttgcaatttatgaaccacttgatccgcatctatgactttaaaacctgattctcgtattatttttgttaccgttgactttccagaagctatccctcctgtcagtcctattatttttgtcataagcattgacaccgagggcaataatgcgtccctctccctcctacttttatcttcttaattaaacaaccacaccttggacacggttgcccagttttaccatagacctgtaaatacttttgcatcgtaccgtcctctccaagagcattcttatatgttctaatcgtggagccacctttttcgatgcctaaagttaaaatgcgaataatttccttgtgtaataagcttgtttcagattcggtcaattgattagccaaacgctgtgggtgaatttttgctgcccacaagacttcatctacgtaaatatttccaagtcctgctactaatctctgatctaatagtaaaggttttattggctttttggagtttgctaagccttttgaaaaaggctcaaattgaaatgtgtcagcagttggctcaggacctaattttttttgagtaaaataatctttgagagatgatttacgaaccaactcaaatgtcccaaatttacggacatcttggtaaaccaatgtgctgccattagtcaatttgaaataaaggtgaaaatgtttgttatctggtactttatttgggaagagtagatattttccttccatgcgtaaatgtgataccataaccatttcaccaaaatcaaaaagaagatacttccctcgtctcaatacctgttgaattgtttttcctggtagacttatcataaagtcattcaaatcagttttcaccattttagggactttaatcgttatagaagctatttcttgattaactacaagtctttctagtccttttctaacggtttctacttctggtaattctggcataaatatatagtctaaaaatcaatagtcattgcttagagcaataatttccaaacgttcttgatgtcacctgaccattcgatttctattttcctttcttattatcattttgagacaaaagctttaaaaattactcataaacttgcactcattagcattctttattattgccaagtactttttgacaataatgttcattataagtattgtaaaatgaatcttcacctaaatatttaaaaatctgtaaagctttcctcatatcttcttttcctgaagaagtatcaccaagttttaaatgatagtatccagttacatataagaaaacagttttttcatagaaattaacttcatcctgtaacaatgatctaaccttatcaattaagtagtggctatgctcaaagtaagagtgatcaatgctgatgattagacaattaattgctaattgtgtaactaggattttattggttttattttgttctgaataagcaaacgaattaaccatttctttggtcaataaaaataaagtattgtaattaatgagacgtgagcaatttcctaagagaataatttcataatatccccactgctccaccgtaaaaagatagtctgttaagcgtgctaattcttcttgattaggctctattgattgatcaattgaaaaaataagagccttaatcataatcttttcatagtctttatggttatgatcctctaagagagccactaatttagttacatttttttcagcacaatattttcttactcgatttaaaaggataaaaaaatgagtgtgcgccttagaatgaatcgacacaaattcatcaatagtgatgttgagtttgtctaaaatattaagcaaacgactacaagtaatttctgactctcctctctcaaaccttgagatttgtgacttggataggtgctcatctgctaaagaagaaatactaactttttttcctttacgtaatcttcttagtgtttttcctaattctttttccatttttcccactttcacaacaatttaaaagaccctttaaatccattatataatacaagtacaaaatagaaaatcagaaaggagatagtcatgaaaaaaattaacaaagctttgttgttcacattaatcatggatatcctaattatcgttggtggataaaactccccacaaatggttgttatggaatcccattttatttagtttataacaggagaactaatgaagattaaaaaaattattagtggccttgccgcagctttaattatcagttcactatcaactattaactatgaggttaaagctgatgacaccaccagtgagtatcactatatcagtaagcaaaataatgaagagcagcttattagttacatcaaggaacaacatcgtttgctcaatcaatttgttgttgataatgtcaactcattcactcaactaaatgctaatccaactattgaacagttaaatagagctataacattatttaaacaaaaagatgagcaattatttaaccaggtgaaagctggtcatctctctcccagtaactataatgctatcgttaatcaacgtaatgtcattaaccaaactgttcaaaatctgattgaccaaaatcataataagcttcagacaagtcaaaataaagcagctcagctcgtggggcaacgtaatcaggttgttaacaaaattcaagctattttagcaactgtaaactacaactctgtgaattctatacaagaagctgaaaatttatttcattcactcagaaatcaaattgaacctcttgtagctgaagttaataattacaaagctgctatggcaatccttcaacaagaagtagatgccctatcaacagcggctattgaaactgagacttctaaacttgctactctcaaagttagcgaaaatacttctgttcctgcaaacaaagtagaagaaaaaactactcaatcagaagcgtcaggcaataaacaagaagtaactaagagtgaggaaaaacaggctacctctgatgcaaaggcatcacagcctgagtcagctaatattgccgattacgatagtttaaaagaagttttacgaaataatattagcaaccaagtaccacacatcagtgttcaaatggagtttaaaactcaagaacaagttgacgaataccaaaaaaatctcggaagcatcatccgggaaattggagatacacttggaacagcaactgaattcaatgccaaaagtaacattagcacttatactcttggtggacaaatccaacgcattattgtaaaaagcgacatcacaatcacctatactcttaaaggtgacatggtaggattacataaagaatataaacagtttgtagattcttttgtcaaagaaaatattactaacaaaaatatcacaagtgattatgaaaaagctaaagtaattcatgaccacttggttaataattacacttacgcgactgaagaactggcaaccactcgtgaaactgctagtggtatcagtatccatgctcctgaagcactctacaaagataaacgtggtgtttgtcaagcctttgcagtaatgtttaaagatatggctgctactgctggcttatcagtatggtatgtaactggtcaagctggaggtggaaatcacgcttggaacattgttactattaatggcgttaaatattatgttgatacaacatgggataataatataaaaagcaataaatatttccttgttggtaaaacaataatggatgctgatcatcttttggatagtcaatacaatgcattagctaaagatattccagctgatcgccatcaaggtgcataactcaaaaattgtattgagcctggaaaggatatgaaatgtctaaaaagactgattcaaattatctacattccaattgttctgacaagaaaatttggagcgatgaggcgcctctgcaacaggagactatccctaaagacagagattgtgttatcaaacctgtcattactatgacagttgaacatgtggaaatcccattagatgaccaatcttagctctctcctaaaataaaaaggaacactgccatttttgacagtgttcctttttatttaaccaaagtggttttctcattactgatatgattcaaatcatctacaactaattgatcaatcgatttcatggtgtatttccaagcttgcagttgaacatgaaaaacagtctgttggtacatggtatcatgcatatcgtcaatgactttgaaataccttatataatctggtttaatcattaggaacagcatgatcatgagtggtcaaagagctaccagcaccatccagagcgatataaatatctttcatcatatagaagctatttgtataagtaaatctaacagtattgggctccccgcaatacaaaatcacttgggacagctgatccaaagagaacgtctgggtcttttcttctcgataacctattccaaagctcccacttgaagtacttactgaatctgttgcaacagaaaaacaatccctactactagaataatagcacctctaactaataaatgactcattccaacattaacatcttttaacatcatgttcctttcattattttttatttaggaattcgtcatactatattttctcatatttatctaacaaaaaactcgtaattctatataaatcatataaagttacgaactttatttagttaacaataaaataataacattttattcattaaaaaaacgaataacaaaagagccaaaaagctcttttaaactgacaaaaatgtcttagtaatgtgattagtctctcaatcttattacttagagtaaatcaagcaaaaatgttagaaaataaaaaatatatgacaaactattccaaacaatatgctcgccaatcgaataatgaatggattttgtatagtggtgcaaactagcgaaaatcaaacccataccaaaatagacaacaaagtcgacgacagatagaccatgtaagtgagaccagctaaatagtatagaagataagatcacaaccaagggaccactcagggagttcccaaatgttctcatgacaaacaacctgaacgttatctcttcttaaattggggcaataagacagatagtcaataataagacaactcgaaagtagtgattgacctgattcatatcagctattaatccctcctggttttgccttattgggaaaaatgtttttactagtagtgcccagcaaaataaaacgctaaaagcacctattgcaaatagccattttttgaggttagatgatgactcttggtagttactgattggctcagtttttgttagcacataactcaacagaatcatcattataagattaatgccaatccatatactccaactccactctaaccctattgatagtaaactaatcacccaatgcccaagcaattgttattattgtgttgttgcaactttggcaaagatgaatatagcaggatggaaaacagattgtttctgaaacttcaaaggtatcttcttatcacaagctattatttggttatctccataattaatctaaatggagcaatatatcgtttttctactaactgttgacaaataaaaaactcccctttaaagtctggtaacttttcgatttttaccaaaaacttaaggagagtgaggcaagaactaatagaatcttatttaaagttttatgattgggagaacagaacaactatcataattactgaaaaattatgaaaggcatggcaaacaacagatggtcaaatccgctctgttgaaaacaaattttaaatataattcatttcactttctaagtttattaaacatagagtgttcaggagaaatgatacgacctaatgataaaatcattcctatcgtataataaacaacgacaaggtgtaaataaaagtaaattaatatatctgatatacttgtcaaacatcctttcattataataaaagcaactaagataggaataagaatagtacacttaataaataaccaaaattgcttaacaacttgataccatgtgagtacttctgtcgtttgtctttgtttgaagacaaaaaccaatagatcaaagagaaaactccaacagataagtagtatatttttcattaatgttaaatcgtagaaactacctatactaaatagaatcactgcagaaataataacaatgcctaaaaatcttaatatattatgcatatcctcacctcctctactttataggtagcaaatataatcttgagtcatgtgctctcctttatttaagaaggggccaacaagcatgtttggctccctttaattaatttgtgaatataatctcaaaattatgactagttggttttatcctcgtgaattgctttttctgtgcgaatcaagtctcacggtgaacttatctaactcttccccactaacttgcggatctcaaaataaactcattaatactctttttcattatagccaaaatcagctaaatcaagctttttatcacgccagtttttcttgacttttacccaagtctctaggtaaactttatcacctaacataagttcaatatcacggcgcgccatttttcctattttcttgagcatagcaccttgttttccaatgataatgcctttttgactatcacgttcaaccatgatagttgcacgaatatgcactttatcagtttcttcatcacgtttcatggattcgacaacaacagctactgagtgaggaacctcttgttgcgttaaatgaagtaccttctcacgaaccatttctgatactaaaaatcgttccggatgatcagtaatctgatcttctgggaaatattggaaaccttcttcaagattatcagtcaataacttgattagggttggcacattatttccttgaagggcagaaattggcactacttctttaaaatccatttgactacggaagtcatcaatctgttccaaaagttggtctggatgaaccttatcaattttgttgattactaaaataacaggaatcttggcagccttaagacgttcaataatcatatcatcgcctttgcctcgcttttcatcggcaggaaccatgaaaagaactgtttcaacttcacgtaaagtactataagcagattcaaccataaaatcaccaagggcggtctttggtttatgaattcctggggtatcaatgaaaacaatttgctcagtttctgttgtataaatccccataattttattacgtgttgtttgagctttatcactcatgatagcaattttttgtcccataacatggtttaggaaggttgattttccaacatttggacgacctaaaattgctacaaatcctgacttaaatgtcatttcttttctttctccattcaatttattcgtaatacttctcatcataaaagtaaagcaagtatcttgggtataaaaataatcaatcccaccaatacggcaaataaggaaacaactaaaaccgctcctgctgccatatctttagcatttttagccagcatcgagaaatggtaattacttgccaaatcaactacattttcaatagctgaattgataatttcaaaagtaattaccaaaaaaatactcaataaaagaaataaccactccaccatagatacttggaaagtaagaccagcaagtattactaaaatggcagaaaccaaatgcttacgcatatttctttcttctttaaaagctgtaaaaatccctgtaacagcaaattccatgcttgatgttaaggtgcgatttttccattttttgtgattattgtcgtttaagtccataagcagttaaaatttcttcctgtaagctgaacatctctttttcttcttcgggtgtataatgatcataaccgttaatatgcaaaaaaccatgtacagctaaaaaacccatttcacgttcataagagtgaccgtactcttctgcttgttctttagctttatcaatagaaataaaaagttcaccaatataagaatcaaaatcttctagcatctcagcaagttcaggattttcagccagatcttcttcatcaaaagaaatatcaacctcaggcttatattctaaactgataacatcagtcggacgatcggtatctcgatactctaaattcaattcatggctacgttcattagtgacaaacgttacagccatttctttattctctttacctgttttttgtgctgcaaactctaacaaatcaagagtttgctttttgatatcttctgaaacttgtccagtttcatcaatcatttcaacgtacatcttatatagtaagaacgacccaaaacgtttagaaaagataaagtgtaatgcataattctaaataatcgacacatctactttcctaagtttttcacttttatctaaaactagttctcaaaataaaagtgcgttctcttccttccttcaagctattctttcacatcattataccataagagtattaaaaaagggagagaaagctaataatcactattacacacttataatccatttcaataaaattctgacttatgaattagtatttacttcaaaatacaaactttagagcgcctaacttacgtaaaactaattcctaaataaacaaagctacaaatgctataacgattatgacaaatttacatttagaatgtctctttatataaatagatttttgttactttttctcagatgctttatattcgtacacacctaaacaattattaaatttacgaattgttggaagtaaagagcgaagtgtgcctaactcaaatttgctcatctcatctgtaaagttaatcagatttatttgctttaatttagggtctaaatccacaatctcatgaccatctgtgataccaaactgaaattctgtatccatatactttactgtatcatgttgctttcctttattaatcatttccttatgacacaaatcaaattgtgccataaattggctaaatgaatttgtcaggatatgaagaaaagtctctacgtcatcttcttttagaaacattaaaacaccttctgacacgattagaaaaggggcattttggggatttacctcccgtgtccaagtttcatctagggctgattttgctatattagtaactctttcatgctcttcaaaaaataattttcttatctccataacctctggcaaatcaaggttataccacctaatttgtccattatcgactctttcaaaccttgtatcaagtccacaaccaattgaaaggatttgactatttggattttctctaataaattttttgatttctctatccataacgcgaattctagctaatgttgcataaaaagaagcttctgaattatcgaatttatcaaaatcatattctatctgttcaacaattgctaaggatttttgatcattaagtatcggatgtttagccatcgcatctttagccctaatatataaggtgattaataacgtttcagcaacgccgtgtaatgttatcttcattcatctactctcctttatgctattttacttagaaatttggatttctaaaactggatttctttaagtatatcattccaataccgtaagtaaagcatatccccaccatcaaatattccataattttctttttctgtacttcttatgctttctaaaaaaacagtcactaaattattgcaagctactgtttttctttttaataattataaaatatacaaatgagaactccttattttcttaacatttgtttctacaagaatgcctaacaacatatcaataaaagttagaagttctttaaagtcacacctagtatttcccatccttttaacgccccatttggaatgtttgtgaaaaatattcatctaaaattaattggtgttgttcatttacgatcgtaatatttttgacgtcttctttagaaaaatagtccaattgcaatgtttcctcattatgaaaaccttctatattaactggttttggacagcttacttcataaataaaaccgacggtttgtgctttatcgccattgggataagagtcttgaaagttagtataaacatttaacagtctgattggttccactctcaatccagtttcttcgaaaaattctcttttcaatgtatctactgatgactcacctaactccatacatccaccaataattccccaagaattcttatcagctcttaattggagtaagacacgtcccttaccatctgtcaaaataccaccagaatatgttaaaaagatagtctcatgtccaacttttgacctaatgtaggaaatataatcttgtttcattctatcaccttgtttaaactaatatgtacgtattgtagcataaaatatctccttttcaaatcactcatatacacttcttgaatattagaaccgttacctcttttattaacttactattaattattgactaaaaagagatagccctgtagaatggagacacatcaatattttacatttttaggagagcatttatggaccatttcacaaaactctggcaagatttctctaaacttccaaatgttgttgctatagcactcggaggctcacgctctggtgacagttttgaccaatcttccgattatgatttgtatgtttattgtgcagcaactcctgatatcactagtcgtaaacgtatccttaacaagcactgtcattacattgaacttaacaatcattactgggagcttgaagataatggtactttaaacgacggaactgatattgatattctctatcgtaacatagataactttttatcagacttagaagatgtcgttgaacaccacaattctcgaattggatacactacttgtttttggcataacctcatcaattgccaaatactctatgatcctgaaaatcaattacaatcactcaaagagagattcgaagtttcttatcccagtcagttacaaaaacaaattatcattcaaaatcgtaacttattaactggcaagcttccctcttacgataaacaaattataaaagcccttaaacgccaagactttgttagtactcaccatagaactactgctttcttagattcctactttgatattatttttgcacttaataagttgacacatcctggcgaaaaaagaatgatttcctatgctaagaagaatgctacattgcttcctaaacatttcgaagaaaatatcattaaactatgtcatcacaactccaacgaacacactgttaaagaaacattaaacgatataataatgcatctcgacgtcatgcttaaagaaaattttcaacactttataggttaagttgaagtacaccatcataaaaacgcctaaagcattaggcgttttttacatattgacacactctctaacaacgtctcctagtggcaaacatcagtccttatcagattgtagcttgtgactactttctgaatctgaataagcatttattatttcagcaacgacagggtgtcttacaacatcctttgctgataaatgaataaagtcaatctttttgatatttcgtaatttctcaacagcatcaatcaaaccagatttaacattctttggtaagtcaatttggctaacatcgccatttacaatcattttagaattgaagccaagacgtgttaggaacattttcatttgcattatagtggtgttttgcgcttcatctaatatgacaaatgcatcatctaaagtacgaccacgcatgtaagccaatggagcaatttcgatgatttcacgctccattaagcgacttgtttgctctttacctaaaatttgatatagggcatcataaactggtctcaaataaggatcaactttctctttgagatctccaggcaagaaaccaaggctttcaccagcttcaaccgctggtctcgttaagattattcgtttaacttgaccacgctttagtgccgttactgctagagtgactgctaaaaaagtttttcccgttccagcaggcccaataccaaaaacaacatcatgatttttaacgctatcaacgtatattttttgccctaaagtcttaacacggataggcttaccatagctatccttaataatttcttcctcataaagggcaacgaatttatcaattgaaccattttgtgccatggataaggctgttacaacatctgaagtattcacagtcatcccgcggttaacaagcactaataatgcttcaatggttaaccgagcggtttctactgcttcttcagagtcacctaatacctgaacacgttcagttctagcatgaatgataacatctaaattttcttcgattaattttaaatggcgctcattgctgccaaagagtgacatcatatcatctggatgttgtaaagtaatttcgatagagtattcttgcaaattattcttccttttcgtacagtaagtgactacattataacaaaatttcattttctttggtgattttagtcgttgtaaaactaaaaaatcgagaaaaacaagttttctcgattttattttacattataaaagatgagcttctcgaagtaattcttctaaataagttcctctaatttttttcatgcctactttacgcattaaggcaggtattggtaaatccatatcttcaacagatttcttatcattgagatagtataaagattgcaacaagacacgaatatcaaatgctgaattaaagacttctggaacaccacgttcaatatttaagaaagtataaacagcttccatagcagttctaatagaatattccgttgtaaatactgtatctctggatggagattctgcaaaattaccaatgaaggctaggttaacagatccttgtgggataacatctggtcggtcacctttaactcgaggcatgaaataactagtaatgtaaggcatataaacaggaactgtacttacatattgtttatcagataaatcatgaatcttcatttcaggaacacctaagtgatataaccactcttctgtgatttctcgaccagtacattcttcaattggttttttaatataattaccttccacatttgaatagagtccataaatccaaacaattgtttcattttccttttgctctttgaaatgcggttggcgatggatagcaaaactcatcatccaattagaatctgtaactgtaacaatgcctccggtatttactttaccatcatggaggtcacgatgtgttaaacgctctatataaggttcaatagctggatcttttattgttgcagtagcagaaacaaaccatgactcttttggaatatctttgtagaagactttaggatgtccaaattcatcagattgagcagctaagttttcccaaagattccaagaacctcccaaatcggtattaggtttagctacagtatcatgactaccatagttcgtactttcagtgatagaaccattcgttacaaaaacaaaatcatttggagtaagatcaattgtttttgcttcaccaccaactgtgagatgaatagcttttgcaagcttctgaccgttcttaaagtctacggagatattagttaccttgctatcaaattgaacatctacattatgagactctaaataactgatgattggtttcaccatagaatcatattgattatatttattaaattttaatgaagtgaaatcaggcagaccaccaatatgatggataaagcgcatagcatatcgacgcatttcaatcgctgaatgccatttctcaaaggcaaacatagtaccccaataagtccaaaaattactttcaaaaaattcttttgaaaaaacttcttcaatcgtcttagcacctaaagactcttcagtctccatgactagcttaactaactctttggaatgtgttccgagtgtaaaatcaccatcagattctaagcgattcccctgtttatgaatgaggcgacagttagatgaattgggatcatccttgtcaagccaataaaattcatctagataagaagcatctggaacttcgagagaggggatggaacggtacatatcccacatacattcgaagtgattttccatttcacgaccaccacgcgttacaaaaccgatatcaggtcgtttgacaccgtcaagtgatcctccagaaagaggtagttcttcaaaaatatgaatacgttgaccatccatttgaccgtcacgtattaaaaagacagcggcagctaatcctgctaaaccagaaccaacaatataagcggattttttatccacaccttcaggttttcgaggtcttgcaaaggcttcaaaatttccatttgtatatctcataaacaacctccctagggctatattttagatgactatattctactcctttgtgaaaacgattgccattaaaaaacctgcttttcagacagtcttagacaatgtgtccaatttctataacctaaaaaagagattgaaaatacaatctctatattattgttaatgattgagataatcttcccaaatatcatcaaaatctgttaaattaaaggaaaaactggcctcatcttctaaatagcgactaactgtttcaaaatccgaactatgttttggaaaagtggtttcatcaaaagcgtaatctgctaggattgctactggttcatttgattttggatttctttgtgtcatcaaccaactgtaaaatgattttctcaatgccagttctcctctagaaatgcatgtcttctggcactactcaaggcgtaacgagcagggttagtccgatagaatgcttgatgatagtcttctgctgggtaaaaagtatcagcaggctcaatgctggttacaattggtctatcaaatctacccgaagcttgtagcttatcttttgatttttgagcaatctgacgttgctcttcattctcataaaagatgacaggacgataattatccccacgatcttcaaactgaccaaaagcgtctgttggatctgtttgtgcccaatataactcaactaaatctgcataagagattttttcaggattaaaaataatttcaacagcttctgtatgtccagtagttttactacaaacttctttataagttggattctcaacatgtcctccagtgtatccagataaaacagattcaataccatctaattcttcaaatggttgtaccatacaccaaaaacaacctccagcaaaaatcgcacgttccatatcgttctccattctttttaatagatacattataacaaaaaaagccaaaatttcctctcagcttttttctataattagccattaattctagctataactaaaacgacctcgtgagaaaactttaaaagttcaaaagtttataataattctgtacctagctgatcttgtttgatctttttagctttcatgagtcctccaagtgcttttttaaactgacctttggaaattccaaaagtagctttaatttcctctggagaagatttatcatttaaagtcatgaatcctccgttactttctaaatacgttaaaatcatttgtgcgtcattttctaacatttcaaaagaacgaggctttaatgataaatttaaggttctatcaacttctctgaagccaataactcgtgcatccagcacttgccctaaacgaggttcactgtaacgttcactagggtgaataaagccgagcatattattttctggtagataaacaaaagttcctgacaattttaagcgataaacgattgctggccaattttgattttgcatattgttatatgcaggggttgccattcgttgaaacacttcaggatctgcagggagagcccagagacgatcttttttatcaacatctaagcaaacgtagaggcgatcaccttttttaggccaaagttctttcaattcaggaagaacatccaaagaaacaaccacttgcttatctggaagaccagtatcaagaaatactcccaagtctttacgtacctcagtaactgtcccccaaccataatgatctcgagtcgcaaatgtttctttagttgtaagacgtgctttttgttgcatatctgtataggcgaatcctttaaccatttcaccaatgtgatgctctccttctgactttgataatgcaaaggtaaagccatctttttggataaagtaaaaatctttgttttcatcagttactaagcctgttatgactgtcgctaataatgtattcatttttctccttttaaaaaggtaaccgacaaaccaaatccatctggttttgattctatcagttacctccataatcattttattacttgccaatcataataaagatagcaaacgttactattaaacttccaacaattctttttctttattagcagtcatctcatcaatatgttttacagcatcatcagtagccttttgaatatctttttcaagagatttcaagtcatcttctgtaatttctttattcttttcttgcttcttagcttcatccatagcatcacggcgaatattacggatagcaatcttagcattttctccgacttttttcacttctttagctaaatcacgacgtgtttcttctgtcaaagctggaataacaagacgaataactgaaccatcatttgcaggattaatacctaaatctgattcgttaatagcacgctcaatatctttgattgatgatttatcaaatggtgaaattaaaagaacacgagcttcaggtacagtaatagaagctaattggttaaggggggttggcgctccataatactcaacttgaatacgatcaagcaagctagcattagcacgtcctgcacgaatccctgcaaattctcttgataaactttggtgtgattgctcaaaacgctcttgagcttttgtaacgatttccttagtcatattttttatacactcctattcagatgctttgtttgaaacagttgttccgatttgttctccaagaacaacacgcttaatattaccagtctcattcatattgaaaacaacaaggtcaatatcattatccattgaaatagttgatgcggttgcatccatgatttttaaccctcgttttattacttcaacgtgagttaattcatcaaatttgacagcattggcatctttctttggatcagcattataaacaccatctactccatttttagccattaaaattgcttctgcctcaatctcagcagcacgaagcgctgctgttgtatcagttgagaaataaggcgaaccaatacccgctccaaagacaacaatacgattcttctctagatgacgtaaagcacgaccacgtacgtaaggctcagcaacagtttgcattggaatagctgtttgaactctagtatctaccccatattgttgaaggctatcagccattacaagagcattcattactgtccctaacatccctgtataatcagcttgaacacgatccatccctgcttctgctgcaggttctccacgccaaagattacctccaccaatgacaagcgctatttgaacacctgaattgtgtacttcggcaatttcttttgcaatagattgaacggtaggaatgtcaataccgacacccttatctcccgccaatgcttcaccagataacttaattaatatacgttgatatttaggttccactactatgttctccttattttgtctttattattttaccataaaaggcaaaattttaatagagcaatgacactagtaagttgatttctttatcaactcctaaaataagaaaaacataataattcagagattggtcaaacagttagtagaacacgctctcttcaagaattcattatcttctactaaataaccattttttatcagaaagacccggttacagatagcttgacaaattttagggtcatgagaaatcattataaaacttaattcataacggcgttttattttttgtaataaacgtagcattttaatttgagttactgggtctaatccacttaaggattcatcaaaaataataattttaggctttaagagtaaagctctagcgatacaaactctctgtagctgaccaccactaagttgtctagctttatattttagataagttccatctaaacccaccgcttctaatatttgacataattcaaaagttgttttttttccataaaaagcttcattcaaaatttcctcaatactaaaatatggattgaccgaactaagcgcatcttgaaaaacaaggataatctgcgccttaccatctttaggtgtgtaaatttttccttgaaaatatatcgaaccacaagtaggactatctagtcctataatgagtcgggcaaggctacttttaccactgccacttttacccattataccaattatttctcctcttttaagatgaaaatgacagtcctttaaaacctcttgtcgtccaaatgtttttccgacatgattacaaaccaacattaagaatatctccttcatactccatttgcactgtcagtgctttcgtatagttatgttgaggattgcttaaaatagcttgggtttgtccctgttcaacaacttctccctcacttataactaataattgtccccccaggtctctagctaactgataatcatgcgttacagtaatcaaggtttttccattattttgcaattcctgcaaaatagctgatatagtagaacaattatgacaatcaaccgctgaggtcggctcatctaatatgattacctgaggatcaagagataatatagtggctaacataattctttgtagcattcctccactaagctcaaaagggtatttttttaacagggatatcgcatcatctaaatttaaacgtttcatccattctaacgctttagataaggctactctctttgaacatttctcatgactaaggattgtttccaaaatatgcgcttcaattttttgaaaaggattaaacatagacatgggattttgcactaaataggcaatatctcgtccccttaatttctgccactgctttacagttagtttacctaaatcaactcccttaaaaaatatgtttcctctaactgtcataccttgtggaatgtgaccaaccaataattttgccaagagggttttccctgaaccactctcaccaataatagttagcgattctcccatatctattttacaactaaaatctcttagtacagggacctctcctatctgtaatgacaattttcttatttctaactgttccattgtcgtttccaatcttttttatctatggcatcgcctaaagtattaaaggaaaatactgttaaaaaaatcgcaattccaggagataacatcatccaagtagctgtcctaaaatatcctctagcatcgtgcaacatcattccccattctgtgacattaggttgcacaccaatccctaagaaagaaaagccagaaatcattaaaataatatttcctatattcataaggaccataacgaggattggctgatacacaaaaggaaaaatatgttttcttaaaatatgccagactgaaagtcccataatttgcgcatttatcacataaggctctttttttgcactcttaactaaattggtcattaatttagcatagtaaacccattccacaaagacaattgcaaaaattaaattccctagaccatgacctaagattcccacggttgcaagagagagcaaaaagctcggaaaagctaaaataatattagctatccataaaaagaggttttctaactttccttgataccaaccaacaataagacccacaaacataccaatcgttaattccaataagctaataataatagctaaaaacagtgaatatctagcaccataaagcaagcgagataatacatctctacccaattggtcagtccctaacaaatgaacattattgggagccaataatttttgtgataaatctacgtattgtggatcaaagctagatagaataggggcaaaaatggcactaatcactaacaataccagtaagctactcgaaaaataaattctttttgatattatttctcccttgactttcgtaaccgaggatcaacccaattcataaaacactgtgtcataaaattattagctaaaaataaggttccaaaaattagcatacaagcttgtattactggaagatctgaagttcttagactggtcacaaataaacgtcctattccattccatgaaaaaatttcttcaacaataattgatcctgttaataagtaaacccaagtcaagctaagtgctgtcattatcgcaggtaaggcatttctaaggaggtgatgtgtgacaatataacgttcttttactcctcttaatcgggcattttccacatttaaacttctattttcttgactaatagcttttcgaataagggctatgtattgacctacggtagaaaaacttaaggtaatacttggcaaaattaaactttgtaaatcgttacctcctgaaacaggcagaagatttaattttgccgaaaatagcagcatcaacaagtaagcaacccaaaaatttggcatagacacactagaaaaactcaaaaatcgaatcaagtgatcactccgagcagattcatgtaagccagcccacacacctaacggggtagaaatggtaacaattagcaagaaggcactcgtgcctaaaaataaagtagccaaaaaccgttgtaaaaccaaatctaatactggcaacctgagcacataagaatatccaaaatctcctgttaatgctttttggaaccacagccagtactgcttccataatggcttatctaaacctaaatagtgctctgcttcttttagcgcttctggactaacacttatttttgataaacgaaggtaattttctgctgaattaactgttgatagtttgataagaataaatgttagaagtgatatgaaaaacaatgccaaaaaagctgacaatatttttttgatgatcgaactacttagatacattgtttttttctatatagcgtaatgggaatgaattttcttctggcgcaaaacgcatggttttaaaatcacctttcctataaacagaaatcaccgattgataagttaatgggatatatacagcctcatcatgcaataattcaagaaccttcttatagtctctatcaacattttcttccttaggatctactagagctgacttaataagtctatccatttcagttttagttgctagattttctaaagctatattttctggatgtccatgatctgccttggcagttaatgccgacatccaagcatgagggtcccatggtgctccccaagaataggttaacatcatatcaaaattaccctttttagcattagcccaataatcatcttcttccatagcaataagagaaacattaataccgattttacgccattctccttggaaataagttaccaggtctttatcagttgccttagtggcgatataaggaagacgtaaggttagagttttaccatctttttcacgaaccttatcttttcccatcttccaaccagcttgatccaatagctgatttgctttatcaacattatagctataaggatttaacttagcatctgagtgagatgttgattttgaaaaaatagtgtctgctggcttttctgttcctctaaaggtgttcttagcaatagaaaccttgtcaatagcatgattcattgcctgacgaacttttttatcttggaaaatactttccttagcatttagcaacaaaagtcttgttgacataggttgagaaatagctgtgacatatttcttgtccttcgtatattgggcaaaagtgtctaaaccaataatgccattcccatagatcaaatcaacgtcacctgattcgaatgctaaagcacgcgtctgagcatcgggtataacttttacggttacttcttttaattttggtttctttccccagtaattctcattacgtttgaaggtaatatattcattttgctttttacttttcacaacccattgacccgttccaattggtttttttacattcttcttagttgtatcatcacctttagggaaagcgctatcagataaaaagcgaattggtcgaatcatagagagatcatataaagtagcactataagcttgtttcagtttaatttcaaaagtactttgattcaaggcacgataattttccaattgattcgttaaattaaaccaattatgattacctctattagacttcgaaaaaatactatcaaaattacgtttgacattcgcagcattaaagttactgccatcagaatatttagcatttctcaatttaaaagtgtaggtttttccatcttgactaatgctccagcttttcgctaaagctggttcaattttcccattgtcaccatatcgtaccaacccctcataaaccatatcctggataacaaactgatcagggttatagcgatgcggattaacatcaccaaagtcttctccccaagcaagcgtgagtttatcactgtttagtttatgacttttgctatcctgtgaatggcatgcagtcagagtcaccatcaataaacaagtaatgctcaataatatgttacgtctcatttttaccaactttcttttaagtttagttaattatttttttaagcaaacttaattagatcattttagtaatgtcttgtcaagaatcttaaaataaaaaatctacaacgatacaaaatttacttattccctgcgaactcattttaatagattattgctaaagaataatcataatagtcacataccatatcaccaatttcatttttccttattctcatctgttacttaaaacacatcgcacattcattagtctttaagaaggttaatacagataaaaagctatttttcaaaagaaacacatataatatcctttgattattaaaatatatacttaactagttaagtatatagaataaataaaactaggaaggaattcctagttttttattgattaaagtgagttaggatcaactttgataccaacaccttgtgttgttgtaattgaaaggtttgtgatgtaagttccttttgcagtagctggtttagctttaacaataacatcattaaatgctttgaagttatcaactaatttagcatcatcaaatgaaactttaccaataagggcttggacgttacctgctttatcagcacggtaagtaattttaccacctttagactcttcaactgctttagcaacgtccatagttactgtaccagttttagggtttggcatcaagttacgaggtccaaggacacgtccaagacgtccaacaagtgccatcatatctggtgttgcgataacaacatcaaagtcaagccatccaccttggattttagcaactaagtcatcttcaccgacaaagtctgcacctgctgctttagcttcttcagctttagcaccacgagcaaaaacaagaacacgtgaagttttaccagtacctgctggtaaaaccatagcaccacggatttgttggtcagcttttttaacgtcaatgttaaggttataagaaacttcaacagttgcatcaaatttagcaaagttagtttcttttgcaagagctacagcttcttctacgctgtatgctttagtgctatcaattttctcaagagcagcacgtaagtttttactttttttagccattttaaaattctccttgtaatgtggtcaatcgatttgatttaaaatctcccacgtcactcatcaaactacgatgaagtcttgcgggttatgtgggtgtttctgattagtcagtaacagtgaatcccatagaacgagcagtaccttcgatcatacgcattgcagactcaaggtttgcagcgtttaaatctggcattttagtttcagcaatttcttgtacttgcgcacgagtaattgttgcaactttagttttgttaggttcacctgatcctttttcaacacctgcagcttttttcaaaagaacagcagctggtggtgttttagtgatgaaatcaaatgatttgtcttcatatactgagataacaactggaataatcataccagcttgatcagctgtacgagcgttaaactctttagtgaatcccatgatgttgattcctgcttgaccaagtgctggtccaactggtggagctggagttgctttaccagcaggaatttgaagttttacaagtttttcaacttttttagccatttttaaaaatcctcctgttgtggttttggcggtaattagaaatttttacctcccacaggcatgtttataacataccttaccattatactataatcataaataaaagcaatagttttaagccattaatttcattatattttaaatttagtaatttctcaaagtaagttccgtctgccctccaaaaccggaagttagtgtgaaaaggatttttatggtggaattaagtctgagacgtttgggttagaaatgagtttatccatcatgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacatgaaccaatcagagctgaactcctggcttgaaatggacacggttattggacggattggtggaaaggtccttctcaccttcaatgtcgccttctgtaacttcatctttgccaaactgatggattctaagacagctatcgaaactgctaaacacatacaggtcattaagaggacactctatgataacaagagagacttcttcgaactctttcctgttatcctaacggataatggtggggaattcgctagagtggatgatattgagatagatgtttgtggacagtctcaactcttcttttgtgaccctaatcggtctgaccagaaagcaagaatcgagaagaatcataccctcgtgagagacatactgcctaaggggacttccttcgacaacttgactcaagaggacattaatctggcactatctcatatcaacagcgttaagagacaggctctaaatggtaaaacggcttatgagctattctcttttacttacggaaaagacatcgcaagtatactcggtattgaggaaattactgcggaagacgtctgccaatctcccaaactattaaaagacaaaatctaacctaatcaactaactgatacaacctaaacgtctcacactaacttcaaccatagcggaacttaatctgaaacgctttcagatgaggatgttttcttgtaccctttttttgcgatttttaactctgaaaacctatgaaatcaagtattataaaaaccaacggaacttagtctgagacggattttcgttggtttttattggtttttatcagactaaattccatttctactagaggtggaacttactttgagaatttagcatattttaaatttctttcccaattccttttacattattacaacaatacttgagattttgaatctcaagtattgttatttatttatcctcaattttcttagggataacaaaaagaattgataagatcgatagactacaaaaaactaggtttaaaattaatccacacaaagctgctttgtgaaaatctgcattaccagaaaaagcatgataaatcgcaattgaagttgctacaccaattgcaccacctagtgaacttgccattttgtaaattccagatgcagaacctactttttcattaggaatactagaaatagctgtatctgttgatggtgtcgcatagatccccaagcctgttccaaataaagcataaccaacaaagactaacacaagatacaaaggtccttgaatattgaccaaagtcattaaaaatatcccaacaaatgtactcatagctcccaaaagcattggcttacgggcaccaaaacgttgtaaaattttctcaccaactcggatagcaattagtacacaaaccaaatagcctaaagacatttcacctgcaacctttggtgttagctggcgaccttgttgcatgtaagtattaataacaatcagagttcctgcaactgcattcagtaagaaatttgatattgtcgcacctaagtaaaatcgattttcaaacagatgaaagtcaataaaactattagatttacgtgtttcaacataataaaacagaacaaatccaataagcatcactgtaaaaagactcaatggaataacgttcatcaatccatgttcctgagccatagatatcccaatatttaacgataacattgaaataataaaaataattaaaccaaggtaatcaaagtgagttttttgtccaacatttttactttctggggttcctaaaattaatagaaaactaactactgatgcgatgattgaaaagataaagacataacgccaacctagagtacttgccaccgctccaccaaaataagaacatagacctgagccaccccacgatccgattgaccagaaactaactgcacgttgtctatctttaccatcatagtacgttttaaccaaggccattgttgatggcataataaaagctgctgccaatccttgaaaaatacgtcccataataaatagcactgctccattagctaaaacaattagtagagaaccaataatatttaagcaaagaccaataaaagtaaatttaactcgaccaagtttatctgctaaaccaccagttacaacaataaataaacctgaaaacaatgccgtacttgagacaccaatatccattgcaccagatgaaatacctaatgatgactgaacatctggtcccatgtttaaaatagactgtgcaaataaccaaaatgatagtacagcgagtacaattcccaccaataatttgttatttcctttgaaattttcctttgtcgttaacatatgttatctattctccttctacaagcatagcaagcgctgctgttgccattgatttagcagataccatcaatgatgattctgcaatttggaattttggatgatgatgtgggtaatatggttgcccctcttcatgtgctccaacatagaagaagcaagctgggattgtttgagcataataggcaaaatcttcagacggcgtttgagggtcgcaatcaatgacatctaaaatttcttttatagcaacagattttaaactatttgcaactttctgtgtcacttcactgttattaactaaaacaggataatcattctgatagtctaactgataactaacaccataagtttgtgctattccatctagaatacgcttaaattcctcctcaacaacacctcgtgtctcttcagacatcacgcgcacatcaccttctaaggttacactatctttgatcacattagcagaacctttaccatcaaaagatccgatagtaactactgctgtgtcaaatggattaactcgacgactgacaatcgtttgcgctgccataacaaaactagaagctgcaacaattgtatcatttgcacgatgtggcatggaaccatgtccacccttaccttgcaaaataactttaaaagtggcacgccctgtttgaatgggacctgcgtgatattgtaccgttccctcttccatcgttgacataacatggataccaaggacagcatcaatgccatctaaacatcctgcttcaatcattgcttttgctccgcctggtggcacctcttcagccggttgatgtaagatacggatatgacctgaaaattctgattttaattcaatcaagctctcagccaaaatcaataaataagctgtatgggcatcatgtccacaagcatgcatgacgcccgctgtttttgaagcaaaagaaagccctgtctcttcctgaattggaagagcatcaaagtcggctctcaaagcaatgtgtttgatgggcttatctgtcgctttatcaccatagatatcaactacgacgccattcataccaccaaattgtgtctgaacatgacagtccttacctttataaaaatctgaaatataagctgctgtttttgtctctttaaatgataattcgggattttcatgtaaatagcgacgaatagcaaccatttgatcacatttttggtcaagtttttcaaataattgatgtcgcaaagatgcattggccatttgctttcctccttaaaatatgaacagttaaaataaggctattattctaacaatctgctcttatatagtctacttttgaaaataattttttacaaataaatttttttagatatttctataactaaatagttatgaatatatcatgttatactactaaattaaatagattgattttagctcaaaatgatagtaaacttatagccataacgtatcataacttattattaatctaaggatatcaaactggttataaagtcttgaaaaatcaacaaaaattaatgtatctagagagtatcgagctatactcaaacatcactaaagccgctgcacacctttttatttctcaaccttacctaagcaaagtgatcaagcaattagaaaatgagttagaaataaaactcatccagagccaaggacaccaaacctttttaacttatgctggacagagatatctattctacctaaaagaaattgatatgattgagcgtcaaatggccaaagaactatatctcatccgttctgataaaaaaggagaaatcacacttgggattaactctggcttagcaagttctattctggcaaatgtacttcccaaatttaacttggagcacccagaaatttctgtcaaattactcgaaaacaatcaaaatatttctgaacaattggtagcgagtggtgatattgacctagctgttgggatggctcctatcctttataaagatggaattgcatcaaccactatttaccgcgacgaattgtttttaatgatacctaccaccagccaactctacaacgctgaaaaacgtggacagattattccttttgaatatcctatttcagttctagacaatgaacctcttatcctaacaccattagagtacggaattggcaaaacaattgcacaattctatgagcttcatcacatgtcattaaatcagatgattacaactagtaccgttcctacagcagctagcctatctttgtcagggatgggagcaacatttgttccacaaactctcattcatcgctatttggataaagagtgcaatgtctaccattttcataagaataagttattttcagagtacattatgatttataaaaaagatgttgaattatctggaattgctctcctactttataaagcttttttaaccaagtagtttcgctaattctattgaaaatcagtttacttcttaccaaaatcggtataaaatagacctatgatatacaaaattattgcttctttatttcttgttttaatccctatattttcacaggttcttgtcaaaatatttaaacttaaaaaatttaacattatgtttccagatgttgcttttcctatttttgtttttttaattccattaatatcatctagtctgttaaaacaaaatcttttaccttactatctgattctcatttcattactggcaatcggaattacaataaagcttctacgaacaaagactcttttttcttataaacgttttttaaaattattttggagatctggctttattctaactttccttttttacctaggattattggttatcatctttatcaaagtacaataaaaagagttggataaattgaactgcaccccaaaagttagacaaaaaatctaacgattggggtgcttttctgatgaaattaagttatgaagataaactagaaatatacgagttaagaaagatcgggatgtcctggtctcagattagtcaacgatatgatgttcgtatctcgaatcttaaatacatgataaaactcatggatcggtatggtgtagaaatcgtcgaaaaaggtagaaatgagtattatccacctgaattaaagcaggaaatgatagataaagtcttgattcatggttgttctcaactctctgtttctcttgattatgctctctctaattgttctatactcacaaattggctttcccaatttaagaaaaatggttatactattgttgagaaaacaagagggagaccgagtaaaatgggacgtaagcgtaagaaaacttgggaagaaatgacagagctcgagcgacttcaggaagaaaatgagcgcttgagaacggagaatgcctttctaaaaaagttgagggatttgcgcttgagggacgaagccttacagagcgaacggcagaaacaattagagaaatggtcacaggaggattccgactagacctcttacttgagataactaagatagctcgtgcaacttactattatcaactaaagaaactgaataaaccaaataaagacaaagcaatcaaatctgacattcaatccatttatgatgaacatagaggaaactatggctatcgtcggatttatttagaactgcgaaatcgtggctttgtcatcaaccacaaaagggtgcaaggcttgatgaaaagtatgggcttgactgctcgtattcgtcgtaagcgcaagtatgcctcttacaaaggtgaggttggtaagaaggctgataacctgattcaacgccagtttgaggggtcgaagccctatgagaagtgctataccgatgtgacggagtttgctttacctgaagggaaactttatctatcgcctgttcttgatggctataacagtgagataattgattttaccctgtctcggtctcctgacttgaaacaggttcaaaccatgcttgagagggcttttcctgcggcttcatacagcgaaaccattctccacagcgaccaaggctggcagtaccagcacaagtcctaccatcaatttctggaggacaaaggcattcgtccttctatgtcacggaaggggaacagtcctgacaacggtatgatggaatctttctttgggattctaaaatctgagatgttctatggcttggagaagtcttacaaatcacttgatgaccttgagcaagctatcacagattacattttttactacaacaacaagcgaatcaaagcaaaactaaaaggacttagtcctgtgcaatacagaactaaatccttcacttaaaataaattgtccaacttttgggggtcagtacaaaatttccaactctttttactttaggtttagaggataaagccctctaacagcattacaggcgtatatagcatcggctgattctaaatcttttaaagttagtggtgcttcaattactttttggtttttaaggagatgacgacgataaatcccattcaaccctccttctgataaatctggggttaaaaaccttccatttttttctaaaacaatattcccaatacttgtttccaatagcaacccctcaggagatacaaatatcttttcattctgaccttcaataatatgtgggcgataagaagttttaaaataagtaaacggggataatttaatagggtagtcttgtacgaccacctctgccgttaaaaacttttttgataaattcactagttgttttacctcaaacgttaccttaccagttttatcaagcattattttcaagcggtaatccttctcatctagctgatgaaggtattttttcagttccctttcgaatttacttttatcaaaagaataagcaaaataagacgctgattcaactaatctctcgacatgttgttgagagaaaagaagtttattttcagtcactcttcctgtagttattaattgaaattttggattgacacgtgttaaaacagctgatttttgacgggtttcttcatattcagaatctgtctggctctcccacgtaatacctccaccaacgccgtaataggcttgttgacctttcatttgtactgtgcgaataggaacgttaaaaatagcttgtccgtctggcatgcaaagtcctatcgtcccacaataaatacctcttggccgtttttccaactcattaataatagccattgttgatatcttaggagctccagtgatagatccacaaggatatagagcttgaaaaatagacataagtgtcacttctggcgataaaactccttcaatagttgatgtcatttgccacacagttgcatactgctccacttgacatagtttttttaccttaactgttccaacatcacagatacggcccatatcgtttcttaataaatcaacaatcatcatattttcagaacgatttttaggatcatttgccaaccaatctcgctccgccacatcttcttgataagtaggctttctagcgcttgttcccttcattggtctagttgttaagacttcatccttcttcttaaagaacaattccgggcttacagataaaatccttttatcgtcgtaggcaatataagcattatatcctgctccttgttctaccattaggcgttcataaacactaaagggatccgagcataattgttggctaagctctagtgtataatttacttgataagtatttccttgtctaatttgtcctttaatattagcaattgcctcttgatattcttgctcagaaacattagcagtccaattatctgctaatctaacattttcataacttaaaggaaaagcttcgttctcacaatctttatgtactgtaaaataagctagatgttctccagccaacttctgttgagaaactttaaaatgtgaatcaaaagcagcagatgcttcataagataaataaccaacaacataataattttgagattgataataatcaacttcttttatcacttctaagacttgttctaaagtatcagctattaattcttttgtaggatttttaaaacgatatctttttcctaattctttgaaatcaataacagtctcaatatgcattcgtaaccttcttcttcatctatttgcttcattataacataaaaaactaatccgacaatttcttgtcagattagttttttcttattcactcggagttggagtcattaaaacttttcgtggcttggttccttctgctggaccaataacccccgctgcttctaattcttccattagtcttgttgctctattgaaaccaacagacaatcggcgttgaatcattgaggcacttgctttttgcgtctctaaaacgagtcccttggcttcttcaaaaagaggatcactttcaggtactccgccgccaccaccagagccgttatctgtttcagatacttctccaggatcaaaggcatcatcatagtcagcctcggcttggtctttgataaaaccaacgatcctttcaacatcatcatctgaaataaaggaaccttgtagtcgtactggatgattctcatcaataggcttaaagagcatgtcaccccgtcccaagagcttttcagcaccattttcatcaaggatcgtacggctatcagtaccacttgaaacagcaaatgcaatacgcgacggaacatttgctttaatcaaaccagaaataacatctacggatggacgttgagttgcaagaatcatatggatacctgcagcacgtgctttttgccccaaacgaataatagcatcttcaacttctttactagcaaccatcatcaagtcagccaattcatctacaatgacaacgattaaaggcaaaggtatttgtttttgctcagaggaagcattaaactcttcaacctttgtattataacctgctatattacgcacaccaattttgctaaataactcgtatcgattttccatttcatcaacaactttttggagtgccttacttgctttacgcggattggttacaacagggattaataaatgtggaatatcattataaacagataattcaaccattttgggatcaatcatcataaacttaacttgatctggacgtgccttcatcaaaatacttgaaataattccattaactgccacagatttacctgaaccagttgaaccagctaccaaaagatgcggcattctagctaagttaaaactgcgagcattgccgttaacagcttttcctagtggtacttctaaaaggttttcaggattggcatcagattgttcccaaagttcgcggaaagaaaccgttgcaatttctgagttaggaacttcaatacctattaatgattttccaggaattggtgtttctatacgcacatcttttgctgcaagagcaagagctaggtcgtcagatagatttgaaatacgattcacacgaactccaactgctggtttaatttcatatttagtaactgatggtccaatttcagcacgttctacttttacatcgataccaaaacttctaaatgtttcttctaaaactctgatattctttcggactaaatccttttctttggattgatttttaggcttatctggtgcaaataaatctatcgttggtaatttataaaccagtgtcgttttaggtgtaaagtcgacattttctatatcactatcatctacatcatcatctaaatcataaaccatttcctcatcattttctctcatattaggaatcggcgaatcatagtcttctaaataaattgtcggctctactggtaaaggatcattttgaggcgatgtctcataagcaaggatctctggctcaaataccggagttgatgtttcacttacctcaggtggtagcgcatcatccaaattgtcctcagcttgatcctctagaatctcacccgtttcagggtctacattaaccgaagctaaataagcttcttcttcagctttttgacgctctatgcgctcttgttcagcgattgcttttttcatctctcgcttagcaaaacgctcctttttattttgctcgtgcttctctgccactttatttttaaaagctctaataaattcgacgatgtcataaacttccagagaactcattaaaaagagacccaaaatgatgaagagaacaccaatcatataggcaccaatattagaaaagagaaaagcaattggcttgtaaatcaaagcacccaacatacctccaccggcaaaaacagtgattttaaattgcattaaatcagacacaattaatcgagcagttgaacgcaaaatttctttatctttcaaaataggcattgagaaaaggtaagcatgccactcaatcaataatcctaaagaagctatcaaaaaacctgctactaagctatctttctttcgcaaccatttaaagaaataaaggtagattaaagttgccgcaataaataagtaagccaagctacctaccataaaacggatgacgttatagactgtaataccaaaaatacctaatctgataataccaaagaagagaataattgttaaaacaagagcagtaatcatcctttgaatagctctttgacgctctatttctgccttagtaggtcttctggttttctttccttttgtttttttcttatttgccataaataccatatttcaagtgaaatacttgttcctcactttctctatcaactcatgctatactattctatcataatttcaacaagtcccccaataggtttactatttacttttataaattatttaaaaatttatgataaaatataatcatcttaataacttaatcaaggagtatgtatgaaaaaaattatttatcttggtttagcctgtgtcagtatattaactttaagtggttgcgagtcaattgagcgttctctaaaaggagaccgttatgttgaccaaaaactagctgaaaactcttcaaaggaagctactgaacaactaaacaaaaaaactaagcaagccttaaaagctgataaaaaagcttttcctcaattggacaaggctgttgccaaaaacgaggcacaagtgcttataaaaacctctaaaggtgatataaatatcaagttatttccaaaatatgctcctttagctgttgaaaattttctaacacatgcaaaagaaggatactataatgggttaagtttccacagagttatcaaagattttatgatacaatctggtgaccctaatggagacgggaccggtggaaaatctatatggaatagcaaagataaaaagaaagattctggaaatggttttgttaatgaaatatccccttacctctacaatatcaggggaagtttagcaatggcaaatgctggagctgatactaatggcagccaattctttatcaatcaaagccagcaagatcattccaaacaactgtcagataaaaaagttcctaaggtgattattaaagcctattcagagggaggaaatccaagtttagatggtggttataccgtctttggacaagtaatctctggcatggaaactgtggataaaattgcttcggtagaagttacaaaatcagatcaaccaaaagaaaaaattactattacaagtatcaaagttattaaagactacaaatttaaataattctatcaaaaatgagactagaacattttctagtctcattttttaacaacactattgtttctttttaaacaaactttgtttaggagaaaataggaaagcaagtaaaaacataaaagtagatgttaaaacaatacttgatcctgcggcaatattaaatgtataaccgatatataaccccagaacagatgctactgctcctaatgcagatgataaaaacaacattgttctgagacttttaacataaagatatgctgttgcagctggtgtaattaaaagtgctacgatcaatattgttcccacactctgcatagctgttactgcaactaatgttaacaaaatcatcaataaataatgataaaaagaaactctcattcccattgattttgctaaaacaggatcaaaagaagtcaataataattctttaaagaagatagtaatcagagtcagtacaattaatcccacaataatagtcatatatttatcactatcttgtactgccaaaatattcccaaaaagaatatgaaagaggtcagttgtactattagcaagtccaattaaaatgatacctaaggctaaaaaggacgaaaaagtaattccaatagcagtatctccttttatgacactattttctttaatataagtaatgataatcgaagacaacaaaccaaagacaatagcacctataaaaaagttaatccctaaaataaaagatatagcaacacctggtagaacagcgtgagaaatagcatcacccatcaaagacattgagcgcaagataataaaacagcctactgcacccgctacaataccaatcacaattgcagttataaaagcattttgcaaaaaatgataagtcaataagccttcaaaaaatttcgtaaacattctagtctccttgtcctaacaaaatagcatcaccgtaagcagcacttaaattctcacgggtaaatgcctgatctattggtccacaagcaattagatgacggttcaaaataattacttgatcaaaataatgatcaactttactcaaatcgtgatggacgactaaaattaattttccggccttacttaatttttttagtaaattaactatgatttgttcactaatggaatcaatccctacaaacggctcatctaaaaaaatgtaatccgcttcttgaacgagacatcttgccataagcatacgttgaaattgtccacctgataaggcattaattggtctattttcaaaccctctcaaaccaacttgatcaatcactcgggatactttttcccagtcagtttttgatagtcgcttgaagaggcctcgttccttatataatcctaaagaaacgcattctccaacagttatagggaattggtaatcaatattagttttttgttcaacatatgctactctccccattaaaggtagcaaatctcccccaatccctgattctccagtagaatcaaccaaaccaagaagagctttcataagcgtagatttccccgccccattaggccctaaaataccaatgattccggagccttctaagcgtaaattaatatcttctagcactaaattattatcataacttacgcttaagtgtttactaataatcatttttcctccaaaagtagaatggagctggttataaaaccagactccacttctctgtatttattaaagctaagtcagtttttagattaggatttcgacattgttacaactcagccttaagcgagaatactacatcattgatttcattatgatttcaatgtcgattctcactcttattttgctaaaccttctgcaatcttatcaagattccatttcatcatagcgtagtagctgtcacccttttgaccttttttagcaattgagtctgtgaagatttctgcgtaaattgggatacctgattctcttgaaacagatttcataggacgcttgtcaacacttgattcaacgaataaagctgaaggtcttacttgttttaatttcttaactaagctagtaatttgatctggtgtaccttcttcttcagtgttaatttcccagatgtatgctgatggaactccataagcttttgagaaatatttaaagcaaccttcactagtaacaattaattttttattagctggaatggcattaaatttagattttgcttctttatccaatttttctaatttagctacataagcatctctgtttttctcataagtagctttgttttttggatctttagcaattaattgcttagcaatattttttgagtaaataataccattttcaaggttcaaccaagcatgtgggtcttctttaccttttccgctttgaccatttagataaataacatcaactccatcgctaaccgcaaagtaatctttgttttctttcttcttagcgttctttattaattttgtaaaccaagcattaccgcctgtttcaagattaattccgttgtaaaaaacaaggtctgcttgagttgttttttcaacgtctgctggtaatggctcatattcatgaggatctttaccaacaggtacaatactatgtaagtcgattttgttaccggctatattttttgttatatctgccaaaatagagttggttacaactacttttaatttttcgtttttggcttgatcctgcttgttagcacaggcacctaagcctaaaaatgctacaaaacatgatacaataactaaccactttttcatcaaaatgctccttttaaaattaatataagttatgtattaaattaagttaacttaattttgatattagcataacctattataaagtatttgtcaaatactttttcagtattttttgatataatggtcttagaaaaatagattttaagaagtataagaaagactgaatatgactccaaataaagcagattacctaaaatgcattcatgaattaggtgaaaaaaacaacaaaatttccaataagaaaatcgctgaaatgatgcaagtctcggctcctgccgtgtcagaaatgattaaaaaaatgataagtgaacaactgattgttaaagataaagatttaggatattatcttaccaaacaaggtttattagttgtttctgacctttaccgtaaacatcgtctagtagaggtatttttagttaaccatttgcactatactgctgatgatattcatgaagaagcggaagttttagaacatactgtatcaacaacttttgttgatcaattagaaaagttgttagactttccacaattttgtccacacggtgggactattcctaaaaagggagagtttttagtagaaattaaccaaatgacattggaccaaattagtcagcttggcacatatgttatcagtcgtgttcatgatgattttcagctactgaaatacctagaacaacaccgtttgcatatcaacgataccattgaattgacacaaattgacccttatgcaaaaacttatcacatcacctataacgatgaaaatctaacaatccctgagcgtatcgcaagtcaaatatatgtatctgctacataaataaaaaagtccgtgtattcattagatacacgggcttttttataatgctttcaaaaatgccattaatacttgggcagagcgtttaccagcttcaatgataaattcatcaaatgtgatattggcatcatgagctgcagtatcactcatagcacgtaccaccacaaagggctttcctgtagcttgagcagcttgggcaattgctgcaccttccatctcgacagctaaaacctgtggaaaatgccccttaataacatcaatcttttcctggccagcaataaaactatccccagttgcaattaaaccaactttactaatcatttcttctttagataaaactgcttcaaaagtggaaacaaaagtcttatccgaatgaaaataaagtggctgcattgacatttgtccatagtcataaccaaaggcggttaaatctacatcgtgataaactaatgtatctgcgacaacgacgtctcctacattcaatcctgttgctactgcaccagctgatcctgtattaataatagcatcaactttaaagctttctactaaaatagcaacactcatcgctgacatgactttcccaacaccagactgtactaaaacaagctcatgttcaccataacgtccactgtaatatacatttgataatactgtctcttgagatttatcctcaagattttccacaaggagttttaactcttcctccatggctgcaataattccaattttcatgatatttccttataatttaaaaattgcataaaacaagagagccaacaaaataagcaaaatgaataaaactaaattcaacttacgttgaaattcatttcgttttgcattctcaatccggcgactcttgtagatatgtttaccgttctcgtcagttagttgctccatgccatcttctgtagaaataattttagtttcttgatctaagattgtttgacctgaaactttttcacctcgatttgaacgttcaatcatatcatctgttaacaatggttttcccattaagaatgacctcccatttttaaaccgtaatattgtaaagcaatgatcgttttcgcatcttgaatcatgcctttttctaccatttgcatacaatcctcataacttaactctagaagctcaaggacctcatcatcatcttgtggcctaggattttcaactttttgtaaatcagtagctagatagaggacgattttctcattacaaaaaccaatagcagtgtagaaactataaagaatttcaagattccctgtgtagccagtctcttcttctaattcccgaagggcagcttcttccttagaacctgactcacccgtctcaagtttccctgctggaatttcgtaagaaataccttcaatagccttacgatactgtttcactaaaacaattttatgctcaggagttaccgccaaagtagcaacagctcctccatgaaaaacaagttcacgtttggattgtcccaatccatttggcaactctacatcatcaacagctactttgataatttgtccatcaaaaacagtttgacgattaattgttttttcttcaaaatccataagaacctcccaaataagtgttacttttgtgaaggatgatgtggttttttattggcatatccttctttattgacttgacgtcctcttccaatagctatgctatcaattggaacattatctgtgatggtagatccagctgctgttaaagcattatcaccaatttcaagtggtgcaatcagagtagaattacttccgataaagacattacttccgatttctgttttaaatttattttgtccatcataattgacagtaatcgtccctgcgccaaagttaacatcacaacctacctctgcattgccgatataagttaaatgacctgccttcgtattctcacctatttgagaaccctttacttcaacgaaattaccaatatgaacaccttttgcaagacttgttcctggtctaatatgcgcataagggcctacggttactccatcagaaataatggattcttcaaccatcgaattagtgatggtaacatcatttccgacttgagcatctactaaataactaccattggttaataaagtacctttaccaatcttcgtctgtccttttaaagtcacattaggctcaattacagattcttctccaatctcaacatcaatatcaatataagcggaatcaggattaaccactgtgaccccattaaccatatgttgacgtgcaattcggtgacgcatcactttttcagcagttgcaagtgctacacgatcattaactcctagactttcgtcaaagtcacgaagtttataggcacctacctttttacccgcttctttgaaaattccaataacatcagttagataatactctccttgagcgttatttgtattaatgtctttaagtgcttcaaatagactttgattatcaaaaacataagttccagtattaatctctttaacctgctgctcaaagtcattagcatccttttgttctacaattttagtaacttcatcatctgaattacggataatacgaccatatccaaatggatttgcagcatcggctgttaagattgttgcaacgtttttatgattgacatgaaaatcaattaagttttttaaactttctccagtaatcaggggtgtatcacctgcaataactagtgtatgtccttttgatgtcgctaattcttcttccgccatcattacagcatggccagttcctagctgttctgtttgcattacaaactctgatttgtcacctaaaacatcacgtacaagctccgccttatgtccaataacagtaacaattttacttggctcaatagcttgcacactacggaaaacatgctcaagcatggtaataccagatactttatgcataacttttggtaaatcagatttcatgcgagttcccttacccgcagctaaaataatggcataatttgacatattaattcctctatctctgaatataattcaacctattatatcataatgccttcaacttatcactaatacccctttaaatccctattacaatagactttagctaaaatagcttacttcaattaggaataaaatagctaccttttggtagctattcaatacatgaaatccgttaattttttcttctctgtttgcaatcagtatttttataaatctatcattgcaatgctcagatggtaaaaacgattagtttaactctgttgaaatttgccacatcacaccaaattggtctactaagtttgcgtaagcaggactccagaaagtttcttgtaactctaactgaacttcttgtgcactcttctttaatttttcataaatttcacgcgcctcctctacgctacccacaataatagcggctgtaacatttttaccagcttgatacacgaaatctggattttcatccgagatttgaagacgaatgccatcaaaaataagctgagcattaatgattaaatccttgcggtcttcaagacagttggggtccatctcttcccatgtcatcatattcactaaatccgcttgaaagacatctttataaaaatcaaccgcttgtcgcccatttccatttgttacgatgtatgtttctagtgctttaaccataagttctcctttttattttacttcacggattgcaaagtaattattgtcattatcggaaaaattaaaaactctcatactccccatatcaacaataggatttgtcataacctcatttgctgttaattcttgatatgtactgtcaatatcagtagtttcaaataaaatagagggagttgctaaatctagctcaggactcatttgagctataattgctttgtcatgtaagacgaagctaacttcactatccaacttcggtgcaactatataggttacataatctccttgtgtctgtttttcaacacgctcaaaacccaccttgtttttccaaaaatctgctgatgcttcaacattgctaacgtagagcattacctgtccaattgatgaaatcattttattatctcactttcggttttattactaattagtataacatacagtatttaaaataagtaaaaaatgactcaaaagagtcatttacttatttcgttaccatatctagaactttcatcaccgttctactatgttctaaagcttgagcagcacgcttaaaatctaaattgctaataataccttcaaaaataacaaattcatcgtgcatgcggtgcctatcaccatttaattgataaacatgactttcttgtccattcatagttaatgaaattttaggcatagtattagttggccctaaaatcgctatagaccccttatcaccttgaatagtagattttacttctgcactacaatcttttgctccaatacagactgttttaaagtgcccatagtctaggactagaactcctgaagtatcaataccacgctctatatttggtaaatactgtgctgttataggttctccaaaaagtccaattactaaatgtaaattataaatattaaggtctctcaacgcacctccacccatttcaggattgaaagctggtgctatttccccacgtttaaaggcatcataacgcgatgaatattgggaataattacattctacaattttaatatctccaaggttgcttaaatgttcttttacaaggtcaaaattaggtaaatattgatttgtaattgcttcgagtaatattagttgcctagtattggcaatagatacaagttcttctaattgacttgcttctaatgtaaatggcttctcacaaatgacatgttttcctgccaagagtgcctccttagcatagtcaaaatgcaagtgattcggcagtccaatatagactgtgtcaatctcctcattgtccaagacagccttatattcactcgtagctagagacatgttatattccttagctagatctttagctgtctccaaacttctaactgttgataagatagcaactagatcaataccttcaattttctgcaagacaggcaaaacttccttaacaatcatacctgtccccaaaaccgctaatttcattcgttaatctcctttgggtaaaccacttggaattcctctaaaactatcctagagtcctcactaaacattaaaccaaactcctcaaaataaggtttaaagaaatcaatgtgagcttttctccaccattctaaagttttatctccttctccttctttaaaagcatggtctgcagagacatctttaaaagggacaatatcaactttagttatttcaataatacagatagcttcatcattgctatccaaaataatatcatatgaaccaacttgtgtaacccttcctcatctaattcatataaatcataggcagaggccgttgcagtttttgtcccatctacaactaactttgccagaagatctggttctgctccaaattgccatgcgtctatctcatcaccgattgaaggattcaaagatttaaacttattccataattcttgtgccttcatattacctccgaagcaattcccacaacaaacttaactgcgttactcatttttctttgtcttttaaatccttctttaacatctaaaatataaacagtttgaccaatccaaacacgtaaataaacagattttattaaaatatcacctgatattcctttaacttcccgctcagtaccatcagatgcttcaaattccgtacgtaataaccaagtattaccacaaccaaattcaatctattttctcatttcaaactccagccaccatcaattttgacaatttcaccttgcattgatctcgcttttcctgaagcaagaaatccagttaattcagcaacttcacttggtttagtccaacgaccaattggcgtctcactagctacccattctgctaatccaccaggttcaaaatcactagcagtcatagcagtttgtacagcacctggcgctataccaaaaatttgaatacaatcttttgcgtaatccaaagccaattgacgtgtgaatcccgcaagggcatgtttagaactagtatatgcagctccaccgccacccgctataaaacttgctattgagcacatattgataataatacctgacttcttttccaccatacgtctaagataatgacgtgttagcctaacagtcacgaaaaaattaatatcaaataggtgttccagttcttcatcacttacttctagaagtggcttgtaggcatctagaatacctgcagtattacacaaaatatcaacagtcggtaccattgtgaatagtggggataaatcagaggataaatccaactttataaagttaaaattaccatttaagttcggtttatccgacttatccacaccatatacttgatacccttgtttcaaaaaatattgagcctgtgcataaccaattccactagcacagcccgtcactaaaacaactttagtcattgacctcgatccaatcctctgctaaaacatcacatggtgttggtgcccacatggaaaaaccttcaccttcaccagtaacattaataagaaaataaggtgtagcctgtagtactttcccattaacttcaagggtatcaaataactgaacataattttcagcgcccccccaacctgtacgtacatattttttctttgcttttaaacctggtaaaatttcttcaaatgtcatattgttctcctttattgtctttaaccattgatatatcaaggtttattgcttatttaaaatcataatttaaagtttcttcgccttttagttcatctaaaggctactattgttttcataggataaaatagtttctggtcatccattattagtaaataatatttcgtctttttcttgttggtcaagaacattatttttgttcttactccttcaattcccacaataaagttatctgcttgctccgtcaacaaaacaggtccattttccactaattcataagaaatacttagttgatttagcacagctataactttttcaaaatcattcgtaattttctccattcttccatagagttagcataactatttgtagactagagaacctaaaattgatacactgtttttcactcaaaaaattttaccttcataatcttcattatacctataacaattttcttttacaaatttgttccccttaaaggaaattgtttttcaaaataggatgtttatactattgtattatcggatgctttatctcgctagtgcaaaatcttctcataacacatttcttccttttcaaaataagtttttgatttacccttaaaagaaaaaccaaacctatcgtaaaatttccttgcgcgtgtattttctgtaaatacccaaagtatcactttattataacctgcttgttgtatctctgatagtacatgattcatcatttgagacccataaccttttccccaaccttctttaagactatgtatacaaatgagttctgcataatcaagcataccatcttctctacttttatcccaccaagccatacaatgaggattgctatctacttccaatatataccccttaccaacctccttgtgtagtagctgttgatacattgttatggcaggttctatttccgtagttttttgaatgatatcctcaggtagtatcttaccaaaagcagctttccagctctccgtttgaatataagctaaattgacttcatctcctaatcttgctctcctgattatgcaagccataactaaaatcctttcaaaaattattattaactgcctgataactactccaattataccattttcgtgatattaatttttattttgaacagttctggttctcatttatcattatatttctaaaattttagatggttttaaacattaacctcagattaggccaattattgataatcactaaaagagcgtagataattacgctcttttagtgattattttatatatatgaatcgctataacttctaagtaacacttgtttcaaaatccttcatttgtttctctctcgtaatatgcccccaaaccatttttttatttttatagccaataacacttgcaaccttaacaaaagttaatacaggatgtaggataagatacctaaaaacagcaatataaaatactttaacaatatctaaaattcctattactagttgctgagaataaatacggtgtaagaaagagcttaatgtaattaaaacacagtaaaagatataaaggctcaccaatgatataaagaatgggatgtttaattgattaaataataaggacaaaaatataatgacaataccaaaacattctataaaaggggtcagtaattcaaataaaatatagtaaatataagaaattgatcctacagctccaaagcgataattggcaaaaatacttttatatttttttaaacattggtacaagccaagataccatcggcgtctctgtttacgtaaatcccctaaattcgttggtgcttgactccaacaaacagcatctgtttcataacaaatacgataaggaatattattattacgacagaagaaatgtaatttcatcaccaactccatatcttctcctagagtctgggtgtcatatcctcccaccgctttaacaaggtctttcttaaaaagaccgaaagcccccgaaataattaaattagctcttaaatagtctaaaaagattcgagctcctaaaaatgatgaatcatactcaagtgcttgtgcacaaggaataattctccaaggcaaacgataagatgctactttcccctgctcaatcttaacaccttgggcaacttggacgagccctcccactgctataaccgtcggatctacctgtatggatttgctaatttgactcaaagaatctacctgcaacatagaatctgcatctagacatagaaaataatcgtaattagcagcattgatccccatatttaaggcatcccctttgccaccattttctttaacaatgagtgtcagtttaaccttaccaacctgtctctgaaagacatctttacaagtttgagtagcaataattgaatcaatcgtattcgagattttcattaatgcaaactcttccttgagaacatctgaagtattgtcactggaaccgtcatccacaacgataatttcatacgcttcataatcaaggtgcaataacgaatcaatcgaactcacaatggttgttgattcattataggctggtacaatagacttcctgcgaaacaaaatatggtacaatagttctatgaattatgaagcaagcaaacaattaactgatgtacgatttaagcgccttgttggtgttcagcgcactacttttgaagagatgttagctgtgttaaaaacagcttatcaacgtaaacacgcaaaaggtggccgaacccctaagttaagcttagaagatctcctcatggctactcttcaatacatgcgagaataccgcacttatgaacaaattgcggctgattttggcattcacgaaagcaacttaatccgtcgaagtcaatgggttgaatcaactcttattcaaagtggttttacgatttcaaaaactcatcttagtgctgaggatacggtgattgtggatgcaacagaggtaaaaatcaatcgtcctaaaaaaatcaactagcgaattattctggtaaaaagaaatgtcatgctatgaaggctcaggcgattgtcacaagccaagggagaattgtttctttggatattgcagtgaactattgccacgatatgaagttgttcaaaatgagtcgcagaaacatcggacaagctgctaaaatcttggcagacagtggttatcaagggatcatgaagatgtattcacaagcgcaaactccgaggaaatcaagcaaacttaagccactaactcttgaagataaaacctataaccatacgctatccaaagagagaatcaaggttgagaatatttttgccaaagtaaaaacgtttaaaatattttcaacaacctatcgaaatcgacgcaaacggtttggattacgaatgaatttgattgctggaatgatcaaccgtgaactaggattttagtttcgcaggaagtctaataattgaaattggaattttttctttatttctagttaaactttttttgcgctcatttttttcatagagatgaacacctccaatgactaatgaaatcactaaaaagctggcataggcaatcaataatactaagaaaatgacttgagatacctttaggaaggtaaaaaataatgccatagaaaatcccctttatttgatatttatatcctttttccgaatacgaagccaactaagcttatctaatcgttgtcttaagatatagtgaatgttaaaaacaataattgctaagcaaatcaaaatgtaaaaatataaaatattatgtaccatatgttctctctctttctttagaccattctttcttaatactataataggagtcttttaaaaaggttttggtatcgggtctctcccaatttttcaaacgataatctgccatctttatcagtgtgttttctttgctattagcacctaatcctaaagcaatgctctcaatttctaactccttcacaccataatgtttaaagtaatcatcgtgaattttttgagatgatggatcagaaaaattcaacaactgccacggaattctgacctctataaagtcctttccaaacgaaatatctgtttgtgaatcaaatgttttttggtgcctatcagttgttcctgttttgagaagaccagtaggatgagttggtaagaacctctctgttgcttttactttttccatgtcttcaacaatctttgtatttctcaataccatatttatctgctcaaaattactactgttcttctttggtgggaaagcataaaaatctttaccgttaagctgtcgaagatagttcgcttttaaggcattatagcgctcttggacaaataattcagacttgccatttggatcaatagacaatacaaagtcactagatttagaaaatgtgaccttactaccattcatttttctactaccagattttggtgtaatatctattggtaataatcgtttttcttttagtttttcaggttttgttttaatcgcaaggtagagatagctttcatcactgctagcatataagtcatctcctgttgcactagtcatcagaggatgtttccactctcctttgcctcttttaccatcaacttgataatgatgttttgcgtttttaaagcctaataaaccataaccttgattaaatacttgtgcatccccccataggaattgactatgtttatttgtggcgaaagatgtattccacgcccttgcattccaatcgtcttgccatgcattgatagtcgctccaaaactaccggatgatataaaagattcataatcttctagtaaacgctgaccttgttctttttcattaatcggcagaggacgtttatcaatttctttttgggcaatacctctcgctgtcgaatagccataacccgtgactagaacagggattttgtgataagcatttagcagtttaacgtatccctgtgacaaagaaagttctttaatcttttgtctatcttctttactgatattctctttatcaaataatagataatccttgtatcgaggatggaaatcaatagctttatatgctgcaaacatacctgctttaacatttgaattagcttgaatattttctacatttagttgtacgtatttaggagcctgtgcctcaaatggttttcgataatgaaaagggtctgttgttggtgagtttgaaaaactaatcaaatgttgccaaccatatttagctgtctcataatgtgtcaattcatccattacttgagctagcatgacctcaaatggattagctgccacagaagttttaaaataacgtcctttatattgcgtttttttctcttgatgattagtataagcgacagtaccactattccaatcatcccctacgacataaccaagtacccaaggactaagatcataatgataatgacggctacccaaatcagtattccatacttgcttacgcccatggagaatatccacaacgccttttgcttctcgttttaaataccccctataattatcattaaaagctgttatagaagcattattgcgataagaatctatacgtattccttgcaacaaatacagtggcctctttgatgctttgttgtggtgatataaggcatcgtaaaatgcaacattcatcggtaccttgactcttacagtatttgcccccatgttggaaattaaatggaaccattcacgatacgttttttgagtaataggaaaatcgttgtgatgataacccgctaaggaagactcaacgtctactcctttaacaacaaaaggtttattggtgggcttgtgaagtacagtatcacctttaacaacaaagttagttcttgtattttcttttaataagccctttggtaaatacaaactaccatcaaagtaatacaaataataaatagagctaaacaaaatagttaaaagggctacaatacttagatattttttcataatgttctactccagtaaagtattagtatttttcgatggtgcactatattgatacaaggtctcaatatttctatccatccatctgccacgctttttgataaaatcttttaattgttctactgatttgtgataacttgtcacattgcgttcagtaggaatcaaataattccttggatcagtattctttaaatcaaagacatagccccattttttataatttcgatcaatagctggacctaaaaaatgccttgtctcgtctatgtaattagataaatattctgtcgctagaactccctttcgtaattctttatagcgatgaacaaccaggtctataaatgctttgtccttaatgagcatattgaaccacggtgcatccgtcaaggtaaaatctgcctcatcaacacgtccttcaatttgattatcaaaagcattattaaaatcccaaactactagttttgctctatcacgaagatctttatatagataggttgaaaatttacccgcatccacatttctaaaaaattcattgatgacaaaataatttgcaaatgattctctatcaatatatttaggatattgtgaaaaatcataagaataaaggactttttcaatatgattgatgtccttattaataaactctaattgttttgatgtcaatctttgtttacctggatatttcacatcaagagctgagataccagactggtgtgtataatgtacatagttatctaacttttgctttgccttatgttcacgatcccaagcaacgatataaggtgttttatgcaactttttatcacttttttcaatgggaactcgttgctcaccttgttcgatattctcaactgctagatatactccctgatactcaccattgacaaataactcacagtagcgaacgtttggggcataggacataatctcaccagcaatattataactcagataatttcttaataatgttctgtctagaaagggaccatgcaatacccactccgattctttaggcattcctgctaatcgatgcttcttttcctttaacttattagtaacaaacttaactttcaatgacttcttatcaaagtaacgagaggtatttcctctatatgatattaacccttttgtcctaattctcggcttttctgataaatgatgtgatctacttggagaatcccgtaattcgatatcaacattaatattatccctagctttgacatattttccgccttcttttgtaacaagaggaataacttgttgctttgtatcaatgctgataatgggcaaatgggttttaaatcctgttaaatcactcttcgcatctacctgctttatacgatgatgatgtattctctcgatgtgatgcttaggaatccaaaaatagaaaaataagaatagaaaaagacctataagggttgtgccgtaaataaccttccctctcataagtctacccattgatttcgtcgctttggctaacaatgttgaaataatcaatatttcccaattggtacactttttcagttaactgattatctacatggagttgcttatcgtaatcttttctagagatttcgaaaatcatttcaatagtattagttgttgaatttttaacacgctgaacagcttttccgtcaaaatattggaagaaaattccttctaaatcaacttctagtgttctatcgcacttcacaatcaataacatacgattctcgtttttaacacgtcccataacccataataagataaagataacgctacttcctaatgcagctaccacatagtcaccgacaccacaacagataccaacaactatggtccaaaaaatataaactgtatctcttgaatcttttatggctgtcctaaaacgaacaactgacaaggcaccgaccatacccaatgacaaggctacattattaccaataacggtcattactgttgcagtcaagaccgtcaatgtcattaatgaaacattaaactttttactataggcagttccactatgcgtataagcataggaaacataaataactacactcaataaagctgctacaagaatatgtaaaatcatatcttgaaaacttaaatttccactttgctctagactatttcgtaataggtctttcatttttttgttatcctctcacatttaataataattaacgtatatactttttcactaaaaacgataatgtttactaacagctcttcctaaacaatacttactcgctgaaagttcacttctatctaccgaatctaagagttctttaatataagacaataaaaatccattatatttaacttctaaaataacaagataaggatctaataaataattttgatttaaatcctctgagaaaatatcataactagcctctgtacctattatatggtggtcaaaggtgattcggatattgttttccttagcaacaaaagcttttctttggtactcaataaccgttttaggttgataaagttgcgttgttatccttgaataacactccgcagcaaatgtatccggataatttaataaaacactattgttaccattaatcagcgcttgagcatctgtcttgcttaattttagagagcgctttttttgattagcaccttgtttttgtttcatttctaatttcgcaaaattgctttgactaccataattgcgcaaacgaatctttcttcgtatctcaacaccatcttccttttcttgccaatcaacatcttctaaagaatcaaagtatagcgaacggatagtatagccgtcgtctgaactatgcgaatcgagcgtcattacttgggaaaatttcttagataaaagatagtaatcttcaagtgatattaaatattttttttcctgtctaagaacttcgttcatcactcacctatgtttaattaaatattaatttatatataaatattaacaataaattaaacaaaaataaatatatcagaaattatacaccttgtcaacaggaaaatatataatgtatattttttttatacgaaggcatttcaaactttatttttatactataaatatgattgttacgctcatttaaacctagaagaaaaatgtatattttcaatccacagctgttataaaataatttttaaaaagtgtttatatcttagtttaatcacaccttactacaatctatatatcatttaaaaaaatctgatataaaaaaggctaaaactaagttttaacctttttgacatatctataaaattgaaatagtgctatccttcaaatttctctaaatcaaatgcttggcctttttgtttatctgacagcaccaaagaaaatactataccaatcaacattggaactagccaccccattgaaatagtatgaaaggggaggaatccaactaactgagttaatgttttttcttgccattgtcccgctagaacctcaacaaacgacactaaagtgacaagaccaattgtcaaagacattcccttttttgaaagcggcaaccacttattaatcaaaataattaagacaataacaataacaatcggatacaataaagttagcacaggaactgaaaaagtaattacagcatttaaaccaagattagcaattaaaaagccaatcaaagtaaaaacagtagcaaataatttataattcccaaaacgaaagttcttatcaaaaaattcagatactgacacaataagcccaactgttgttgtaaagcatgtcaatgttaccataatactcaagaaataacgaccaaaatttccaaataatttataagatgcttgtgataatacataagctcctttattaacatttgggtcagctaaaatatcagctgggacaggaaacttattccctaaaaaacctaagccaatatataaaatactaaatgctaaactagtaacaattccaacaatccaaatggttgataaatattcttttttagttttaaaaccaaactttttaagcgtttctgttgctactagacaaaaagcaactgctgcaagtgcatcaagtgtattatagcctgctaagacaccacttccaaacgcttttcctgcatagtcagcactcgccttagcactctccaagtttccataagcaatagctccaacaacaaccaaagagagaattaaaaaggcaaaaacaggcgttaagatttttccaacactatctaatataccatttggtctaatagcgagataataagctgcagcaaaaaaacaggctgtaaaacacaaaagagcaatcggactatgccctacaattggagcaaccccaatttcaaaagaaaccgttgctgttctaggaatagcaaaaagtggaccaatagttaggtagagtataactaaaaatgttaaagaaaaccacggactaaatttttccgacatctctgtcttataaccaccattagttagtgtgcctagtaggagggtaataatagctaatccaactcctgacaaacaaaatcctaaaatcgctggccagaaatcttgtccagatgctacacctaatgctggtggaaaaatgaggttccctgcaccaaagaagataccaaataagagtaatcccgttaaaaagcctttttttaccataagcaaccattagtgtaaataatctatttacaccctttccataaattctccttatcaaattctatctaaatgcttagaatcgatgtcttttattatatcaaaaataaaaataaattctaggtcattttcataattttccaactattcagtcacttttttcttgaaaacaaaaaaagagcataatgctcttttcgattaaccaataattgatccatttgccactgctgaatcgaccgtcaacactgtcaatttaccatcatgttctgctgagagaatcatgccttgactgacatattttttcatcattttacgtggtttgaggttagcaacaatttggagttttttccctactaactcttgttcatttgggtaaaattttgcaatccctgataagatttgacgatggccctcatcaccagcatctagacggaaacgaagaagtttatcagaaccttccactttctcaacttcaattacttctgcaacgcggatttcaacagcgtcaaaatcctcaaacttgatttgacctttgcttgatgtcaattcaacttcttcaggaacccactccttttccactggtgcttttccagcattcatttgttctttgatataagtaatttcgtcttccatatccaaccttgggaaaattggtgaaccttttgcaacaactcgaacaccttctggtagatcagcaaaagtcaatttttcaagatcgaatgttgcccctaaaccaagttgttccataatggcatcggaagtttccatcatgaacggttgaatgaggtgagcaacaacacgtagactagcaactaaatgactcattacagctgctaacttatcacgatctgtttcgtcttttgcaagtacccacggtgctgtttcatcaatatatttgttagttcgtgaaataagattccatacagcttcaagggcacgtgggaaatccaccgcttccatttgtttatgatagttttcaatactatctgtcgcaacagaagctaaatcggcatcaaagtcagttgcaacagcaaaccttggtacttctccatcgaaatacttgttaaccatagcaatagtgcggttgagaaggtttcctaaatcattagcaagttcatagttaatacgtccaacataatcttctggcgtaaaagttccgtctgaaccaacaggcaatgaacgcatgagataataacggagtggatcaagaccaaaacgctctactaacatttctggataaacgacattcccttttgatttagacattttaccatcttgcatcacaaaccaaccatgagcaactagacgttttggtaatggcaaatccagcgccatcaacatgataggccaataaatagagtggaaacgaagaatatctttaccaatcatatgaatgtctgctggccaaaatttatgatattgactgagatcgtcagaccaaccataaccaagagcagaaatatagttcatcaaagcatcaatccagacataaataacatgttttggatttgatggtacctgaactccccatgtgtaagttgtacgagacactgctaaatcttctaaacctggttctataaagtttttaagcatttcattcatacgaccatctggctgaataaattctggatgctcagcgtagtacgcttttaaacgatctgcatatttgctcatgcggaagaaataagattcttcagaaactttttcaacttcatgaccagatggcgcaacaccaccaatcatattaccgttttcgtcacgataaacttctgctaattggctttcagtaaaaaattcttcatctgaaacagaataccatccggtatactcaccaagatagatgtccccttgtgccaacaattgttcaaaaattttagcaaccgcttcttcatggtaagtatctgttgtacggatgaatttgtcataggaaatatctaaaagttcccataatgttttgacactttcagccatgccatcaacatattcctgtggtgtaatgcctgcttcttcagccttttgttgaattttctgaccatgctcatcaagaccagtcaaatactgaacatcaaagcccatcatgcgtttgtaacgtgccaaaacatcacatgctatcgttgtataggcagaaccgatgtgcaatttacctgatgggtaataaattggggtagtaatgtaaaatgattttttttctgtcatgatttctcctataagccaccctaatgagaggtgttttttatcatgatacattataacataaaatctttttcaactggatatatctctgaataatatatctacttttgctataataaaggtattaaaaatagagagttaatatatggttaatacaaaaacacttctcccctacaaaactatgccggtttggactgcacagtctattccaaaggcatttttagaaaagcataatactaaggaaggcacctgggcaaaactaaccattctaagtggttctttagtattttaccagttatctcctgatggagaggaaatctcgcggcatatttttgatgctagtagtgatattccttttgttgatccacaagtctggcataaagtttcgccgaatagtccagacttaagttgctatctaactttttactgccaaaaagaagattacttccataaaaaatatggtctcacgcgcacacattctgaggttatcgccagtgcacctctcttatctgagaagagtaatatattagaccttgggtgtggtcaagggcgaaactcactttatttatcgctgctgggacatcaagtgacttctgtcgattcaaacggacagagccttgtagctttagaaaatatggcattagaagaagagcttccttacaatataaaaaggtatgatattaatactgctgctattgaagggcactatgattttattttatcaactgtggtatttatgtttttaaatcccgactgcatttctgatattattttacaaatgcaatcacatactcagattggaggatacaatcttatcgtttctgctatggataccgctgaaaatccttgcccgcttccattcccttttaccttcaaagaaggacaattgaaatcttattacaatgactgggaaatcatcaaatataatgaaaatttaggtgaattgcacagggtggatgaaaacggtaatcgcttaaaattacagtttgcgactttattagctcgaaaattaagatcataaaagtgagtagaaatctactcacttttatctttggttaggtaataagtatattctaaacccatacataattatcctataaaatatatagagatgatatttcaaatcattattgtaacaatcagctttagtatagctcttcaacataaaacgccatacattaggagtgcctttctacttgtaggttataaaattcatggcctaacagcaagttgacatataaaagaggaattaatattaatgataagctccattcgcccagtttacttgaaaaataagtcgagcaaacaacaccaaagataaatcctccaataataataatcgtatttctagcaattaagaaaatatcagaatttttttcgtaaagtccctttgttaataaataagcagcattcttgatattaccagtcatcatcatattagcataaggtgctcctctgagcgatttaaaggtatctacttgtattgaagcaaagaaggctagtcctgccacagtaaacgacgatggtaagaaaggagtcaatataattgttactatagcaacctgtgtcaacgcaaaactagataataggtaccagtgcagttgatgtttattcgcccaacgattcatgaaataagtaaacgattgacctaacatgaaaaccattataggtagcaaaaaagcaagcgcttgactataatgcttattactaagatgaatagcaaaagataacaaattccctgtttgtacacctgcaaaacgttttccttgtgttacataagtaaaagcattgatataacctgaaataaaacagagtgcaaccgcacacctgagcccttcatatatttgatattgacggtgagactttttagacatattttcctctaactttatggcaaacaaaaataagactgggcaatcttgctcagcactttttttctaatagattggtttaaaatagtattaatattagcactagctagcctaacagttctaaataaattattaagcaatgataaatgtagttttagtatatcataacctcagcattgaagcaatctcactttatgaaaggataaagaaaatctcataagtcatttacccttaatttgaagtttaattagttacttttaattttactaccaaaaaacttgcaccattcttaacatttgttacaataaatacaacctattaggaggtcagtacagattatgcacagcactatttataaatgtcatcattgccgttatctaatttataaaagttttaaagatatctttccttttgctctcattttttcttggattgaaatccttcaaaaactcgttatatcagatgattcttttttagctcaaacaacaaagtccagtatttataaaaacgagtggttatatacggtttccaatactctttatgatttatctcatttactaatctactttatggctagttattttgtggctagtttagtatggagagacttatctaaccaaactaaagaaagtttttctgcaagtttacttggctttgccactgtttggttgcttctaacttcagttgttccaggtacagattatcactatcctagccaacccatttggcttatgctggctttgatttcgtatctttttatctttttaactcgactgcttcaaaatcgacatcatattttccagtatagtatgttagctatactactattaatctcttctattttgtcacatatcttatatcgttatcctaatattgatttagaataccttatacaaaatcacttttctcaatggctgggtgatgggccacatcaattaattcctattatgctttggtctatcttagctatttttctaaccttatcaggtctttttgtaccagatattttatttcgtccttactcctatttttcagtagttagcgaaaatttaaatgctgccttgagccaacatacagataaaatcccttatctgtataccttttatactgttaaaaatagctttgctatgtttggcggtattggaatcctattatccttatttttagcagttttatatgaaagtagaaaactacaatcgaagaattactataaattgacattactgaccttaactcctcttatttttgatcaaaatttaccatttttagtaggtctacctgtcattttacaaccaatattattcattccgatggtattaacaactatctttgcagaggcttttggagctcttatgctctacctaaaatttgtcgaccctgcagtttatactgtcccaagtggtacacctagtctactatttggctttcttgcttcaaatggggattggcgttaccttccagtcactgcaattattctagttgttggcttctttatttatcgtccgtttgtcaaaatcgctttcgctaaggaggagcaatatgaaaaaattacttagatggcttcctcctgtacttttcattattatccttataggaatgactatcttaggtaagtcctatatcaataaagtaacagctcacaaaataaaactctataactctcgaatgactcctactattttaattccaggatccagtgctactcaagaacgatttaacagcatgttagcacagctcaaccaaatgggagaaaaacatagcgttttaaagttaactgtcaaaaaagacaatagcattatctacaatggacaaattagcggcaatgaccacaaaccctacattgtcattggatttgaaaataatgaagatggttatagtaacatcaaaaaacaaacaaaatggctacagattgctatgaatgatcttcagaagaaatataaatttaaacgttttaacgctatcggtcattcaaatggtggcttatcatggactattttcctagaagattattacgactctgatgaatttgatatgaaatcattgttaacaatgggaacaccttttaactttgaagaaagtaacacctcaaatcatactcaaatgcttaaagatttaatcagtaataaaggaaatattccatcaagtctcatggtatacaatttggcaggaactaattcatatgatggtgataaaattgttccatttgctagtgtggagactggtaaatatattttccaagaaaccgctaaacactatacccaactaacagtaactggtaataatgctacacattctgacttgcctgataatcctgaagttatccaatatgtcgcagaaaaaattcttaaaaatgagaaaggtaaattaccaaaacctcactaaagctgtaaaatagcaacgcctctggtattttgatataatatattgcgaattaaactaaataaaaaaggatattattatgaaactcatttcatggaatattgattccctcaatgcggcattaacaagtgaatcaacacgtgctttaatgtcacgccaagttattgatactttagttgctgaagatgccgacatcattgcgattcaagaaactaaactgtctgccaaaggacctactaaaaaacatttggaagtacttgaaacttacttcccagaatatgatttggtttggcgatcatcagtcgaacctgctcgtaagggctatgctggtacaatgttcttatatcgtaaagggttaaatcctattgttagcttccctgaaatcgatgctcctactacaatggataatgaaggtcgcattattactctcgaattggaaaactgctatatcacacaggtctatactccaaatgcaggtgatggcctaaagcgcttagctgaccgtcaaatatgggatattaaatatgctgagtatttagcaacattggatagtcaaaaacctgttctagcaacaggtgactataacgtagcccacaaggaaatagacctagctaatcctagcagtaatcgtcgttctgctggattcacagctgaagagcgccaaggctttacaaatctactagccaaaggttttacagatacttttcgttaccttcatggcgatgttccaaatgtttatagctggtgggcacaacgaagtcgtacatccaaaatcaacaatacagggtggagaattgattattggctaacaagtaaccgtgtcgcagataaaattaccaagtcagaaatgattcattctggtgatcgtcaagatcatacaccaattattttggagattgaactataaaccaaaaaaagatgattgagttataactcaatcatctttttatactaagttgaggtctttatacttagtacggtagccaatctgaagaattttattatctttaactagcaatggacgcttaataagcattccatccgatgccaataagtccaaagcttggtcaagagttaaatcatcaaatttatcttttaagcctaattctctgtaagaatttcctgaagtattgaaaaactttttaaggtcataaggcgaattctctaacaattcttttaataacgaaactttgggaggattgctttttatatcaatcgcttcaaaagtcaagccgagttcagttaactctttttttgctgaacgacaagtggtacatttggggtattcataaaacgtatacatattatttctccttttcgtattctaataaccaagattttctttctaagccaccagcataaccagttaattgaccatatcttcctaaaacacggtgacaaggtataattagagaaatagaatttttacctattgctcctccaacagcctgtgcagattgacaatttagctctttcgctaattctccataagttttggtatctccaaaagggattttctgtaattcctgccatactctcgtctgaaatgctgtccctctcaatgataatggaatactaggtaaattttgctgtgaaaaataagcatctaaccacttcttaccaagtaaagtataggaatttgacatattaacaatttcctcttggttgactgctagcatatcatatttttgcccaacaaaataaagccctgataaacctagattgtctgctagaaggcgaatttctccaagaggggactgatagaattcttgatataacatatgataagcataacttaaaaagccatgaaaagcaattcatgactttttagttctttattgttgttttgcaattaaacgtacacggacgatattctcatcaccttcaaattcttcaattaaagtagaaatcttgttattatccgtttcatctaaatctattagtgtgtaggcgtagtcaccctttgaacggttaataatgttatcaatatttatacctaactctgatacagcagttgaaattttagccacaatgttaggaacattcttgttaattaaagtaatacgaaatggtgcggtttgaatttgatgtacattggggaaattaactgaattagtgatttctcctgtctccataaaacaacgaatggtttgacttgccataatagcacaatttagctctgcctcatctgttgatccgcctacatgaggaaagactgtaattcctttttggtttaataattctttgtctccaaaatcagtaatatagcgcttgacaacaccagtttctatcgcttcaaatagctcttggttattgactaattctgcacgagcaaagttgataatcgtagttccttttttcatgattgaaaaagctttcgcatcaaaagtatgcttagtttcatttgttaagggaacatgaattgtgatatagtcacaagtttcaaaaatatccttaatctctttaaccctttgaacatggcttgaaatattccaagctgtttcaattgaaacatagggatcataaccaagaactgtcattcctaagcgtctagcatcattcgcaattctagctccaatggcaccaaggccgataactcccaatttttttcctgcaatttcattaccagcaaaagctttctttcctgcttcaatttgtttgggaatatctgttccagttagagtattaacccatcggttagctcctaaataatcacgagctgaaagtaataaggcagcaatgaccgcttcttttacagcattagcatttgcacctggggtattaaacacgactattccctgtgcacttgcctcttcaataggaatattatttgttcctgcacccgccctagcaatagctttgaggttacttgggaaatcctgattatgcaaattttgactacgaataatataggcatcaggattttctgacatatccccatcaatctggaaacgattccctaactcttgtaaaccaatttgattaatattattaaatgttttgacactaaaaaccattctttttcactaaggttatctctttagtcatcattgaccaaaataacccctttctttttttcttacatgggatttctttcatcaatctcacgatagatgctcgtttctcccttttcttttatcttctgataagccaatcgtaccccatctagaggtactttaccacaatattgatagcctaatttatttagaatatgctgcatagtgacatttttttcatgagtatcgcaacgaaaatcaggtcctttatgaccttcaattaacccttgaaggaatgtctgtgctagtcctctaccacgaaattgatttgagatcgcaatacgatgaaatgtaagatagcgatggttatcatggagccattttccctcataaatagcatcataaacctcttcatgaccatcaatgacagccgcataagtcgctagcatcccatcttcaataccaacccaagcataaccgttcaagatatcatcaataatatcgttacgattagggtatccatcttctttttgccattgatcacttcctgttttagcaatttcggcacgcgcttcctcaataagaagcataatttggtcaatttcatttggaaaagctaatctgatttgcattatattacccacttttatatattatagactataataacggtttaattttctttcgtgataacatttactatgtattttctgcttcaaatgttttcataaaatcaattaattcgatgacaccttgtttaggaaaggcattataaaggctagctctcataccacctaccgaacgatgtcctttaatatttttaaatccacgttctgtcgcttcctttacaaatttttcatctaaatctttattaatagttatgaaaggaatgttacatagagaacgactctttttatctctgacaggattactataaaattctgaggaatcaatataatcatagagaagtcctgatttttcacgattagctttttccatagcatcaacaccacctagacttttcacccattcaaagactaatttagcaatgtaaatactgtaagcaggcggcgtattataaagagaaccagcatctgactgaatcttataatccaacattgatgataaagttggttcctcattaatcatatcttcacggataataactaccgttacaccagcaggtccaatatttttttgagctcctgcataaatcattgcaaaatcttctactttatattttacagctaatatattagaagacatatccgcaataacaggcacttcattagttttaggaatatcataaagcgatgttccttcaatggtattatttgttgtcacatgaacataggcagctttaggatcaatctctttttcatcaaactctggaatataatcataaactgattcttctgatgaagctaatagaattggttcaaaaggaattgtttttgatagttttacagcctctgtataagcttttttccccccacgaaccagcaacatgatagtaagctttacgccctctggcaatattcaagggaatcatactaaactgtaaggatgcaccaccttgtaaaaagattactttataattatccggaattcccatcaaatctcttaagtaacgctcagcacctttgataatatcatcaaactctttggagcggtgcgatacctccaaaacactcatactagacccttgataattaaggagttcagattgggcttttacaagcactggttttggtaagactgcaggacctgcagaaaaattataaattgtcatataacacctccatataattgtgtaagattatagcacagtattttgaatattgtaaagatttttttgattaattttgctttttattcgtgatataatggtaaaggcgaacaatcaagtttaaaggagtaatttatgattttgagggaattttgtgcagagaatttaacagacttaaccagattagataaagctattatttcacgtgtcgagctttgtgataaccttgctgtcggaggcactactcctagctacggtgttatcaaagaagctaatcaatatttacatgaaaaaggtattagtgtcgctgttatgattcgtccccgtggaggaaattttgtatacaatgatttagaattacgtattatggaagaggatatcctacgtgctgttgagttagaatcagatgctcttgttttgggaatattaacttcaaataatcatattgatactgaagccattgaacaacttctacctgctacccaaggtttgccacttgtttttcatatggcatttgatgttatcccgaaatctgaccaaaaaaaatcaatagatcaattagttgctttaggctttacaaggattctcctacatggttcatctaatggcgaaccaattatagaaaatatcaaacatatcaaagcattagttgaatatgctaataatcgtattgaaattatggttggcggcggtgtgactgctgaaaactatcaatatatttgccaagaaactggggttaaacaagcccatggtactagaataactcaataaaaaattcgaaacagggctataagtttctttagtatatttactactaagttctctcatgttttctaaaacctgaaagaaccggaataagagcataccatcttttataacctactctcagaaataaaatccaatttgcaatggtattcaaaagagctgaaattaaaaattttaaggaaattggaagtatcttacttctttattccaatagctaaatcggagattataaaaggttgccaaatttttctttggcaacctttttatattattacttataaatcatggaaactagcatagagttcttgtctattgagattaaattcttttgctactttttttatcgcttgattagttttatcaccattagcgatatattcttttactaatactagtggatcttgttggctactgtctttcactcgctcggtatctctcttaccatcaacaataattaagcattcacctttgagagggaccttttcaatatgctctaaaagttgactaatggttcctctttgatactcttcatagagtttcgtcaattcgcgtactaaaacaacttggcgatctccgtaaatctctttcatgtgttttagcgtatcagagactcgaaacggtgactcataaaagatttgtgtttcagggtaatcttgctttgtttcaaagaaagttatttgttgacctttcttacgaggtaagaagccataaaaaatatgaggttgtggagctaaacctgaagcgatgagagcagtaataccagcgctagctcctggtatagatacaactgggatatccccttcaatagcagccttgacaaggtcatgtcctgggtcagaaatagagggcattcctgcatcagatacttgggctaaagatttcccttcttttaacaaatcaattaacccagagattttatcgtaagcattgtgttcgtgaaaactaatttgtttagtagtaatatcaaagtgcttgagtaaaagtcccgtatttcgtgtatcctctgcacaaataaaatcaacttctcttaaaatcctaatggcacgaaaagtcatatcatctagattaccaattggagttgggactagatagagtgttccgtaatgtatatttgatttaaaacttttttgaacttgcatttccatcaatctctatataataattcaatacaaaaagcacattcttcgtcattttcacgacgttgaccatagaaagtattacaaatgtgaaagccatcattgtaaatgccttcgagtaattctcttccttgtttagaatttttaactgcagtttctgtttctgcttcaataacgctcagacgctcacgaagtttaccattttcaatgcgtagaacagtattctcctccaataatttttggatttgttttttcatagtctcaatttcagacaacccaactaataaattttgtgaaaaatcatcaaaggcatcaaacaagtcttttttatccattcactcttcctctctgcgcgtattattttctaagaaagcaccatatactctaaactattttgaaaactaacattgctcttccacatttgctgagctctataagtattttctaaatcataaagttggccttctttagccagcattattgtcagccattgaaaaacaaatgcctgatcatttttatctacaacttgcgatgtcaagcgagatacttctaaataagcagtttgcctatcttttgccaaagtcgtcacaaactgttgacttaaattcaagtaatctaataactttttgttagtcaacaatatttctaaatgtttaggatcgtctgctacttgagctaataagctagcttgtgattttagcaatcctgcttgttcagcttgatgaaccaacatgtccaattgttttggaaaacgaaaaatttgcgttctactcttaattgttggcaaaacattgttttcatcattagtcaataagatgacataagatgaactttgaggttcttcaataaatttcaaaagactgttggctgcattgacatgcattttttcgcaatctttgatgataaagacctgtgatttcccttcgaaacctgatcttgaaaaatctttagtcagctcttttatagtctctgtcttaataagttgcccctgtggttctatgattttaacatctgaaaattccccattagcgattaaacgacaggctctacactcttgacatggtaaaccactctggcgcttttcacagaactgactttgtgctaaataaagtgccatatctagacttgcaaaatttcccgaaaaaagataggcatgactcatcctatctgactgtaaaatagtattaaacttttccagcaatttgggttgtgttcgctttaaatccatgacctttgtacttcctgattcattggttgatacgatctaaaataatagagaatgtctcagctattacttcatctagctgttgggaggcatcaatcgtcacaatgcggtttggctccgaatccgccaattcaaggtaaccttgacggacgcgttgatgcatatctaattgctcgagatctagacgatttacctccctttgaacacttttttgaatacgctctaaacctacttcagaaggaacatcaaaatataaagttaaatcaggtttatgactatcagtcgcatagtcattaagccattttatatgtgacttatctaatcctcttcctgatccctgataggcaacagaactatcaataaaacgatccattaggactattttcccttcttctagagctgggagtaccttttccactagatgttggcgtcgagcagccatgtaaagcaatagctctgtttttttatccatttgcgtgtgtttaacatctaaaataatatgacgaatttcttctgaaatagttacgccaccaggctctctggtggtgagaatatcttgtgataatttttctctgagcaagggtaaaacagcttctaaaacggttgttttacccgcaccatctgggccctcaaaagaaatcattagtccttttttcatggtacatcctttatttataattactactattctatcaaaatttatcaaaaaaagacacccacaacttgattgtgcatgtctgatatttttaagagtaatttctcaaagtaagttccgtctgccctccaaaaccggaagttagtgtgaaaaggatttttatggtggaattaagtctgagacgtttgggttagaaatgagtttatccatcatgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatgggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacatgaaccaatcagagctgaactcctggcttgaaatggacacggttattggacggattggtggaaaggtccttctcaccttcaatgtcgccttctgtaacttcatctttgccaaactgatggattctaagacagctatcgaaactgctaaacacatacaggtcattaagaggacactctatgataacaagagagacttcttcgaactctttcctgttatcctaacggataatggtggggaattcgctagagtggatgatattgagatagatgtttgtggacagtctcaactcttcttttgtgaccctaatcggtctgaccagaaagcaagaatcgagaagaatcataccctcgtgagagacatactgcctaaggggacttccttcgacaacttgactcaagaggacattaatctggcactatctcatatcaacagcgttaagagacaggctctaaatggtaaaacggcttatgagctattctcttttacttacggaaaagacatcgcaagtatactcggtattgaggaaattactgcggaagacgtctgccaatctcccaaactattaaaagacaaaatctaacctaatcaactaactgatacaacctaaacgtctcacactaacttcaaccatagcggaacttaatctgaaacgctttcagatgaggatgttttcttgtaccctttttttgcgatttttaactctgaaaacctatgaaatcaagtattataaaaaccaacgaaacttagtctgagacggattttcgttggtttttattggtttttatcagactaaattccatttctactagaggtggaacttactttgagaatttagctgatatttttaagaaagtggttttttcatggtcttttctaaagtttccacaataacatcatcaaatactagttcttgttttaaaacatccttgtcagcgtatccttctagttgtatctcgaccgctttcttacctgcttttcgttcaataatgactaaacgtttaacacttaaatttgcactagaaagacgatttaggacttttgatagtacccctatcccctcatcagctaatataaccaagcgataactttcttgaccataccccgcaatttcaaggaaggctttaaaaacatccctatccgtgacaatcccataaagttgtccattatcaactactggtaaaacaccgatctttcgagacatcatcaaataaatagcgtcctcaaggctagcatactgtgaaacagtcacaatatctttaatcataatatctcgaatttttgtcttattaagaagatagttcatctcatatatagaaagactggttgctttagaaggttgtgcttctgccattgtcccttctgtcactaaccccactagctgatcattttcaacaactggcaaacgccttaagtggtgttctctcaataaatcagcagcttctgcaactgtagtatctggagagacataaactaatttttttgtcataaaatctttcactggcatacctgactcctctaaatattatccacctaagtaagctttacgaacttgatctgaaactagtaattccttacctgtccctgataaaacaaccttcccagtctctagaacatatgctttatcagcaatcgtcagagctttatttgcattttgttcaactaaaagaactgtagtcccttgttttttgatgtcttcaatgatattaaaaatttcttgaataaaaattggagctaggcccattgacggttcatctaaaagtaataatttaggacgactcatcaatgcacgccccatagcgagcatttgctgctcaccacctgataaggttgctgcatcttggtttttacgttcttctaagcgaggaaaacgatcaaacactttttttaacattttttgattttgttcacgatccttttgaagaaaggctcccatttctaaattttccataacagacaaacttgagaaaacgtggcgcccttctggaacctgagctaaaccattgccaacaatttttctagctgctaacttatgtataggtttccccataaaagaaatagaaccctgacttggtcttactaaaccagaaattgtcctcaaaattgatgtctttcctgcaccattggctccaattaaggttacaacctcaccttggttaacttcaaacgagacatcattcaccgcttgaataacaccatagtgaatagatagattttctactttcaacatggtcattatagctcaccccccaagtatgcttctataacacgtttattatttttaatttcttcaggtgtcccgtgagcaatcagacgaccatattccaatacataaattctctctgttacttgcataaccaagttcatatcatgttcaatcagcataatagtaatatcaaaatcactctttatttgactaattaactgcgtcaattctgcagtttcttgaggattcattcctgccgcgggctcatccaaaaacaatatttttggttctgttgctaaagcacgaacaatttctaaacgccgttgttttccataagggaggttcttagcaagagcatcttgatatgctttcaaaccaaaaatctctaatagctccagtgcctttttccttaaggctttttcactatgatagtatttgggtaatcgtaaaaaactagcaataggatgtgataagtgatgattactgagtcctactagtacattgtctaaaacagtcatatttttaaaaagtcggatattttgaaaagttctacctaaacctaaagaagctattttagctggtttcctcccatttaatatcttaccatcaattgatattgtccctttactaggaaggtatactcctgttaagagattaaaaagcgttgtcttacccgcaccgttggggccgattaagccaattaattcacctttatgtaatttcatcgaaacatcacctacagcagttaggccaccgaaatgtttacttaaattttttacttcaagaagtgccatctaattgcctcccttactcgtcttacgaaatagatgagatagagttaactctttcgttcctaataaaccgctaggtctaaaaatcataattaaaatcagggctaaagcatagataatcattcgaacagaagcgtagtcttgtagtaacatattcaataatcctaataaaattgctgctaaaactgtccctgtcattgaacctaaaccacctaaaacaacaataattaaaacattgacagacatcataaatgaaaagtcttttggcataacagttccaacgtagccagcctgtaaactaccagcgatagaagctaaaatagctccaaaaacaaaaacaattactttcacttttgttgtatccacacccatagactctgctgcaatttcatcttctcgtatagcaattgtattacgccctaagggactacgcaaaaaattcattgcaaggataaggctcacaactgccaccccataaactaaagaccaggttgtaaaaggcggaatccccatgatacccgcagcaccattcgtaatatcacctccattaaccaacaaaatacggataatctcagcaacacctaaagtagctatagctaaataatcaccttttagtctcaaagtaggaattcctacacctaaggcaatacctcctgcaacaagagttccaacaagtatagctatcaaaaaacctacataagttggcattttaacgccgataatagcaactgcataagcgccaatagccatgaaacctgcatgtcctagtgaaaactgtcccgaacaacctacaattaggttcaaaccaactgctaaaataacattaatcccaattgtttcaataatttgaatatgatagaggttaaatatacccatagatattagcacgctaatcaagagataatctaacactactatagctaaccaagataaaattgatttcatattttctttcatgcctagaccttctccttaatattttttccaagaattcctgctggacggatcaagaaaatgagaattaaaatagcataaacgataccatctcgaaaatctgacacaccaagtgcagtcgctaaagtttctaaaatgccaataacaaaaccaccgatagccgctcccggaatgataccaataccacctaagacagctgcaacaaatgctttcaaccctggagttacccccataagaggttgaacagaattataataaagcccaatcagtactccacctgctccagctaaagcagaccccagcgcaaatgtaaaactaatggtacggttaacattaattcccatcaattgtgcggcatcgctatccactgataaagctctcatagctttccccattttagttttttgaacgatgaactgtaaagtaagcattagtaatagcgcaatacctaaaatgatgagctgaacattggttatagttatcggtcctaaattatatttaacagtatgaatggcttgcggaaatgccctagtatccgctccaacaaggtataccatcccgtactccaaaagaaaagaaacaccaatagctgtaattaacgcggcaattctagttgattttctcagtggacgataagctaaatattcaattacaacacctaggaaagcagaccccagcattgcaattaataaagctaggaaaaaattaagatgaagatgattaatcaaataatagcccatgaaagcgcccatcatatagatgtccccatgagcaaaattaatcagcttaataatgccatataccatagtatatcctaaggcaagtaaagcatatatggatcctaagataagtccattaacgagctgttgaagcatattataaccatactttctattatatattattgtcgaattattctgaaaaattactttttaaaaaaggggagctgaaaattaaactcccatttttctagagaatacttattttgctgaaataatgttaacgctacttgtttttccatcctctaatttgacaacgtaagctgatttaacaacattgtgatttttatcaatagacattttccctgtcacacctttaaaatctttcagcttagctaaagcttttttaatatcaattgaagttttagctcctttagcagatttagctgccatatacacagcgtcgtatgataaagccgagaacatggatggttcttcaccatatgccttaacgtaatgatcatggaaagctttagctttggttgatccttgtgtagtgaaacctgtcaaataataaacgtttgaagctcctacaggtgttgccgattgcacaaatttcggactatcaaaaccatcaggcccaagaaccggtttagagatacctaaatcacgcgcttgcttaactattaatcctgtctcggtatagtaacctggcatcacaatagcatcatattctttccctttcaacttagtcaatgacgcttggaaatcagtatcaccagcggagaatgtcatactatcaacaatttttccactataactttccttaaatgattttgctaccccctttgagtaatctgatgaattatcataaaatagaacaacttttttagctttaaggttgtctgtagcatactgagacaatagctttccttgataattatcgacaaaagtagctcggaagaaatactgatttaaggtttttccatcagaaccatagactaaattgtcttgtgtcgcagcaggtgcaatcattggaactgctgctgcatttacttttggagttgaagatgcagctgcacccgatgttgctggtccgataatgacattagctcctttggtaaccaagtttgtggcaaccgttgctgcctctgcattttctgatttattatcctgtgataggacttttaacttcttgccgccaacccctccagcagcattaatttcttttactgctaagtcagctccattcttcattgaatttccatacgaagaaacgtttcctgataattcccagttataccctaccttaatatctttccctatttttgttcctgtcgaagatgctcctcctccgacatttccacatgctgctaaaagaactgtactagctaaaacaagcgctcctaaactaagtctcttttccatatttttctccttttttgaaaatggtaactaaaataatacagaattatcagaatattgtcaatagtttttaaattgtttttttgaaaattatagaaactaaataaaaaagaaggacatctgaactccttctttctaataactactagtaaatatcttaacgatataagtttccaacaaaatcctgatcaatatcatcaattgctgataaccgaacatccttaacaaattttaaatgttttatctctttactaacgctaacaatatcctctttattaacataaatgactagatatcttaatctacgagaatgataatgaacatctccgtatttatataatttacgagcgtcacgattatagtaaagataaacgctcattcctaaacgctcttgtttattcaataattttttcctttctgcgtcatatctgtaattactaagattataacataattccaacaaataaaaaaagagttggtaaactcaaccacgccgtacgcatgaaaactttctcttcatccttttgtgcccggacatcaattttgaaaagattcctttttaaatcaatgatctgcttagcctctttctccaaataattggactaaataatcttccaaatggacagaaatataccgttgtttgcgacgataactgaggtcttttttaggaaataccatcactttgagaaaatataagcacatttttcggataagatttaggttaaatgcggctcttttatccaatgtctgatgatgatcttcatgataaacaacgtccaataaccagtgcatactctctatctgccaatgacctcgtacacaattggcaaatgtgaggacatccggcttaaagctaaagataaaataacgattctcttgactcagctgaccatccttatcaatcgtgttacgagtcatcccaataccacgtaacttatgccatttgggatggttttgacacaaccatttgatatcggaagacacccagtattctctaacttcaatctgtcccctagatttttcaacagtctgataatactgcgcattttcttggagttcttccaataagttgacatcactaaaataaagagcaatatcatcataaagtgtttcttgatttcctttgacggctaagcaatagtctgctttaccttttataatcgtatcaacgatagccgtctgcgtgcccattgcgtctatcgttacaatgcttttacggatatcaattgtccgcaataactgaggaatggcaacaatttcattacttttctcctcaaccgctacctgtcccaaactaagatgatgacccccatcataagccgttacaatatgaacaggcttctgatttttacctcgattgcctcgaatcgttttaccgtccactgaaatcagttgatgaacggcatctaagcttgtcaatgattgctcaaattgaactttaagctcttttaaacggtctgaattaacaagactaatcacacgctctaaggtatcatgagacggacaaccttcactcaaatcaacgtaggtcgcaaacaatggttcattcatttcaataaaatcttccatctccttccaggtttcaatgccagctaactgacaaacaaagacaagaaatagaatggttgataaggggtagcgaattttccaagattgacgactatccaattcaactgcgcaatcatcaatagaaataataaaatcaatcatcgtagtcacctcatctatagtgtactactttgattgattttgtcattatgaatctagttttctgaaaacaaaagtttcttcatgcgtttggcgtgtaaactcaactcttttaaatctattattgtaaattattattttccataatagcatcaataaagccataatcaagtgtttcttgagcactcatccaacgatcacgctctgcatcatcatggactttttcaatagattgaccagaattatcagctaagattttttctaaagtatgacgcgtttttaaaagatgctcagcagcgatagccatatcagattgctgtgtacctccgcctgttccgcccattggttggtggatcatatattctgcattcggtaacataaaacgttttcctttagcaccacttgaagcaataatggttcccatcgaagcagccatccccataacaatcgtctgtacgtccgatttaatgaagttcatggtgtccacaatagcaagtccagccgatactgaaccacctggtgtattgacataaaggtaaatatcctttgtattatcttgtgcatcgagaaacaataactgtgcaatgatactattggccatattatcctcaacttggcctgtcaacataataatacgatcttttaaaagacgtgagtaaatatcataagaacgttcaccacgacttgtttgttcaataactactggaatcatatctttctccatttctttttatcactgtcactattataatcatttggtcaacaaaggtcaaataataacttttttaagaaaaggctttctgagttcttcagaaaagccttattcatctcaaatcttattttgtaccaaataagcgatccccagcatctccgagtccaggaacaatgtagccatgttcgttgagtttttcatccaaagcagcggtataaatatctacatctggatgtgcttcttgaagtgctgccactccttctggagctgctactaaacaaacgaatttgatactagctgcgccacgtttttttagagaatctactgctaaaatagcagacccacctgtagcaagcattggatcaactacaaaaatctgacgttgatcaatatcttcaggtaacttaactaaatattcgactggttggaaagtctcttcatcacgatacataccgatatgaccaactttagcagctggcacaaggcttaagaaaccatcaaccataccaatacctgcacgtaaaattggaacaattgctaactttttcccagctaattgtttttgtacagttgtcgctactggtgtttggatttcaacatcttctaaaggcaaatcacgagacacttcatagcccattaacatcgcaatctcatcaactaactcacgaaaatctttagtagatgttgtagtgcgacgtaagattgacagtttatgttgaataagtggatgtgaaatgacttgaaattttcccattataatgaccgctttctatttaattttgagcattaaaaacattctaatgcttgtttacattcaaagtattataacataaaaaccctttccatgcgactttttttatagtctagtcattttttctaaagtttgtcactaatcgcaaaactgcctcctcaataacagacctaggagctgcgacattgattctagcatgttttttcccttcttttccaaaagttaaaccatcatttaatattaatttggcatcatatcgaagtttttcttgaatttctaaatgcgttaaattataagcagaaaaatctaaccaaacaagataagttccctctggtttcatcactttgatatgagttttttgcgttaattgctcataaaggtattctattgatccttctaactccatttttagggcctttaaccattgtttctcttttgtaaaggcaacttctgtagctaataaccccaatgaagaaatttcttgttgattgttagctatttgcctcttcttaaaatccgagcgtaacttttcattttcaattattgcaaaactatttttagtccctgcaatattaaacgttttagttgcactagataaaataacactcaattctttaaaactagaatcaacagtattaaagctatggtgtacattatcaaataataccaaatcttgatgtatttcgtcagaaacgaggataacattatatcgtttacagatatctcctattttttgaatttctccttttgtccagacacgcccaccgggattgtgtggactacaaaaaatataaagctttacattattttcaatgatatctttttctaattgtttaaagtcaatctcaaaatactgattattattaagtaaactatttgaaactaaatgacgattattgtattttatagttctagcaaagggcggatagactggggtattaattagaacagcatctccctcctttgtgaaggcttgtatagcaactgaaatcgctggtacaaccccatcaattaataataatgattttttatcaaattgataaccatgttcttgcacttcccaattagagatagcttggtataaactgtctttaggactatcatagccaaaaaccatttggtgtgaaaaatcttcaatagcctccgacatttctggaaagataggaaaatccatatccgcaatccaaaggggaaggatttcttgatctttttgaaccgccttccattttatggtattacttgaaaaacgttctggtaaacttgtgaaatcatatgtaatcataattactcctgactattctacagctaaaaatatcccttgtcgccttggtgactattttaccatttgtttttgatactatatactaattaacattctaaagataaaagtgaccattttaaacgatcactttctttattattttaatttatcattttcataagtatggcttaattctaaattaggaaagctttgctgcctaagggcttcataaacaatcatacaaacagtgtttgaaacattcaagctacgcacatgctcatcgttcatgggaattcgtaaggccttttcggcatgctcgcgcataaaagtttctggcaatcctttatcttcacgaccaaacataaaataatggtcttgatcatcattgtaattttcatctgagtaaaccttgtcagcaaatttgctaattaggtgaactttccctcgacatgacaacataaattcttccaaaccatcatagaaactaacatctagcttatcccagtaatccagtcccgctcgtttcatttttttatcatcaataggaaatcccatcggtcgtatgatgtgcaaaggagcatttgttgccgcacaagttctagcaatattaccagtatttgctggaatctgtggttcaaataaaacaatatgatttcgtccgctatcggaacgatgatttttctgcgttagtgtttcaatattcatctcatcatcactttctagaactcattctgactcgcaaaaaaaccacactgctcggagtcaatctcagcaaacaatgtggtttatggtggtttgttaacttaaatcataacaggtttgatttaaactaacaaatcgttgacactattatagcacttcagtctacaaagtcaacctattcatgagtttttgggttatttttttgatagatataatgacaaatcaaacagaataataagcaaaaacattggaaaattaaaaccgtaaagaaattacttaacaaactcccgataaggaggatcaaaccgcctaaaattgctagaatcggtgaaactaagccggtaaatttatttttaatatcttttttgagataaaggctgagtactaaaacataaagaatgattaaactggtattattaaacaccacagcaatttcactaatatcactacccggcaataagttaaattttgtaaccataaaatgaacaaaaagccaaaaaatagctacagccgtcaccgtcaaactagctggcaatgacatttgatacttcaaatttatgttagccatcctctcacttttgatccatccgcgttccgcaaaagcttgaggtagacgcatcgtcccaagtaaaagtccattggcaacacctaatacagatagaataacaatgaaagataataaacgcccaacactaggaccgaaaataatattagctgcataattaatagcatcattaccggttgtcataataaagctagcacctaaaatttgtgtcaaaccatagaaaaatgccaaatatgataataagataagcgctggaccaatgacaaaggcaagtggtaaattcttcttgggattcttgacttctggtgcaatattaacaaaaattgtccaaccatcatatgcaaaatacaatggtaccagacctgacacccaactccatccaacatttgacggttgaatagctgttaaatgttgtggaagttgtggagctttatcagaccaaaaagcaccaattaaagcaattagaactaaaggaatcatttttacaaaggtcgttaaagattggaatccccctgcaatacgcttagcaaagatattcatgagactaagcgctaaaatataaacagcagctaaaataatctgtgattccaaacttgatgattcacctaaagtataaaatgcagctacccatgaaacgattgctgttaaagttggaagatacaaaaaagacgcaaacaagcctaaagttgctgctaaagctgggctaacatatttttcgtagtaagaaaaaataccaccactttcactcgttctaatagctagctcagaaattgacaaacttccaaaaacaatcgaaaaagaacctagtactaaaattaccatgcctaaaaagacatctccaccagtaaatttaaggatgtcatcaactttaaaataaatgcctgaaccaatcactacacctacaatcatagcaattgtagtcattaatccataggtctgtttaatagaattatgattctccataatatctccatttctactgtacgcttaaaggttaattataacctaatttagggcttgtcacaagtttatctgtgttatttttcaccagattctgataagagaatcatattactcttatcagaaagatgaaaacgttttttaaccataattctcgtgcatttttactaaaaaaaaggtatcatagagtttattattggaggtaaaaatgagaataattgttgtcggcggaggtaaagtcggaaccgcactttgtcgctcacttgttgctgaaaagcacgatgttgttttaattgagaaaaaagaaaacgtccttaaacgtgtcactaaacagcatgatattatgggaattgttgggaatggagcaaactataaaattttagaacaagccgaagtcaaaaattgtgatatttttatcgctatcactgatcgagatgaagttaatatgatttcagcagttcttgccaaaaaaatgggggcaaaagagactgttgttcgcatgcgtaatcctgagtattctaatccttacttcaaagataaaaactttcttggcttctcttcagttgtcaaccctgaattgttagcagcacaatatatcgctaataccatagaatttccaaatgcaacttcagttgaacacttcgccaacgggcgtgtgatgttaatggaatttaaaattttagaaggaaataaactctgtcatacttcaatgagtcaaattcgtaaaaaatttggtaatattgttatttgcgcaattgaacgcgatggcaaattgattattcctgatggcgatgcaactatccaagtcaaagataaaatctttgtaactggaaatcgtattgaaatgatacttttccataattacgttaaaaataaagttgtcaaaaacttgatggttatcggtgcaggacgcatcgcctactacctactcaatatccttaaaaataccaatacacacgtcaaactagttgaactcaaccaagagcaagctgaatattttagtcaagaatttcccaatgttcctgtcgttcatggggatggtactgctaaaaatattttgttagaagaaagcgttacaagttttgacgcagttgctactttgactggtgttgatgaagaaaatatcattacctcaatgttcttagaaagtatcggtatccctaaaaacattaccaaagttaatcgaactagcctactagaaatcattgacgataaacaactatcaagcattatcacacccaagcgtattgccgtagaccatgtgatgcactttgtacgcgggcgtgtaaatgctcaggattccaacctagaagctatgcatcatattgctaacgatcgcattgaaaccttacaatttgaaataaaagaaactagcaaattagcaaatcgtagccttgcatctttaaaattaaagcaaaatattttaattgcagcgattattcgcaataataaaacgattttcccaactggtgaggatgttttaacagtgggtgatcgtatcgttgttatcaccttattaaaaaatattactagaactagtgatatgttagcgaggtaggaatatgaataaaagtatgattcgtttccttctctcaaaacttttgctaattgaagctgctcttctagcgattcctctaactgttggacttatttaccgtgaaccgcaaagtgtcatgatgagtatagtcattaccatgattattttaatcatccttggattactgggttctctctttaaacctaaaaattatcatatctacactaaagaaggcatgttaattgttgcactctgctggatactttggtccttctttggcgcccttccatttgttatttcagggcaaatccctaatattatcgatgctttctttgaagtatcttctggttttacgacaacaggagcaactattcttgatgacgtcagtgtcttatcacccgcgctcttattttggcgtagctttacccatcttatcggtggaatgggggttttagtatttgcccttgccatcatggaaaattctaaaaatagccatttagaggttatgagagctgaagttcctggacctgtatttggtaaagttgtctcgaaacttaaaaaaactgcacaaattttgtatttgttatatcttcttatgtttgcagtatttgcagtaatattatattttgcaggtatgcctttctttgatagtattatcatagcgatgggaactgcaggtacaggtggttttgcagtttacaatgatagcattgctcattataatagtcctctgataactaacttagtttctattggtatgcttatcttcggggttaactttaatctttactatcttcttttactccgaaaaattaaagcattctttggtgatgaggaactaaaaacctatctccgcatcgtggcaatagcaactttcatgattgctctaaacgtcatcggtatgtatgataattttcgacaaggcctcgaacatattttctttgaagtatcagctattattacgacaactggttttggcgtgactgatatcactcgttggcctttgttttcacaggttattttgctattcttgatgtttatcggtggttctgctggctctacagctgggggctttaaagtcatgcgtagcttaatcctagcaaagattgcacgtaaccaagtattgtctacactctatcctaatagagtcatgtcactacacattaataaaagcgttctagataaaaatacacaacatggtgttttaaaatatctaactatctatttagctatcttcatggcactcgttcttgttttaacgcttgatactaatgattttttggttgttatcagtgctgcagcctcatgttttaacaacataggcccactcttaggtagcaatgaaactttctcattctttagtccattctcaaaactccttctttcatttgctatgatagcaggacgtttagaaatataccctgttttattgatgtttattcctaaaacatggtcaaaactataattacaaataataaaacggatatatcaatctgatatatccgttttattacgtcttaagctaaaatgatcagggacaggatcatttcctccgtgggctaagggatgacatcgcaaaatacgtgcaatccccatcaacacaccttttagaccatgtttttgaatagcttctatcatatacgtagagcaagttggacgataacgacagctagctgggaaagctggagaaatatttttttggtaaaagcgaactaagaaaatcaaaaaagatttaagcattaagatttattaatagccgcattatgcaactgactaatttcttttttatttaatcgtcgtgcttccccaggacggagacccgttaaatctaaggtaccgaattgtgtacgagatagcttgtccactaataacccaacttgttcaaacattttcttaacttgatgattacgaccttcatgaatagttaattcaactactgaacgatttttttcatgatccacttttatgatagtatagcgagcaggttttgttttcttaccatcgataacaacgccacgcgttaatggtcgaaggttttctttagtagctattcctttaacacgtgctaaataaactttatcaatttcattacgaggatgaatcattttatcagtaaaatcaccatcattagtcaaaattaaaagtccagttgtatcccaatccaagcgaccaacaggatatatccgttctttgacttgtggcaacaagtcaataactgtcttacgtcctttatcatctgagacacttgaaataacaccacgtggtttatttaagagataatataccttctcttcgttgtaaattggacttccttcaatttcaaccagatcaccagcctttacttgggtcgccaattcattaaccacttgaccattaatcgtgaccattccttgcttgattaattcctcagcttttctacgacttgcaatccctgcatgcgcaatatatttattaattctcattgttttccttatcttctgtattaattgaatccattgaaaataacgatacttcttcgtcaactaattcaattgaagaggcgtcaattaagtcatctaactgattaattcccatataatctaagaaataattagttgtctcataaaggttaggacgtcccaacacttctttctttccagcctctttaattaaaccaaaagctatcagtctcgttatagctccactggaattcacgccacgaatatcatcaatttcaatcctagtaataggttgtttataagcaataatagatagaacttccaaacttgcccgagatagactctgattaatcggagccttcgcataatctctcaacaaagtcatataactatcctttgttaccaatttataagtttgtgctgtctcaagcaataatagactagaatcgtcatcttcttcatatcgtttagccaacttttctagttgctgtattaatgctgatggtgtcaaagacaataattctgccatttgacgcaaactcagtccatcttcacctgcaacaaaaagaagagcttctattgagcctaaataagtcatttctcttcctttcttaagataacttgactaaaattactgtcttgttctactgtgatttgatgtaattttatcaactctaacattgccaaaaataaagttatcatttcagattttgtttggcaatccgcaaacacttcttgtaatgtcgttttctttttaagattaaaatgtctttcaataacgatcatcatatcttcaatacggtagtcttctttctcaattaccgtttgactatttgacaattctttttgtttttgggacatcatttgagaaaaagtcaaaaaaagatccatcaccgatttatcgtgtagaagaattgcatcttcaaagataacttcttgttttggttttgaaaaatatttggcgcgttcctgatgctgattagctaactcttcacttagcactttaaaacgtctatattcctctaattggctcaacaattccatttctggatcatcttcaataggatttgactccactactttaggtaataagttacggctttttatcaacatcagctgacttgccataagcatatactcaccagctacttctagacgcatcgcctgtaatgttgctatataagcaaggtactgctcaataacttccacaatcggtacatcgtatatatcaacctcatatttagatacgaggtgcaagagtaagtctaggggcccctcgaaatcttttaacttaatatccattatctataatatctctctaaagtgataggagtttttaagcctagaaggcgactgagctccgtcatcgttttgccattttctttttgctttagaataaattgttctcgcagaagttgtgcagttagttgttgctcattcttctcatttaagaaatctgttaattgattaaaaaaccattgtctagaataaggcttaccgttatgctcaaagactaagtcaccatcttcctctaaagattccaaaagaaaaggaagcaagtcttctggaagttttaaaatacgcttcatctgcgatttttcaatacttaagatattaaaagttgtatcaaaatcagccttcttcaaattagcaatttcagccggagttaaacctaaagataaaatcaacaaagcaatcaaacgaccactcggataatcagtatcttgatagaaatttgataaatccattatttgagactttgtctgagccaaagtgattttttcagtctcttgtagtctgtaaaattccttcagcgttcctctattatataaaaagaaaagaaattgattgactgcagataactttcgcttacgagctgttaacttaaattcacttagagactgttgatacaatgccagtttttcagaatttacatgtccaccaattattttataaaattgctttaaatcatagtgataggacttacgcgaattgagagataatttcttactctcaataaaattattaatatcatttatcattgtttttaggagtgatagtatattcgtctgtaaaatcatgtaggaggctattaatagcttttaaaatcgatttacgggttataatgcctctaaaatcattttgatcactgataacaggtaaaaatggataatctacaatcttatgcataattgctgtcagagtagctgcctcattaatcggctcgatttttgtattaaccatctcaacaatatcagtctgtgccatctcccaatctgttaattgacctttagattggtagcccataatgtctgagatactaatagtacctacatattttttctctttagtgataactggtacacgtgaaaaaccattacttgctaatagtaacataacgtggtctgcattgtgtgtatccacaaaaatagcaacgtcttcagctggaattagatagtggtccaaatgatttagcaaaaacgactcaaattctttagcaatcatcttgataattcctttgtcaagttaggatagggttggtgttggcgagtataatactctaccaaaaccttactatctgttatagttacaacagcgtaaagcttctcatttattggtcctcttggctgcaaaacactacctggattgataaaaatagttttaccatttttccaagcatctgcacgatgaagatgaccatataaacaaatatccgcgtcttcttgctgagctaataaatccaatttatcccaggtaaaattaatctgatggagatgaccatgggtttgaacaataacagcattatctatttttgtaaccaaaacttccggataacctgaatcataatcacaatttcctgtgaccacatgaatgccttcccatataggatctgagctaggaagttcggaatccccattgtgaaaaatagcatccacttttcccaaataatgattctttatatcttttacaatgtcacgatctccgtgagaatcactcattacaactaattttctaattgccattttggaaatacctccatcaatttacggacagcttgcccacgatgtgatagattatttttttcttgtgcgctcaattcagctgctgtcctactaccttctccgacaataaagagcggatcataaccaaagccattttcccccttaggttccgtaccaatataacctggccactctgcttcaactaccaaactttctttatttggagctgacacgactaaggttgtatgaaactgtgctgaacgtctttctttgtcaaataccatggctaattcatgcaataatttggcattattacgagcatctgtcgcgtcaggacctgaaaaacgagcagaccatacccctggcaaaccacctaaagcatctacttttaatccggaatcatctgaaattaccatttttccagttaattttgaaatagtctctgctttaagtcgagcattttcttcaaaggtcataccagtctcttcaacttctggtaaatctgggtaatcatttaaattttcaactttgagtcctaatttcccaaataattctctaaattccttcgtttttccttcattgtgagtcgcaattaatatggtatccccaaaattattatcattctttaaatcaaagaatttttctaaagaagtgccctctttaggtaagtgaactaagaacaactgatcatcttcactaactaagatggcccctttatgttgagtcactttgatatgccttgaatactcttgattaatcatatcaacgaggaatgctaataattgaaaatccgaagtcatctgcacaacgtgaagctgtagaccttcaactttcaaagttgataatagacgatgaaaaacatcttggatagcttcgtaagattcatcattaccaaaacaagtaaaataattaaaagcttggaaactacctaaaaaccaattgccttcagttttactttcaaaaattgtttttgtcataatacgatacgctccacatttatttcttgactaagccattgttctgcaatttctttaaaaccttttgggctggcggttgtgtaaaagtgatgaccaccgtgtttattttgccaattatggtttatctcaaaatagttcaataaaacagaaatatcacgaacggtttctgcgccactatcaattaatttaacctcagcccccataacattttgaatgatgggacgtaataggggataatgcgtgcaacctaaaattaaagtatctaatttaccaactaatggggacaacgtttcataaaccacctttttggctaaactagaagacatctgatttgattccacaattggaacaaatttcggacaagcaagggataccacagcagtatttggagacaaagcttgaattttttgacgataagcatctgatttaacagtcatgggagtacctataataccaactttccctaaattagttgatttgatagctgcgctagctcctggtaaaataacgcctaaaacagggatgtctagtttttctttaatttcttgccaggcaactgcagttgctgtattacaagctataacaatcatcttaacatttttagtcaataagaagttaaccatctgccaggtaaactctctaatctgttgagcaggtctaggaccatacggagctctagcctgatctccaatgaagattacttcctcttctggaagttgacggaacatttccttaacaaccgttaaaccacctacaccagaatctagaaagccaataggcctactatccatttttattcctccaatattagtgactaaaagaggctggacaacagtcctagcctctctatacaataaccaatcagtcaaatctacacttgaccaagtttgcccaaatcttgtctagaaatctgatggactatcactcactatttcatcactaaacgcttcaatgctaaaacactcttattttttagttttgatagctgtttttgcgtgttttacaatattacggtatgtttgttgaactttagcttcactaggtttttgtcccatttgactcatcatttcacgaatagcatccggtgttaaacgagggtgctctccaatctctttttcaatttgtttacgagcaataaaaatgcctcccacgagaccaccaaacaaagcgacgataattaataaaatccaaatagttattgacatctattcattctcctcatttatttacatgactcattatagcaaaaaaagaaagagtttacaaatatatgtaaacaaaatcaaagcctctatcgtccttgtcacgtcaatacactattaaattttcactagagcatggttaagcacatagtcgagtcctttatcttatcctaagtgttttccccaacttttgtgtcatccatttccaaatgaagagagctatgtaaaaatctaccaatccatgtagcaaagagcctagtcctatcaaagaaaatagtgaccataaataagttgaactactgttagaagtcattgtgattatataaacagtaataaattcgagcagaccatgaattatgttaatagctacagcaaataacaatgtttgccatttactcatcaataaagagggctttgacttaatcaagaaagccgcaattaatgcaaatccgatatgtgataaagctctaagaacgattacaatcggaaaaccagctagtagaaatccaagtcctgtccctaaagctaccaatattgcaactggaacagatataaaaatacttaaaaataaaggtacatggcttgctaaggtgaaagaagcaggcccaataattattttagcaggcatgattataggaatcatgattgcaaaagctactaaaatagaagtataagaaaccatttgtgttgttttttttgacatttttatctcctttgaagctattatacaaaacaaccttacaggtgtaaagacacctgtaaggttatttgtctatgtataaaattcctgctttttttagagcctcacatatttggtcaaaaactgactgatcttgacaagaaatcatatgtgtatgtagaccatctgtcaaagaggatagcaattctgcattggaaacttttaatttagcagtaaaattatcaatgtctttttggctttgaatgtttaagggagcagtcagcatcccataaatagggtgctctacctccacattcataatgattccttgataccgcaaaataatttccagttcttcttctgtctgttctatgccatgctgacaaaccaatctagctgtgaattgatgagtacttagagcactggacataaggtatccttttggggtagaaataatatcacattgttgtgcacgcaataaggcaatatctccaacaatcacctgcctactaacactaaaaatctttgctaatgtgcttgccgatatagcttcttttgttccttttaaagtcgttaaaatattttctcgacgctcctgtgccttcatataacaaattccttctttggtgttatttcacaattaaaaactggctagaatatctaaccagttagcctcaatcatttcgtgcaaaaagacgaagaatatttaagaatagattaataaaatcaagataaaggcttagtgccatcgaaactgcccaaccatctgcgacttggccgccttggctattgtagacatatttaatcatttggttatcgtaagcaatcaatccagaaaagatgatgacacatacgatactaatgatataactcatacccccactaccgataaataaattaacaagacttgcaattaaaatcccaattaaagcagccattaacgctttacgcatacctgataaatcttttttagtcttagctccaatcaaagccattgcaaagaaaacagccgcagatgttataaaagcttgaagaactgtagtttgcgtgtaccttgcgataatgaaacttaaagtaaacccattcaaagctgaataaatcaaaaataatggtaatgcagctggtgtgtttcgacgcgccgctccactagcaacaaagactaaaaccaattctaagatgattgctccaaaatacaaccctggcattttttgcatgatggcaatcatattttgtggaaacatatacagcataatcgcagaaacagcagctgacaaacctactcctatccctacaagaccgtaaatcttagcaaaaaattgattcagccctgaatcagattgtgtgtaaatgacgttatcattcatatgtattttcctattctaaattttaatgattatgactacctaagaatttgcgactaaaacggataggtttcttaaaaatacgtttgagtggacgagaagcctctcgtactgcccaatacttatcaaccatagtcacaatataactttctttataacgtggcggtgcaatagtcgctccccacatgtgcttcaaaataatatcttcttctctagcgtttaaatcagttaattttcgcgcattacgaaccgctatccttggatgaacccaggcatggctcttgttaaatttcgttacacgccaatcataataaaagaaatcatgtagtaaaccacctcgagcagtactactcgcatcccaaccaaacttcttagcaattttataacttgtataactaacatttatagaatgctctaagcgagttgagtgatgatgttggacaatagcttcgagtttttggaaacgtggatggtcaataaggtgaccgaccaaatccatgaagtccttatcgtcttgatactttttcattataatcacccctctggggatattataacatatgaacttaaattaagctgaaaatgactactcccgcagctactgctacattaagactttctgcttgtccaggcatttcaatatgtgctaaaacatctgcttcttctgtcatagttttggaaattccctgtccctcatttcccatgattaaagcaaaataatcatatttagggagattcttataatttaccgattgttcagataaagttgtcgcaatcatagttatcccttctgctttacaaaagttaacaaactgctctatttctaccctaaatactggtaaatgaaagtgactgccttgcatagaacgaagtgttttttggttatacaaatcagcagatttctgagataaaaaaacagcatcaaaattcgctgcatctgcagttcgaaccattgttcctaggtttcctggatcctgcacatcttctaatacaagaaaacgtccttttttaatatctgtccatcttgtctcttgaaaggcaatctcagctacaatcccttgaggagtctgtgagtcagttaattctttcaaaacatcatctgtaacaacaatagctctctcgggttttctcaaacgatctattgccgtttctgtcacaaaaatatttaaaaattgtgcaccatatttttcagcttcctcaaataaatgccagccttcaataagatatgaagatttccgatattttttttgtaacaactttttcgtttttttaatgagattatttgattttgaagttataatagtagtcataaacctattatatcagaaaagaggtcaagttatgaaaaaagttcatttaattgtctcagggcgcgttcaaggagtcggatttcgctatgcaacttattccttagctttagaaataggtgatatttacggtcgcgtttggaataacgatgatggaactgttgaaattttagcacaatctacagattcaaataaaatgacacaatttattcagaaaattcgaaaaggaccttcaaaatggtctaaagtaacttatgttgatattaaactagataacttcgatgattttaatgactttaaaatgagtaattaaaaatcattctgcggaagtattgtttaattcttaaaaaaaaagtaaaatagataggtatattaaaaattagaggaactaaaaacattgaaaaaaacattgaaacgtatcttattctctagcttatctttgtctatgttattattattgacaggatgtgttagcgttgataaggctggaaaaccctatggagttatctggaatactcttggagtgcctatggccaacctcattacttatttcgctcaacaccaagggcttggttttggtgtcgctatcattattgtaaccgtcatcgtacgtgtcgttatcttaccacttggactttatcagtcttggaaagctagctatcaagctgaaaaaatggcatactttaagcctttatttgaacctattaatgaacgactacgcaatgctaaaacacaagaagaaaaattagcagctcagacagaattaatgacagctcaacgtgagaatggccttagcatgtttggcggtattggctgcttgccattactcattcagatgccatttttctcagctattttctttgctgcacgctatactcctggagtctctagtgcaaccttcttgggacttaacttaggtcaaaagagtctgacacttactgtcattatcgccattctttattttgtacaatcttggttgtcaatgcaaggtgttccagatgaacaacgtcagcaaatgaaaacaatgatgtatctgatgccaataatgatggtattcatgtctattagtttacctgctagtgttgcgctttattggtttattggtggtattttcagtattatccagcagctagttacgacttatgtacttaagcctaaactacgccgaaaagtagaagaagaatatactaaaaatcctcctaaagcctacaaagctaataacgcacgaaaagatgttacaaattcaactaaagccactgaatctaatcaagcaattattacatctaaaaaaacaaatcgtaacgccggaaaacaaaaaagacggggataaaacaagcatactaaataatggtgtgttgtcctaaacagttaaagattattatgtaattcaagtaaaaaagacttagttctatgtcctacatagctaagtctttttagttttgcctaacttttcatataaaaagcaccctaaaagtcagataaaaatctagcttttaaagtgcaagtaatctagctaacagactaccttattaataaagtaatcgtttttcccaccagtcttgaataattgcataaagcgtacaaattacccaatagataagggctactaagatataggcggtcatatagtcggagtaggttcccccaactattttagcattattaaagatatcaggtaccgtaatcatcgcagtcaatgaggaactcttgaccatatctagcaaaacattacttaaagaagggagtgcaattcttgttgcttgcggaataataatgcctctataaatcgtcggtgtttttaaccctaaagctctagcagcttcccactgaccatgatcaacagctaaaagagctgctctgataatttctgatatatatgcactagacatcatggtaaaacctacgatagaagcagtcacagcatctaactgtatccctataaaaggcaaaccaaagtagataagaaagagtagaaccattaaaggaatcccacgcattaaggaaatatgaatattagctagatacctcagtaagcggaaatgagacatcttcattagagctacaaagaatcctacgatagctcctaaaataaagccaaccaaggataatccaatggtatatggtaacccctgaataacacttggaaaagccttaacagctagttccaaattaaaaatggcatcccagtttatcacttatctactcctctcgaaattttttatttaactttaattactggaattttatccgttccagcaggttcttttgtgagatcttgaccagcataatatttttcagagatttttttcaaagaaccgtctttcttcatatccttgatagctgcatcaatttttgttttgaggctcttatcttttttactcatcacaataccttgctcagtcggattatacttcacatcacccatttttactttgatatctggatattgttttgttacatattttacagcaatgacttgtgtgtagtaatcattcggaatgaaatctgtacgtccagttgatacatctcgaaggtaaacgtcattagttacattgtcataaataacaggttcagcaccttgctgttttgcaattttcatatattgcgttccagcgccaccaccagcttttttacctttccagtcagataaatcttttgctgtaatctttgaagaaccatctgcacgtacaatcatacctccaacagaatatttataaggttgagagaaattgtattttttcaaacgctcgggagttgtgtcaaagttattgacagcaacatccaccttaccactatctacagaagtaaatgattcagcaactccaacttcaacaaacttaacttttatcttaagttttttagcaatcgctttcatcatatcaatctcataaccagtcaattttttatggtcatcataataacttgttggataaagcgttgcaggggtagcaaccttaaggacaccatcttttttaatattgtcccatgttgtttctttgctagattgaccatttgagcaagctgctaatgtcattgcagataaaccgactaaaccaagtaaaattgtctttttcataagtactcctgtagattaaattatattaaaatggtttggcgtactctatcgaaaattaaatttaatgaaaattaatacataaatttacgataataatacaaccattgttaagagtaccatattgtatccgttttcgcaaaaatattgtttacttttcaaattaatggtaaacaggccctttgaattgcttctctttttcaaacaactctgcaacagcaagcaataaatcttctctccctttagccgctgtcaattgtacacctaaaggtagcccctctttagttagatgagttggtatggctaaagaaggttgccctgtcaagtttggctgatgtgtaaaaggtgtccaggccattgagtcttcaaacattttccaaattaaatcctgttgttcacttactgagaattctcccatatgcctcaattgtttctggagtgtctcgtctaaatcaaattgtccatgaaaaggagctggttgattagttgctgctgttaaaattaaatcataattttcatgaaacctcgccatggtagctgcaaattgatcccatgaatctaagagtttactgtaatctttagccaataccctttgtccactctgatacatagcccaggtcattaattccatatcgctaaattccattgaacgccctaaactcttttcgatgtcatcaaacattgctgctgtttcaacgctattcatcatacaataagttttcatagaatgaataccatctaaaggttgttctactaattctaaatgattccctttttgagacagaaaatctgcggcttctttaatagctgctttagcctcacttgatacctttgtttttaagggagaatccatcaatactgctatttttaggggtttactaacgctaaactcgaaaagactctctttgctgagttttttcaggggaaatgggctttctacttgatatgattgtaaataatataatagtcgttttgtatctctaactgactttgttaaagcaaaatgactagaagccccttgccaacctctataggatgaaggtccaacaggtatacgtcctcgactcggttttaaaccaatcaaaccattaaaacttgctggaattctgattgaccctcctccatcactagctcctgcaattggaaccattcctgaactaacagctgcggctgcaccaccactagagcctccagcatttcttgaatggtcaaatggaagattaacattcccgtgaagttgaccatcactaatattcttaaaaccaaattcaggggtatttgttcttcctaaaataataaaccctaatttttcaaaggactgcactaaatagtccgtttgtttagcatgatagtgtttaaataattgtgaacctgaggttgagagttgtcctttttgattctgtcccaaatctttcagaagaataggaactcctgcaaaaggagcatttgattcatttgcgtatttggctgcttgacgcgcctcattatattgcttgctgacaacagcattaacgcttacattctgttcctcgatcttgtagattgcttgctctactaattcttgcgacgaaatcttatgctgttttatcgcttgtaccatagcggtagcatctttaaaaaccatataaacacctcataaaatgtatttttattataagataacaaaaaatacttaaaaaaatagaataacgtctagactctagatattattctatgatttatactattaatttgttttttcaacactaatgatttcaacttgatagctaccagcaggtgattcaattgtagctaagtctcctgtttttttaccaattaaagcatgagcaattgggctttcattcgaaatttttcctgaaaaaatgtcagctccagcagcaccaacgatatggtaagtatctttatcatttgtaccaacttcttggacaaggacagttttaccaattgcaacctcatctttagcaactgcatcactatcaataatttcagcataacgaatttttgtttctaaaatttgaatttgaccctcaacaaatgcttgttcgtcttttgctgcatcatattcgctattttctgataagtcaccataagaacgagcaatcttgatacgctctacaacttctggtctacgaactaattttaactcttcaagttctttttcaagttgatctttttccacttgtgtcattgggtaagttttttctgccattttatttctcttttcttttcattttttcaagtcaaagatataaacatgatgactcgcaccatgtttataagcttagttaatttgactattgatatatttttcaacgttagccttgtgtgtttcaaaatctttagcgtagtatacatttccggtcttcacatcagcgacaaaataaaggtaatctgttgaagcaggttttatagtcgcttcaattgctgagatacttggactatcaactggtccaggcatcaaaccagtattagtatagatgttgtatggtgatttaattgaagtattaatttgagcatcttcagctaaacttgttttatcacctaatttccccatagcatacaaaattgcaatgttactttgaagagcttgaccggctgataatcggttataaaagacacttgctattttacggcgatcttcgtctgttgatccctctttttcaacaagagatgataatgtcaaaacatcatttacagacatattcttcgctttaatagtgttatagtaaggtgccatcttagtattcattgttgaaatcatatcttcaacaagtccttctaaggttgtatctttataatagttgtaggtagctgggaataaatatccttccaattgataaatagcttttgatttatcaggtaaacttcctagtaaatttggatatttagctaccatttttttaataaacgtttcatcttgaacaagtttcaagaaatcatcagctttataaggtgtacttgtagtctttgtatcaattttattagactcaatagctttagcaatctgtttaatagtgtaaccctcggtaattaatatcttacctaaagctggttttgtcggttctgcagttccgcctttttccaattcagcagcaatctgatctaaagtcatactttttttaagattgtagtatccactttgaaaattactatagtttttgaacttggaatagtaattaaagactgtggcgctcttaatgactcctgctttttctaaaatttgaccaattaatttattcccagatcctatcggaatttcaacttgtacaaatttatttgaattggaatcaacaggtttaatagcactatctacaaaacgataacctacaaatgctgtcaagagcaatacaagtatgataattgatatcagaatacgtgcaattcgttttgccacattatctgctttctgacgtctttcacgcttgttatgtttgttcttggctgacaaagctataccctcttcttcttttgacaaatcctctactcggataggttcctttgctacgggctctaactctgatatctcaccaagttttacattttcaccttctgtaggaatatctgttgctctcacaagaaagatttcttccgtttcttgattaggcacagcagttgcaacatcagtcttatctgcttttaaatctatgtcaggtacattttcagttgtcctaaattcactagatttggagccgctatcaagctctcttgaaggttccatcccttgattgataacttgttcttcttgggaagctaatgcttgttccgcctgacgtctttcttcttctcgagcagcttctgccagaagtttcgcctcaatccgagccttctcttgctcttctaagcgttgcttagtctctagcgcctttgctctagcttctcgttcgtctttcaaacgttgcgcttcataatctgccatcaattgtgctgttctgcgagcagcttctttggcttcttgctctttttgatagagttcttcttcacgcaactttctcaaacggttagcttcttctaactctgccagaatttgttctttaaaacttttctgatcatggttagaatgctgatcgtcattaaattcggtcaaagagatttcctcctaataataatcacaggcaattatatcttaaatagtctataaaatcaacaaaactttgacaatgttatctacttttaacaaattgatcgtgttggattattccaaatcatattataccaaagcgaaccaccatgtttggagtcagattctccctcatctttaaatccattcatttcatagaaggaaattaaatcatcatggcaagttaaacttataccatctcgttcttgagaaacaaccaggtctttcatcgctgctaataatgctgtaccaatcccctgacctttaaaatcaggatgtattgatagactagtaattcctatgaaaccacctacccttacagggaattcagaaactttatggaataaatcgtccgttaagtaccgacctttaataaccggtccttcaatgtaacctgctaaacgaccattaatctctgcaactaaaaaagtatcagtcattatcgttaaacgttcttgcattgcttttttactcgcagcctctgcttctgaaaaatttatttgttcaatactaatgacttgctgtaaatcctctaggcaaccatttctaataatcatactcatctccttaatttctttatgaaattctcttgataaagtcagatagaggactgagaaacttctctcagcccttaccatcaacttattgtgtatttttagttaggttagctaataattcttcaaaagagcgctcatacaattgaatgtctccagcacccataaagacatagacagcattatcatgattgagtaaaggcgagacattttcgactgtcactaaatctgagtgtttgacaatcttagcagctaaatcttctaccttcacctcaccattatctacttctctagcagaaccatatatttgagcgagataaacgctatccgcttgactcaaggcatgggcaaattcgtctaaaagagctatcgtacgagtgaacgtatgcggttggaaaatagctacaatttcttttgacgggtatttttgtcgagcagcatctaatgtcgcaataatctcagtaggatggtgagcaaagtcatcaataatgacagtatcgtcaataatcttctcagtaaaacgacgctttacccctgaaaacgtcttcaaatgctcagctactaatgccatatcaattcccattatgtaaaggttagcaataacagcagttgcatttaagatattatgtttaccgtatgctggtacatgaaactgaccaatttcttcttggttatagaaaaccttaaagtcagaaccattaacagttcgagtgatgtcttttgctataaaatcatttgaatcttcaaaaccataataatatattggtgcctcagaagtgatttcatgaagttttggatcttctccataaatgaataaacctttttgaacttgcttagcatagtcattaaaggcattgaatacgtcctctaagcctgtaaaataatcaggatggtcaaaatcaatattggtaataattgagtattctggatggtacggcataaaatgacgttcgtattcatcagcttcaaacacaaagtaattagcattagcagaaccacgtcctgtaccatctccaattaggaaagaagtgtctgtaatattttttaaaacatgagctaataaacctgtcgttgaggtttttccatgtgccccagctacacctagactagtgaactgacgcataaaatctccgagaaattcatgatatcgtttaaattgatagcccttttcaataacataagccaactcttcattgttatctggacgaaaagcatttcctgcaataatctctaaatcctcactgatattattcggtgagaaaggtaatatagttacacctgcttgctctaaaccacgttgggtaaaataatatttgtcaacgtcacttccttggacgttatgtcccatttgatgaagcatcagtgctagggcactcattccggatcctttaataccaataaaatgataagtttttgacatggtctctccttaattaatgtctttaaaacgtgtcagatttaattcttgagccttggctctttctttatgaaactgattgtcttgtttattgtaaacttgactgcgtttcaaaaaatcaaaattatttttctttgtttttgggttcggtgtattatcaggttcttgaaatatgattggaatttctgctaatatatagctttcctgctgtaaacgatcagaaagatgacttagttcagtcacctttcgctgagtttgttttttcggtactgttgccttcaattgttgctgaaaagcttcctttgatggcgccttaaattcctgtttcgcatagtaagcttgtcgtttctcccgaacagacctctttgcctcttgtcgagatttgctcaactctgtcgctttttttacaaaactctgcggtggtacaggatcattttcaattaccttaggatgtgatatttcttcatgttcataattgcttttgaccatgctttgatatgttttttcttgataaaagtctcgaatgttgttaattaaatcttcattatcataaagattcatctttacaagcggagacattactggttcatcatctgctatcaacggaaatcgtctagagcctctattcacattatcacttcctttctacaacagacctattataaactaatttttctgttttttcaaagttttcaactaagtaaagcttatcagattggtatttttcattcatttatataaaaaagaaagcgagagaccactttcttttttatattatagtcacatcatcatatttatttagaaactccaagtatctctcgaatatcatctacgctcatgctagcatgggtttcatttccatccagaactgttgtaaccaaatgttttttagtttcttgcatttctagaattttttcttcgattgtgcctctagtaatcaagcgataaacctcgacattctctttttgccccaacctatgtgcgcgactaatcgcctgcatttcaacagctggattccaccacaagtcaatcagaacaacggtatcagctcctgtaaggttgagaccaacgccaccagcttttaaagaaatcaagaaagcatcttttgatcctgcattaaatgctctggtcatttcatgacgttcatttgctggtgtagaaccagtaattttataagttgtaagccccatagctaccatctcacgttctgcgatatctaacatacccctgaactgagaaaaaatcagagcacgatgtccattttccttaatttgtgttaaaagttgacgtaggctttctaacttaccgctttcaccatcataatccataaaaagacgtggagtgtcacaaatttgacgtaatcgtgtgatgccagataaaatttcaattttacgacgatttaagtcagcgtcactagaatgttggatactttcttgaatttggcgtaattgcgccaaatagataactttttgactgtctgtcatttcatttggatagttcatttcaatcaaatccggtaattctgggagaacttcttcttttcgacgtctcatcacaaatggtttgatataacgagcaacttgtttagggttcaacttcaaaaactctttcttaccaggtaataaaccaggtaaaatgatctggaaaatggaccaaatttctaacagtttattctcaataggtgttcccgataatgcaaaacagtttttgacctcaaaagatctcaagctatgggctattttagtttgagcatttttcataacctgtgcttcatccaaaattaaataatcataatttccttcagaataagtctcaaaatcctgcctaaatgatgaataacttgtaatgattacttgatgacgttcagcaataatttcatctctacgaatcttagaaccataggcaactgctacatctacgtctggcgcaaatttgtggaattcatcttgccaattataaattaaacttgatggtgataaaataagcacacgagaatctctagttagttttgtacttaaaaatgaaatcgtttgaagtgtttttccaagccccatatcatcagctaaaatccctgcaaagccataatgatctaacatacttaaccaacggacacctgtaagctgataatcgcgcaaggaagctgaaacagatagaccaggtattttaaacttttctgggtgtctcaaatcttcaatcaattggtaaaaatgttgtgaaaagctaacattatcttgatttgcaaacagttctgataattgaaatgctgcaatattatctaattcaatatgcccattctttgctcgtctagctctcaacccttgcaaagttgcacttactttcttagtttcttcatcaaaaataactaattgccctgatttattcacaaaataaggattattgtcaaacaaagctaccagagcttgatcaacatcgttttccagtaaatcagagaaatcaaaagaaatatctagcaggcttcccttagcttcaatatcaatttgcggtcgttctatgagacgataactttccaattttgcggataagctcactgttcccatttttttaaattgtggaagcatataggtataaaaatcgtataattcttgtgcactgtatgctggatggctggttgaaaagtggggtgcaaagccatatttttctaagagtttaaatactttttcttcatgtttgaagtgactagcaaatgttaactgttctagttcttgacgattatgaacagttaaatcattaccataatcaaataccatttgcaataaaatttcattttgactattaatatcgaactcaaaatttaccttaaaatcatgaatagagaagctccgtggagcatccactagtccaatctccttaaaatccagtaaatgagctgctaacttatcttgatcatctaaatcaaaatggatatgttttgctaaatctccctcaatgggaagactacgaatagccgttaccatcttttcttgcttcaaattaagatggtagaaagtatcgcgataaaacaaataagaattcgcaaatagtggttttaagtctttctctttgatttctaattcaattgattgcctatggacaataaccttaaattgataaagatgatcctcaccttctaattccttaaagtagaggtgattaaattgatgaaaatcactttcaaatgaaaaattttctaaagcattcatcaaagtaacaccctcttcaaaaaaaccacgagtgagactaaggtgacgaccttgatttggtaaaataaactctagatcaattttgcttgaatgacttggaatgagcctccataaaaattctatcaattcttgactggtctcatcaaactgtattaaagacaaagtttcaaagtattgttttccaatctgataataagcttcttttcgaacagtatttaaaaaggctttgatgtcacgaataacataacttctatcatcaggcagtcgtctaatttttaaagtccaccagatatcattagcataaggattttgttctccttgagccgataattgatattttatagtatcatcttcattaataattagactatctaaaaaaacactaccaaaagaggttttcttcttagtttcttgttgactttcttgttgaacttgaactttagataagattgctttaccttctggatcgtttttcaagaaatgctccagagcagctaaatgttgacaatagccttttcttgcaaaaaaatcacaagaacattttgtttcttctgttactaatgaatattcaatctgacaatccccaactttagcttttaatagattaccttcttgagaaatcaaggacaccaaaccttgttcgtagagttctataccttgatttcgaatacgtcctggaatcattctactcattatgctaccaccttcatcttatcccttaattataacaaaattcaagtccaatttcttgtaaaaatactaaattgacacgccgtacgcatgaaaactttctcttcatccttttgtgcccggacatcaattttgaaaagattcctttttaaatcaatgatctgcttagcctctttctccaaataattggactaaataatcttccaaatggacagaaatataccgttgtttgcgacgataactgaggtcttttttaggaaataccatcactttgagaaaatataagcacatttttcggataagatttaggttaaatgcggctcttttatccaatgtctgatgatgatcttcatgataaacaacgtccaataaccagtgcatactctctatctgccaatgacctcgtacacaattggcaaatgtgaggacatccggcttaaagctaaagataaaataacgattctcttgactcagctgaccatccttatcaatcgtgttacgagtcatcccaataccacgtaacttatgccatttgggatggttttgacacaaccatttgatatcggaagacacccagtattctctaacttcaatctgtcccctagatttttcaacagtctgataatactgcgcattttcttggagttcttccaataagttgacatcactaaaataaagagcaatatcatcataaagtgtttcttgatttcctttgacggctaagcaatagtctgctttaccttttataatcgtatcaacgatagccgtctgcgtgcccattgcgtctatcgttacaatgcttttacggatatcaattgtccgcaataactgaggaatggcaacaatttcattacttttctcctcaaccgctacctgtcccaaactaagatgatgacccccatcataagccgttacaatatgaacaggcttctgatttttacctcgattgcctcgaatcgttttaccgtccactgaaatcagttgatgaacggcatctaagcttgtcaatgattgctcaaattgaactttaagctcttttaaacggtctgaattaacaagactaatcacacgctctaaggtatcatgagacggacaaccttcactcaaatcaacgtaggtcgcaaacaatggttcattcatttcaataaaatcttccatctccttccaggtttcaatgccagctaactgacaaacaaagacaagaaatagaatggttgataaggggtagcgaattttccaagattgacgactatccaattcaactgcgcaatcatcaatagaaataataaaatcaatcatcgtagtcacctcatctatagtgtactactttgattgattttgtcattatgaatctagttttctgaaaacaaaagtttcttcatgcgtttggcgtgactaaattgattgttttttgatacagtaacaaataaaaaaggctaaaacaactgtcctaaccttctatttcaatttcaacaataagatgttatttacgtttacgtgctattagattaattggtgttccttcaaaaacaaatgcttcacggatttgattttctaagaaacgaagatatgaaaagtgcatcaattcttcttcgttaacaaaaacaacgaaagttggtggtttaacagcaacttgagttgcgtagaaaatcttaagacgttttcctttatcagttggtgttggattaatagcaatagcatccataatcacatcatttaatacagcagacggaatacgtttgttttgactttcgctaatacgtttaatcatatctggtaacttgtgcaaacgttgctttgtctctgcagaaacaaagataattggcgcataagacaagaattggaagttatcacgtatatcagcttcccactgactgacagtatgattgtctttttcgatagtatcccatttattaactacaataataatacctttaccagtttcatgtgcaaaccctgcaatacgcttgtcatactcacgaataccttcctctgcattaatcaccataagaacaacatctgagcggtcgatggcgcgcatagaacgcataacagaatatttctctgtgttttcatataccttaccagatttacgcataccagcagtatcaatcatagtatactcttgcccctggctatcaacgaaattagtatcaatagcatcgcgcgtagtaccagcaactgggctagcaataacacggtcttccccaaggatggcattaattaaactagatttcccaacatttggacgtccaatcaaactaaaacgaataatatctggattttcattttcctcttctaccggaagattttccacaatagcatccaatatatcaccagtaccaataccatgaactgatgacaagggataaggatcccctaaaccaagagagtagaaatcgtaaatatcattgcgcatctcaggattatctaccttattaacagctaaaataaccggtttattggtcttataaagaatacgtgagacatactcatctgcatcagtcacaccttctttacccgacacaacaaacacaataacatcagcctctgtcatagcaatgtctgcttggtgcttaatttgctccataaacggtgcatcaacatcatcaatcccaccagtatcaattaatgaaaacttacgatttagccactcacccgttgtatagatacgatcacgagtgactccttcaacgtcctcaacaatggaaatacgttctcctgcaattctgttaaataatgttgattttccaacattcggacgaccaacaatagcaactgtaggtaataccataattctcctctcactattgggaatactcccaattccattctattttattaacggcgattcggtccttctaagtggaattctatcgctaaataccgtacgcgctccataactcgttttgcttgccaagtttcgtcgcttccttttatattagcccattttctttccaaatcgttaaaactataatttgacgtaaagaaagtgggcaactcttctagcatacgatgttgtaatataacttgtaaaatctcgtcacgaacccaggacgttgcctgttcagccccaatatcatctaaaatcaaaatcggaacacttttcacagcatcaatttcatcttttacagttccgcttgaaatagcatttttgacatcaatagcaaaactagggaaatgaagaagagtcgttgacacaccctttctctctgataattccctcgccattgctgccattaaataggatttcccaacccccatatctccatataaataaagccccttgtgattatatgaaggataagtctctacaaaatcaagcagttgtgacatagctttcattcgactctcgttattaatatcaaagtcagtcattctgatattccgataggacttgggtagattaactaaattaatacgatcactgatagcttgttttttttgtgcttcaattaactctcgtgtttctaaataagaaacatctgcataaccttcattcataaccaaaataggctcatagcctttagcaatatattgactatccttatttttaaatttctgacgctcaatcaaaaattgattaaatttagacatgctgatatttatttcacgctgagaaagttggtgggttttaatgaactccgctacctgagcatctgctaaaatcatttgaataagctcatcatttgtattacgaggcactctcccttgattttctaatgcttgtcccactgatttcatgattcaccatcctttcctaatcgttctaaacgcttgagggcatctgttttaaactgttctaattcaatttctttttctgggctaacctcatctttataatcaggattactccattcaggaacattcgattgtttcttcttcgtttctgttttagtccttactttttgatctgaaaaatcacgaattttaagcacagcatcttcggccgtcataacattctgaaaagcaaaatcattagcaactttcatgatataggccttatttaagttagcagattttgtcttattcaaggtatataaaaccataacattaatgacttcgtctaggaaattcatttttgccaaatcctcaagtaaagtcttctcaccacttgttgtcactgccttacggcttctcttgattttttcaaggaacactagagcactatcatttttagattcccttagtatgaccttttcattatttgtaaaactctgattatctttaatatgctgcccctcattttgttgaactttcattcgctgaggcgcaatcattccattgatagctgtttgttttgctaattgataggtatcataccaatttaaatgataaagttctgatacactataaatacctaagacatcatctttttcattgttaaaacgtaagccatctcgcatcatcaaacgtttgaaactttccaagtcaaaaacatttttactccggtttacctcttgttttggttgtcctaaatccgagaaaacatctgtaaattttttagagatatctctagcatttttaggtattttcatatctaattctgccactgctacctctcctatacgtttttctaacaaacgacgatagatgggattagataaaaataactcatttgacatagcttgattcaacttaacaaggtaagtacctgtggcttggtaaacagtcaacaaatccaaagctgttaacattaccaatgcatcttgaaatcttggcatcccgtattgcagatgattgagaacctctgaaaatttatgacgtcgtattccgtcatcaaaaaaatgaacaaaataatcatagagtgccatggcatcacttcccataattgggaaatacaattgtattaaactattactatcataaacaatcttattttgcttaatatatgtaaactcatctattggactcatcacacgctaccactctttttactccgtacgcgctttgtaatttgttgaagtagttcttcaatttcatctacatctttaaaagatttataaacactagcaaagcgcacataagtaatctcatctaattcggcgagttcatccatcactaaatttccgatagtgatactagaaacctcatcttcatactcactcctaattttacgttcgatacgtaagatacaattttcaatatcttcgctcgaaacagggcgtttttgagcactctgaataataccattcaaaattttatctcgagaaaattgctcgcgagtaccatctttctttatgactaaaagaggcaattcttccaaacgttcaaatgttgtaaagcggttgccacatttttcgcactctctccggcgtctgatagtcgtaccttcttcagcttgtcggctatcaaccacactagatttattatagccacattttggacaacgcatgtcaacacccctattctatcatatcatttaatcatcttattttaacacaaattcagtaataacaaaagaagcgcctctcttatcacctcatcatatcaaaacacaaaataatccttatgccttttatcattaagcataaggatttttcttatatttctttagtttcttcaaatttttttataggaatgcgaacaatgaattcagtcccttgatttagttcacttttaatatccacctttaaatggtaagcatccataatttgtttaaacactgaaagcccgatacctaaaccagcttgtgtactttctctgttacgtgatttatcagttcgataaaaacgatcaaagataaactcaatatcttcatctgagataccttctcctttatcttttacaactactgtcgcaaaatcattgtctactgataaaacaacactgacttctttataactaggagagtacttgatagcgttatcaattaagatcatgagagcttgctcaaaatgtatcttatatatctttccccaaacgatatctgaaatattattttcaaaaataaattgaaaatcttctctcaaaatacggaaattttcaataacaactgatatagagcttgataaatctgtcacttcatcttgatgaagttccaagcttccttggacgcgaatcatatttaacatgtcattaatcattaaggacatacgatctgcctcatggtatgccgctgctaaactttcttcaagaatttctggatcatctttcccccaacgttgtaataaaccaatatgaccctttacaacagcgacaggcgttcttaattcatgactaacatcactaatgaattgtgattgtcgacgagtatagtcttccaactgatccaacatcccatcaaaaatcctagacaattctccaatttcgtcttctgaacggaccttacttctaatttctaaattactaggattttcagatatctgatgcattaagtcgtgtaaatttttaaccggacgaacaatacgcttagtagcactattaataacgaccaaggctaaaacagtccctaaaacttccatcataatcaagaaaacaatgatgttttgcctcatactataataacgacctaaattatagaaaatttgaacgtatccaagcaactgtcctgttttttgagagtagattgcttttgtaccaacaaaaccttccatatctgcaactttagagatgataacttttcccatggatttaccaatagttggcatacccgttctcagtgtagaaaaaactggtttcctgttgacatcgtatagggtcatttcttgattaacataaagaatactatcgattgactcgcccgttctaacaattccattttgacgcttatgaggatagatgtcatccgcaaaaacctggttgtacaggatctctaaaatatcatcggatgtcaaactagagttcgcttgcgacaaacgaactctagttttttctaatgacctaccgacattaattttttccctgtgaaggacgtatcttgttgccgaagtataaactaaaacagaaaatactgtaaataggctaaaaaataagataaaaactaattgcgataatttttttgacagaggttgttttacccctataaactgatcttttttatttttcacgaatcacatagcccattccgcgaacagtttgaatatatgattcacgacctgggatatcaattttacctcttaggtaacggatataaacatcaacaacgtttgtctctgctgccacatcgtatttccaaacatgttctagcaactcttctcgtgtcataacacgattcatatttgtcatcaagacattcaacaaatcaaattcacgttttgttagtgaaatttcctcatcaccacgcatcgctgaacgattatgagtatttaatgacaaatcacggaaactaccactatcacctttttcttttgtcttcgtttcaatttcttggcgtcggaaaatcgctctaacacgtgctaataattcttcgattgcaaacggcttaacaatataatcatctgctccacgatcaagaccagctacaatatccataacagaatcacgtgctgtcatcatcatgatataggttgttttttcagcctgcaggcgacgtgtgatttcgaaaccatccatctctggaagcattaaatccagtagaatcaaatcaaaatctttttctaatgctgtgtccaatccttcacgaccgtttgtttcaacaacaacatcatatccttcatgtagtagttctaacgagacgaagcgagctaaatttttctcatcttcgattattaagatctttttacccatctacaccaaccttcttattctttacttaacactatcaattattttttagaatatctagataaaaaacaagatagcccacattttactaacgtttctttaaataaataaatcgccatcccaaacaattgttcgatagcgagacttaatttttattattgagtagtgtcctctgtcacttttcaattctactaaaaaaaaattaaaatatcaactgatgttattaataatttttatctaatcactatcaaacataccttctaaggctgcgaaaggattagatttttctttttctttagcttgtttttcttcatactgcttttcagtcattaacgaccaatttttacctgataaatccgcttctaccccaacctcatcagctgccagaacacgaagaggtatatttaacaagatattatcgataacgctttcttctaaattaatatcatcttcctctaatattaagaccaactcctgatcaacgagctcttttttagtgctaacattttcagcttcaataaaaacttcattaatagtttgcttttcagataaaacaactggtttcatagaacgactagacggtaatgtaatatcgtaagccatattatagtcaagtagatagagaccatcttcatacaccacatgacctgaaacttgaatatcagaaatatccattatctctgaatgacgctccataagcgactctttgatatctatttttttatcaaaataaagcccctctggtgattttttgatttctgtaagtaacacgtgccatctccctttatagtatatgtcatattatatcaagttttacaggctttgtcttaaaaaaacaaaacgcaaggcatagctaccctacgttttgttaacgactacatatgacgcaaacgctcaatacgatctgcaattggtggatgcgtataaaataaagactttaacccttcttttttcgttgggtcattgatatagagagccgcactagcatcatctactggatgccccataggttcagaacgatcaagtttttctaaagcagagatcattccttgtggatttcttgttaactcaacagaactagcgtctgctaagtattcgcgctgtcttgaaatagctaattgaactaaactagcggctaatggtgcaaggattagtgataaaatagagaaaatcaaaaccaagatgtttccaccatcttctctgtcatcatcacgcctacgacctccgccgtaaaataacatacggctaccaatgcttgatattagagttacagcactcgctaaagctactgcaatggttgaaatacggatatcataattacgaatatgactaacctcatgtccaataacaccctctaactcttcgcggttcataacagctaataggcctgtcgttgctgcaacagcagcattttctggcttagagcctgtggcaaaggcatttagggagtcatcttcaacaatgaaaacgcgtggcataggtatctgagctatcattgccatatcttcaacaatatgaaaataatttggcgcctcatcttctgtaacttcacgcgcattgttcattgacataacaacattagttgattgaaaaatcatacttactgcatagataaccccaataattagagctagaacaagcccaaattggtagctgcctaataccaaataacctacagctgctccaatagctgctaaaagacagaagaagacaattaacaagacaactgtttttctcttattacttgcaatttgttgatacagcaaaagcctctctcccttctcaattaaaagtcaaaggaaacttttggcacttctttttcttcttcaggagtttctaagaattggcttggtttgaacccaaatagttttccaacaatattacttgggaaagtttctaatttcacattataattggatgttgttgtgttatataactgacgtgaataagaaattttattttccgtattagttagttcttcttgaagtttaacaaagctattgttggcttttaaatctgggtaattttcagcaaccgctaaaatacttgaaagctgtcttgttagctcattacttgctgtcattgcttcagcaggtgtgttagctttagcaacttgagcacgcagttctgcaatcttctcaagtgttttcccttcgtacgcagcatagcctttaacagtttcgattaggtttggaattaaatcgttacgacgtttcaattgaacgtctatttgactccatgattctttagtatgcatgcgacttctaactaaactgttataagcaacaatcaaccaaataacaaacaaagcaataattgctattaaaatcatagttcccatagtagtagctcctttacattttttccattatagcaattttctttagattaggaaagtcctgttattcccattattagtatttgtgataaaatagagtcattatacgatatagaaattgaggtttactatgacaccccaagcattttatcaagttctgatagagcatggtattacacttactgacaaacagaaaaaacaatttgaaacttattttagacttcttgttgaatggaatgagaaaattaacctaacagctattacagataaggaagaggtttacttaaagcacttctatgattctattgcgccgattttacaaggttatattgacaatagtcctcttagcattttagatattggtgctggtgcaggttttcctagtattcctatgaaaatcctttatcctgaaattgatattactattattgattcactgaataaacgcattaattttctaaacatattagctaatgaacttgaactttcaggagttcacttcttccatgggcgcgctgaggactttggtcaagatagagtatttcgagctaaatttgatatcgtaacagctcgtgcagtagctaaaatgcaggttctagcagaattgacaataccttttcttaaagttaatggtcgcttgattgcactgaaagctgcagctgctgaagaggaattaatttctgcagaaaaagctttgaaaacactattttcacaagtaactgtaaataaaaattataagttacctaatggtgatgaccgaaatatcacaatcgttagcaagaaaaaagaaacgcctaataaataccctcgtaaagctggtactccaaacaagaagcctttgtaaagttgggagctagtatgaaacatttctttgattacaagacaatgtctgtcgcacgtaaactcagcattagttttatcgctgttatcctattgggaagtattttactttcacttccaatttttcaatatgctaacgcccctaaaacacattacattgatcaccttttcacgactgtttcaatggtatgtgtaactggtttatctgtttttcctatcagtaaggtttataacggttgggggcagattgtagctattttactcatgcaaacagggggacttggtttagtaacactaatgtcgttgtcttactataccctaagacgtaaaatgtcgttaaatgatcagacccttttgcagtcagcgataacttataacagttcgacagatttaaaaaaatatctctatatgatttttaaagtaactttaactttagaagttttagcagccagcattttagccatagattttattcctcgatttggtttgggtcatggtatctttaatagtatattcttagctgtctcagccttttgtaatgccggttttgataatctagaggcaacgagcttagctcaatttaaactaaatcctttggttaacattatcgtttgtttcttgattatttcaggaggacttggatttgccgtatggaaagatttaattgaagctactatacaaacatctcacaagggaccaaaattaatcaagacatttccaaaacgcctcagcaaccattctaaactggttttaaaaacaacaaccattattttactaacaggaactttgctttcttggttgttagagtttggaaattttagaacaattgctaatttatctctacctaaacaactaatggtcagctttttccaaacagttacgatgcgtaccgctggattttcaactattgattatacccaaactgatttcgcaaccaaccttgtttatattatccaaatgttaattggaggagctcctggtggaacggcaggaggatttaaagtcactgttatcgccattttactcttactatttaaagccgaactgagtggccaaagccaagtgacttttcattatcgaacaattccttccagtattattaaacaaacactatcgattttaactttcttttttatcatacttattagcggctatctccttcttctggaactcaatccccatatagatcctttttctcttttctttgaggcatctagtgccttagcaaccgtgggtgtaacaatgaacactaccaatcaattaactctgggcggtcgaattgtaattatgttcctcatgtttattggtcgagtcggtccaattaccgtactgctatcaattcttcagaaaaaagagaaggaaattcactatgctgaaacagaaattattctaggttagaaaaggtcttttatgaaaacaaaaattattggtgtacttggtctaggaatatttggacaaacactcgcacaagaactaagtaactttgaacaagatgttattgctattgacagcaatcctgaaaatgtacaagctgtcgccgaagttgttacaaaagcagctatcggagacattactgatttagctttcctaaaacacatcgggatcagtgactgtgatactgttattattgctacaggaaacagtttagagagctcagtattggccgtaatgcactgtaaaaagttaggcgtcccacaagttattgctaaagctcgaaaccttgtatacgaagaagtactttatgaaattggtgctgatttggttatctctccggagcgagaatctgggcaaaatgttgctgcaaacctcatgagaaataaaattacagatgtcttccagattgaatctgatatttctgtcattgaatttaaaattcccaaatcatgggtagggaaaactgtcgaacaattaaatatccgtcacaagtttgatcttaacctcataggtatcagaaaagcaaaaaacaaacctgtcgataccgaagttccaatcaatagtccacttgaagaaggtattattctagtggctatcgctaactcagatgccttccaacgctatgactatttaggatactttaactaaagaaaataaaaaactgactattaaggtcagttttttattgccatgggttatagaaacgtccatgattaaggtgaattaaataaaggcttacaaacagactagctagagcaagtatgattaagacaatgtcacttttttccaaagattgcttagagtaccaagtacgtcttttatttttaccaaatcgtcgaagttccatagcagttgctactgtatcaatacgttctagagagctaaaaattaatggtgtgacaatctgcaaattccccttaatgcgtgctactaagttcgatttttttgataattctattcctcttgcctcttgtgctcgacgtattgtataaaattcttcttgaacatcaggtatatatctaagggtcaaactaacagcataagctattttatatgataaacctaattgatttaaacttgatgcgaactgactaggattagttgtcatcaaaaacaaaagagctaaaggcactgtacaaaagtattttaaaatcagattaaagaggtaaaacaactcttggctagtcacatcatatgggccaattccttttaacaataaagaagaactaccataaatcttatcaccataatggggagcaaaaagatagaccattataatatttaaaacagcgaatacaacaactaaagtcataacaaaggacacctgttgccatttgatttttgctaatctaaataagactagcgatcccaatgaaacaacaattaaaaatcttgtatcataagtggtcatgcaagcaacagaaactaaaataaaaaatagtaacttactggcacctgatagcctgtatagaaagccataaccctcttgataaccaattaattgtttagccattcttacctccttgattatcaatgtaccattgtgttagtttctgtggagatatccctaatctgtctgctaaagcaaataaactcgttttctttaaatgagtctttttcaaaagctctgtatttgaaaggatgttaataggatgatcatctgcaacaatcagaccattgtcgattacaattgcacgatctgtatactctaacataagctgcatatcatgtgtaatcataacaatggtatgtccatcacaacttagtttatcaaggaaagacatcatttcagtataatgcttcatatcttgaccagctgttggttcatccaaaataataacttctggatttaaaatcagtatcgaagcaatcgtaacacgttttttctgaccgaatgatagagccgatataggccaattcctaaattggtagagcccacaaacctttaatatatcgtagacacgactttctatatcattatcactaaaacctcttaaacggagacccagagcaacttcatcaaaaaccatcgcttgacttatcatctgattgggattttgcaaaacatagccaattcgttctgctctttcttttatagagtcttgactgacatcttcattattataaattagagtagcattattagggataaattgacataacgctttagctaaagtagatttacctgcaccatttttcccaacgatagctaaccgctgacctttatataaatcaaacgaaacatcatctaaagtattattctctaaatcatatgacaccgacaaatgctgtactgataataatttatctgtatgtttatctaaatctaatgctcgcattttaggtatcaatagttcactgaaatcaaagtcatcaatagacgtcattgtattttgtttttcaaagtcatatcctaaatttttgagagcagaaatatacagtggttctcgaataccatattcagataaaaaattagtttttaaaagttgatccggctccccattataaataatttgtccatcactaaaaagaactacacgatctactcgctcataaaaaacatcttccaatcgatgttcaataataatagtggtcgcatcttgctcttgatgaatacggtcaaccaatgccatgatatcttgtcccgattgtggatctagattagccaaaggctcatcaaataatagaattgggctatcgtctactaaaactccagctaaactaacccgttgtttttgtcctcccgacaagtcttgtggacgtttagacaaaagaggagctatttctaaacgttttgcccacatttcaacgatagaggccatttcttcctgtgctacaacatcattttctaatgcaaaagcaatatcttctgctactgtcaatcctataaattggccatctggatcttgtaaaaccgtagaaactaaatgagacttgtcatatattgacaagtcaaaagcatttttatggttaatcgtaaaaataccactatattggcctttatgagtatttgggataataccatttaaacaatgaccaagcgttgacttccccgaccctgaaggtcctaatatcaagaccttttcacctttaggaatgcttaagttaatcccttttaaagttggttcagattgaacgtcatattgaaaggtaaaatccttccattcaataaaatctttcatagattactctcttatcctaatctttggataaactacctttttgtggtcgtgatttagcgtatgctagcaacaaaagcgtaccacctactccaatagtaatggaattcacaaggcttgataagaaaccttgtgcaaaaactttgcttgcaggttcgctataaaagaaaatatcaccatacggtgcaacgacagaccaacctataaggttagcaataacttgaactacattaaatagaagcaaatccttcttagtcatgccagataattgaatagctaattttttagcaaaaaagcctatcatcaaacctaaaagaccactaactaaaacccaagtccaccacggagaaccatattgaatcgaatctttcaatgcgtgtccgataaaaccagtaaaaaaaccaactcctggtccataaataactgcaaataatgctaaaactgcatactgcaattgaatattagtatttggaattggtgttggtatattaactagcatacctataatgataaaaagtgcagctccaattccagtcgctacaaccttttttattgtgtttgtattcataaaaacctctctgaaaaacaagcttaaacagtcacttacaatctgttctattttatcatatttcaagctgatttgaaaccttattgacaagaagaactgaaaaacgattgaaaataatattaaataccaaaaaagatctcagatagaatacctaagaccttcattagtttatttttttccaaaaactgatttttcagctacagccgtgaacagaacgtctgtcgatgaatttaaggctgtctcacacgaatcctgtatcacccctacaatgaaaccaactcctacgacttgcattgcaacgtcatttgaaataccaaataagctacatgccaccggaatcaataaaagtgaaccaccagttacaccagaagctccacatgctgatacagcagcaaccacacttaataagaatgctgttggaaaatcaacagtaattcctaaagtatttactgctgctaaagtcaggatattaattgtaatagctgcaccagccatattgatagctgcaccaagcgggatagatactgagtaagtgtctttatctaatcctaaatcctcacatagtctcatattaacaggaatattcgccgcagaactacgtgtaaagaaagctgtaatacctgaatcctttaagcatcgtaataccaaagggtaaggatttttacgcatcataacaaaagcaatgattgggttaacgacaagagctacaaataacatcgtacccaccaaaactaatattaaaagaccataatcacctagtataccaataccgttttctgaaatgctagtgaaaaccaaccccataataccaattggggccaaattgataatccatttgacaacttgtgaagtagcatcagcaaaagtttgcattaaatcttttgtacgctgattactgcttcgcatcgccaaaccaaaaataaccgcccaaaatagaatactcatataattggcctcggtaatggcatgaatgggattatcaacaattttcaacaaaagagattgaaagacttctgaaatccccttgggaggtaataagtctgtctttgctggcgttttcaatatcagtgtcaaagggaaaatatagttcacaacaacagcgattagggccgctgcaaaagttgcagtgatatacaaaccaattatcgttgacatattggtcttaccgccctcacggtgttgcgacaaggcactaataactaaagtgaaaactaaaagaggggcaatagctttcaaccctcctacaaaaagttgaccaagtaaaccaatcgcagaggctttagggactaaaatacccaagaataagccaataacgactccaattgttattttttttatcaagcttgtttttctccaagcttttaaaaatcgtttcatactaaactcctaaaaaattcttaaactctatgatatgataaaaaaaaagattcgtcaaataccttttttattttttagaggttgacgaattctaaatttttctgatataattactttttgaaatattcaatcaatttcgaaaataaaatatttttttgtacagaaaggtacattgatgaaactaaaaaacacttatatcattatcggcttgatgctttttgcgctgttctttggagccggtaatcttatttatccagcctacttaggtatctactctggttctaattgggcgtgggctatcattgggttctgcttaacaggcgtaactttacccctacttggtgttgcagctgtggcgtactcaggagcaaccgatgttgaaagcttcaccaaacctgtctctaaaacatatgctattttctttgcagtagcactatacctatctattggacctttctttgccattcctcgaacaggggcaacctcattctcagttggtattcaacctatcttaggcgacagctccttagtcaaaattatctatggtttaattttctttggtatttcttatttcttagctattagacctagtcagattgtagatcgtattggtaaatatctaactccctttttactaactgttattagtattttaattattgcctcactcatccatccagctgctatcgttggaacaccacataacgcttcaacgaatgtcagcgatgctttcaaggatttaccattcctagcaggactgattcaggggtatggtacaatggatgcccttgcatcaattgcttttgctattatcgttattcaagcaagtaaacagtacggagcaattaccaaaaaagaaattacttctatggcacttaaatctggtgctatcgctacatttcttttagcttttatttatatttttgtaggacgtattggtgcaacttcacaaagcttgtttaaatttgcaaatggttccttcttacttcacaatactccaatagacggtgggcatgttcttagtcaatcagctaacttctatttaggaattgtgggacaagctattttaggtacggctatttttcttgcttgcttaacaacagctactggattaatcactgcttgtgcggaatacttccacaaattacttccaaagattagtcacattacttgggctacaatctttactttaattgctattacgttctattttggtggtttatcagagattatccgttggtcactaccagttctctaccttctctatccattaactatagtcttaattttcttagtcttttttgatcaaaaatttgaaagtagccgcattgtctaccaaacttctattgccgccactgctgtcgctgctttatacgatgccttatcaaaactcggcgaaatgactggtttatttaccattccatccgctttgaccacattctttactaaagttgttcctttaggtgaatattctatgggatggattagttttgcaatttgtggtgtcttagttggtcttattctaaaaaaagtaaaagcataataatttaaagcagtacgaaaattactgcttttattttaaaataattattgtaaccgctttcttttggtggtataatagccttgaaaataaataatttttggaggaactctaatatgagagctgcaacttatctttcagctaatgaattatcacttactgataaggctaaacctcaagtaataaaacccacagatgcggttgtaagacttgtcaaaacaaccatttgtggtactgatctacatatccttggtggcgatgttcctgcttgtaaaccaggaacaactttaggtcatgaaggcattggtatcgtcgaagaagttggttctgctgtcaatcattttaaagtcggagataaagtaattatttcttgtgtcactgcctgtaatacttgctattactgtaagcaccagttgccttcacattgtgaagatggcgggtggattttaggacatcttattgaaggtactcaagcagaatatgttcatattccacatgcagatggtagcctttatcatgcacctgaaggtgtttgtgacgatgcattggttatgttatctgatattttaccaacttcatacgaaatcggcgtcttaccttctcacattaaaccaggtgatactgtttgtattgtaggcgctggaccaattggactatctgccttactaactgcacaattctattctcctgccaaaattattatggttgatttatctcaaaaacgacttgaagcctctaaaaaatttggtgcaacacacaccattctatcaacgtctactcaagaagttaaagaagaaattgataaaattaccaaaggccgtggcgttgatgtcgtattagaatgtgttggttatcctgcaacatttgatatttgtcaaaatgtagtttctattggaggacatatcgcaaatgttggtgttcatggtaaacctgttgaatttaacctccaagatttatggataaaaaatataacccttaatactggattagttaatgctaatacaactgaaatgctccttgaagttcttgagacaggcaaaatcgatgcaacacaactagtaacacatcacttcaagctatctgaaatcgaagaagcttataaggtatttaaagctgctgaagaaaacaatactctcaaagttatcatcgaaaacgatattactccagcctgataatttttaaacaaataaaaatgtgagaagaatagccttctcacatttttatttatgactcaagcgacgtgttaaaaaatcacctaaaaattggataaagaaaattaataataaaatcagaatagtcgctactaaagtaatatcatcacgagaatagttatatcctttagtaatagcaacagaacccaatcctcctgcaccaatagcgccagccatagctgtttcacctactaaagaaatcaaagtaaccgttgatactcgaattaaatctggtagaccttcacgaagataaactacaataatatcccaaagtgttccacctgaggcttgtgcagcctcaataactccaccatcaagttcagctaaaacaacttgaacttgacgagcaaaaaatgggaaaactgccaaagaaagaggtaccaaagctgctggtgaaccaagtgttgttcctacaattacgcgagttactggcgcaatcaaagcaagaagaataatgaagggcagagctctaaaaacagaaacaactttatctaaaactccaaatactaatttattagcaataactcctctaggactagttaaaacaaggaataaacctcctaacaatcccattaaacctccaataaggaacgaccaaaaagtcatataaagggtttgtacaatagctgtctgccagccgtaagcaccttcccaacccatttgatatacatttggtaaatgtgtttgaatccactctatcatgctttaccaccttctttcaataacgttaattgaacttgcgaatctgtaattgcttggcaggcttgtcttaatttttcttcgtcacctgataagataactaccatttctccaactggaataccatctaaaatttcaatattcccatagaggatgttagcagttacttcaaattctttataaatttgatttaaaagcggctcatccgtgctatgcccagcgtatttcagttgaactaatttgctacctactggtagatttttgacaacttcttgttgctcaatcttaagcattgcctcatcaataccagtagctatttttataaaatcttgtgtaagactctctctaggatgtgaaaaaatgtctaaaactgatccttcttcaatcaatttaccattttgcataacagcaacgcgattagcaatgtctttgacaatttgcatctcatgtgtaatcaaaacaatcgtaagtcccaattttttattcagatcttggagaagggcaagtatttgttttgttgttttagggtcaagtgcagaggtagactcatctgaaattaagattttaggatcgttagccaatgcacgcgcaatggcaacacgctgtttttgccctcctgataattgtgaaggatagttttgagcacgatcggataatccaacaagttctaataatttagcaaccttagctgctttcgcctcttttgataaacctgaatgtttaagagcaaaagctacattctgctctgctgtcaactgtgacattaggttaaaatgttgaaaaatcattccaatttcacggcgctgttcgcgtaattgtgtgctagtcagtgtcaccttgttgtcgtaaataacttggtcatcaatagtaattttacctgctgaaggttcttgtagcaaattaataacacgaacaagggtagattttccggctcctgaataaccgacaattccatatatatcaccttgattaatatggatagtaacatctttaacagcattaatctcacgtttcttttggtggaaagtaacatcaatgttgtctaatttaataattggttctttactcatatgattctattaaagcctccactaattcaatatgggtgtaataatcagcaatactaacattttcatcaacgccatggtctcgactattggcatgtcctatgccaatagctgcaattggcgctcttagagcttgatgaactaaatacattggtcctgtacctggtgaggtaggtaacagagatatcccttctggataaaattgctcagctaaatcaacaacctttaggatagatggcgctgacatatcactacgataagacatttcaccaagggtataggttagctcaatgtctttaaagccattctctttcaaatgattttgtattgaatctagtacacctttcggggttaaccctggtactaacctaacctctgctttacatttagcataagcaggtaaaattgttttgacgccttcaccttgataacctgaggttataccttcaatggctatagaaggttcaaaataaagctttctcaaaaaagttttatgactatctgctaaactgggcaaaactaattggtaagcaccttctagcgcctttgcagatctataagaatatttttcaactaattctaactctctcttagtagggggaataactttatcataaataccttctaccaatatatgacctttgttatcccttaacgtattgagggcttgaattaaataccatgtcgaggaatcaacaaccccaccaaaggatgaatgaatatcaacatccgctgaacttactgataaatcaaaagtgacaatgcctttatttccaccagcaatttccaactgtcctttaggatttttagggccatcttcccacacgatcaaatcagccccttgtagctgctcttgatacttttctaaataataatcaaggcctactgaagctgattcctctgctccttccacaataaaagtgatatctagaggaagttcccctttgtgtcttgataaatattttttaactgctgataaacgtgcggtaatgtgacctttatcatcatctacaccacgtccatacatcttaccatatcgaagtgaaagtgtaaaagggtcctcagtccactgttctacctcatctgctggtacagtatcataatgattgtaaaaaataatacgcttagcatctacttttgatgatttgaaatttgccacgataaagggagcgctatagctgtcatctataatgacttctgcgccagcttttatgaaaacttctccaagatagcttgataagtcatttaaaccaactttctgagcaaaaattgacttaattgcaattaaatctcttaaaatattgatatcatcctgaacaatagtatcagatagaaacttttgaatttgattttcttcgtttgttaaagtcatctttcatccaccttccttcaaaaacaatccaagagcctggcacattgtattcgtcccaggccctttatggctatatggctgataagttgtatcctattaggattccctgttaaacttatacagtcaattcacgttaccattgtggaatatcagctgaagtatctttgataacttttttcacttcatctgtgtgataagcatccaagatagcttggatagctttagcgttcttttgctttttccaatttttacgtcccgcaatgatattaatccattgttttgaatttttatctgatttctcaacaaagatagcatctgaaggttttaaattagcttgctcaatgtatgtattattaataatagctgcatctacatctttgagtgcacgtggtgtttgactcgcatctaactcctgaatattaatatcctttttattagatgtgatattagcaactgttgcaaccttcttaccagaaacattcaatttgattaaacctgctgactgaaggacatacaatgcacggctaccatttgttgcatcatttggaattgcaatagtggctccttttttcaattttttaagagattttaccttctcagaatagatacgaattggagctaagtaagtcttttcaagtggaattaagtttttcttattttccttattccagttttctaagaaattgtaatgttgaaaggcattaatatccacatccttattggctgtcgcttgatttggttgtgtataatctgtaaattctgtaaatttgattttagctttatcacctactagcttttcaattttatcccaacgtgctttttcagtgtcagaaaaggtcataacaccaactttaacaactttacttgaagttgagcttgctgaaacttcttgattactaaatgtgactcctaaaagtgttgttaaggctaatcctaagacaatatgttttaacttcataataaattccctcaatttttgtgataaagatattatcccataggaagttattagaatcaaattgttataaactgtctcttgttatagttttaaactatataacaaaaaactaaggattgacatctccttagtttttattactacttctccttaggagtaacgagatctttctcatttggtacgtaatcacctccaaggtattctttagctatttttgaaagtgtcccatctttacgtaattgtttaaggcgattattcacatacttttgcaagtctttttgatcctgaccaaagatgaaataaatataaggctgatctctcatagtcaaagggatggtttttaaattcgtgagaccttgattctttatgatagcgttaacagttggtccgtcaaaaagtttaaaatcagcttttccatcactcaaattcgttagaatctgtgtaatattttcattagtatattttagagtaacaggatttttctgatgctctttattgaaattttctaattgcttggcagttgtcgttccttggacaacctgtgttttatgaccactaatatcattataagctttgatattactattcttaggaactgctaaaactgaaggagtagagcctattgggtatgaaaataaatatttttgagatctctctgatgaataagaaatattatttccacccatttgaaactttcctgaatcaatgccggtaaataccgatgaccattctgtttttttaaaagtgactttatagttatctgaacctttaaaaacagctttggctacttcaatatcaaagccagtcagtttcccatccttcacataagaaaaaggtgccgttgttccaacagttgcaaaattaacttcttttttgcccgtcttagtagtatgagattttgagctacaagcagctagagacgctactgtcactaaaataattcctgttacacttaacactttttttattgtcatcttttttctcctctttaattgtacacgacatcataacatctttaagtttttaactaacacttatcttctatcgtctgagagtttttgctattatatggatgctacgtttcattaacaaaataaccaaataaggtttggttttcaatttggtgaagcattaattctggatgccattgaacacctataatacattgttctgttcgactttcataagcttctactgtcccatctctaggatctctagcactaactatcagaccttcagctaacagtttaacactttgtctatgaagagaattgatcttaaaatcacctgatataaagccttctagaaaactccctttttccacatttaaataatgagcaaatccaatgtaaggctcttgatagtgattatcaatagattgattaagtgtaccaccaagcgccacatttactaactgcatgccacggcaaatcgcaaagattggtttattttgtttcaacgcttcttcgactaatgcaaattcaaaaatatcacgcgcaagtgaataatcatcactctcaattatcttctcttcaccataataggatggtaaaacattttggccaccagatatgatcagcttatctatcatctcaacataagctttggcactttctgcttcacttattggtaggataactggtaacccgcctgcgtttttaactccttccgaaatatgcctagataccgaatcataataataacctggaatatctgacatttctctttcatttcctgtaataccaataataggctttgttaacattttgctccctcatcaaccaacaactgtctaataattatcattttacacctaaaaaaactttttgaataatattttttacctatcacttctttaacaatacctatcaactctcacaaaaataaaaaccatagtattaatactacggttttattttttagaaatctgctacattatgataaactttttgaacatcatcatctgattcgagtgcgtcaataagcttttcaaaagtttcaaggtcatcaccttccaatactacttctgattgaggaatcatttcaagttcagtaacttggaattcttctacaccattatcgcgaagtgcttggatacctttatgaagatctgttggggcggtataaactgttattgttccctcttctgcttcaacatcatctacgtctacatccgcttcaagtaattgttcgaagacagtgtcagcatcatcaccagcaaaaacgatgacaccttttttatcaaataagtaggataccgatcctgaagctcccatattgccaccgttcttaccgtaagcagtacgtacatttgctgccgtacggttaacatttgatgtcaaagtatccacaataatcattgaaccatttggaccaaaaccttcatagcgtccctctacgaaagtttcatctgtgtttcctttggctttatcaatcgctttatcaataacatgctttggaacttgtgcttgcttagcacggtccaaaacgaattttagagctgagtttgactcggggtctggttcaccttgctttgcagcaacatatatttcaacaccgaatttagcgtatacttttgagttagcaccatctttagcagtctttttggcaacaatattggcccacttacgtcccattggaaaatctcctttgatttcatttttaataacctgctggctcatattggcaagcaatcttaattttaactctattattatagcactttgatagcaattggtaaaatggaaattctatcaccaagctctagcatctgtcttatgttttaagtaatcaatccatctactatcctttacacgacacaaggtaactgataaaccagccatatctaaacttgtaattaggtggcctgttttaataaaaggtaattgtaaatcgtctaaagccagaaattccatgacagcatttgtaaaaagtaattcctccattttagaacttcctccaagattatttatcaatagaatgaatgcttctccatcttgccaacgtaatttcattttcaatttgttaactagttcgtttgccaaatgttccatggacacgaaaggcattgtccggtatcctggctcaccatgaataccgattccaaatgagatgtaaccttcttctatatcaaaaacaggttgatgctgacctaaaatagtggctgacttacttgctacacctaaagtagccattgaagttgtcaaagatagtcctagctgttctaattcatctaagcttgctccttctaaagcagcttgtccaataattttatgtagcaacacagtaccagcaacgcctcgatgacgaattttaaaatttgatgtttcaacagagatgtcatcatgagaaacgatgtatttgattggaatgccttcttgacgagcctgttcaatcgcttgggaaaattcttccaaatcagcttcaaaatttttgataataacaaagacacctttgcctcgattgataaatctaatagtctctagaatatcactagcacatggtggtacaaaaataggaccactaatcgctgccgatagcattccctcaccaacatatccaaagtgagccggctcatgtccgctgcctcctcctgataaaatcggaattacttgctcggattgccctaaataatgaatagcgggcaaatcttttatttgctctactttaggattagttttagtgattgcttttattgtttcaaaaacatattccattttatgatgttctgtttttctcatatccttgtcctaataattttctattgatgttctgataattttttcaatgactttcctattaaataattcttcttttgagttatttattaactcatattttataaaataagagagggctttactatgataattaataaatgtaactctttctttctgattaaagttagatttactataatcagaaagaagcttatctactaactgctcacagtaagactcaaaatacgaagaaaaatcattttgatcttcaatttgaaataatttaatatagaattcttgattcattttaaaaaaagtcaacaactctgataacaactgaaaacctgagatatagtctaaattatccgtaacttgttcgcttaattctgtttggaaaatccattctaataaagcatatttatcaacaaagtgattataaaatgtttgacgtctaatacctgcatcttccataatatcactcaccgatattttgtcaaaagcttgcgaaataaataaacgtttaaatgacttggctatttttttcttagtaataagcgaagaagtcataatttctcctttattttatattgaattgctgatgatttattatggtttagtgtaacatgatttatgattattgaaaaccctaacaaagcggacaaacaagaaaatctgtccattccagaaaaggcttacaaattttataataaaagagaattaaacataaaaggagtttccaaatgaaaaaaattctcaatcaaccaactgatgttgttactgaaatgctagatggattagcatatgttcataatgatttagtacatcgcatagaaggttttgatatcattgctcgcaatgaagagaagtcaggaaaagtggctctcatttctggcggaggaagtggacatgagccttcacatgctggtttcgtaggcgaaggaatgttatctgcagctgtgtgtggtgcagtatttacttctccaactcctgaccaagttcttgaagcaattaaagaagctgatgagggggctggagttttcatggttatcaaaaattattcaggggatatcatgaactttgaaatggcacaagatatggctgaaatggaaggcatagaagttgcaagtgtggtcgttgatgatgatattgcagtcgaagacagtctttacacacaaggaaaacgtggtgtagctggtacgatactcgtccataaaattctaggacatgctgctcgtcatggcaaatcacttcaggaaatcaaagctattgctgatgaattagtaccaaacattcacactgttggacttgcactaagcggggctactgttcctgaagtaggcaagccaggatttgttcttgcagaagatgaaattgaatttggtatcggtattcatggtgaaccaggttatcgtaaagaaaaaatgcaaccttcaaaggctttagcgacagaattagttgataagttaattgaatcgttcgatgctaaatctggcgaaaaatatggtgtccttattaacggtatgggtgcaaccccacttatggaacaatatgtctttgctaacgatgttgccaaactccttgaggataaaggcattgaagtgaattacaaaaaacttggtaactatatgacttcaattgatatggctggtttatcactaaccttgattaaactggaaaatcaagagtggttagaagcacttaatagtgacgttacaaccattgcttggtaatcattcctgttaattagaacaaaaggaaggaactcttatggaagtaaaaactgcaatagaatggatgcacacttttaaccaaaaaattcaatccaacaaggactatttatccgaactagatactccaataggtgatggcgaccatggtggcaatatggcgcgtggtatgactgctgttattgaaaaccttgataacaatgaatttagtagtgctgccgatgttttcaaaaccgtgtccatgcaacttttaagcaaagtaggcggagcatctggaccactctatggttctgcatttatgggaattacaaaagctgaacagagtaaaagtaccatttcagaggcacttggcgcaggacttgaaatgattcaaaaacgtggtaaagctgaacttaatgaaaaaacaatggttgatgtttggcacggtgttattgaagcgattgaaaaaaatgaattgactgaagaccgtatcgattccttagtagatgctacaaaagggatgaaagcaacaaaaggacgcgcttcttatgttggagaacgctcagtaggacacattgatccaggatcattttcttcaggattattatttaaagcattactagaagttggaggtgtctaatgtctgatattggtattattgttgtttctcactctaaaaatattgctcaaggagttgttgatcttatttcagaggtagcaaaggatgtctcaataacttacgtgggtggaacagaagatggtgagattggtacttcttttgatcaagttcaacagattgtagagcaaaatgataaaaagacgttattagctttctttgatttaggttcagcaaaaatgaatttagagttagtagctgatttttcagaaaaaaatattatcattaactctgtcccagtagtggagggagcttacaccgctgctgctcttctacaggcaggtgctgacctggatagtattcaatcacaattagctgaattaactatcaataaataaggagatattatgactcaatttcttggggaatttttaggaacatttattttggttcttcttggggatggcgtagttgcaggaaatgtgctcagtaaaaccaaagaagaaggaactggatggactgctattgtttttggctggggaattgcttgtaccgttgctgtttatgtttctggattattcagtcccgctcatctaaatccagcagtcacattagcaatggcttctattggagcaatttcttggggacaagttatcccctttatcattgcacagatgttaggagcaatggttgcggcaactattttatggttacactattatcctcattggaaagaaacaaaagatagtggacttatccttgccagcttctcaaccggacctgctatccgccatacaccatcgaatctccttggtgaaattatcggtactgctattcttgtgattacaattatggcaattggtcctagtaaagttgcagcaggtcttggtccaattatcgttggtatagttattttcgcagtaggattctctcttgatccaacaactggttatgctattaaccctgcacgtgacctagggcctcgtcttatgcatgctatcttacctattgaaaataagggtaactcagattggtcatacgcttggattccagttgtaggtccaattatcggcggtgtccttggggctatcttatacaatattgctttgactttagtttaactaaaaaaccagaaagttaatactttctggtttttcatagttgcagtatgctttcaaaatagaaaaaacaccaaaatacttagtgttctttctggagattttatgaaaaaagtttaggatgtttatagtataaccgcccttacttaacgtttccttaaaagctcggttattaacattacttcctaaattactatttatattctccaagaaatgactactattaagctaaaaagcgctattgacatagcgctttttagtctagtattatttagtttcagtagtaactccatcaaaatcttcttcattttcttcagcttcttctcttgtggcacggataataccatctttgtgatgagctggactgtaaattgtatagagttttaacatctcagtttcagaagtgttaattacgttatgttcagcacctgccggaactattatagcgtctccatctgcaacttcatattcattaccatcaatgacaaccttaccatgaccagcttcaaaacggaaaaactgatcattttctgcatgaatctcgctaccaatttctccaccaacaggcagtgtcattaaaacgagttgacaatgttctgcggtatagaggacttggcggaaatttgtatttcctagtgtcaatttttcgatattcccatgaaatcctttcataacgatacctacctttctatgcctacagtctactctttttgctccttactgtcaaaaatttagataagagtctgacatttttaataatatctactgttccttgattcctatcatttcattgcaaacctaaaatatagcctaatgacaatagctatctatagctttagaaacaaataatgctgttccctggcctccccaattatcaatagacttttggaaacgctcatcttggatgtacattattccaagacttgctaataaatcgttagtgcagttgtaaaactgagctgtgatataatcttgtaaaatctgaacttgtttttgaactttctcatctgtcggagaaagttctttcaactgtccaaagtctttaaaaatctgactcatagcttgtgaaatcattgaaaaatcattcttactatggctattttcaaattctttgtaactatctgtatccccccagcgtgttctagcttcctcttgaaatgcttctaattcttcttgattataagctgtaaaatctgacatatttttacccctctggatagactttgcatgttcaattacttcttctagtcgctgtttctttagttccagccacctaatttgatcaagaagtgcttgattacgatcataatttggactatccattatctcttttatttttttaagaggaaattccagttccttaaataacaaaatttcttgtaacttaatcagtgattcatcatcatagtaacgataaccattctctcctacaaatgaaggagataacaaatctatttcatcataataatgaagtgtgcgcacactaataccagaaatgtgacttatttctttaactgttttcataataacctctctgtaaagagtataatgtataacgttaagtaagggtcaagggaaaaatattattttgtgatgattaatttataaagcttaaatcaaaggtcactttgactaacaggttgataaaaagggatacgtccccatgtttgctctgctatattagcatttcccatctgataaacagaatctgctcgttgcgtcaaactatcccacgtttgtgaaccaatcctcgtcacgatatccacagacttcttcacagactttaaatgctgttgacctttttgtgtaaaacctaagacatgaatagcatttggtataggactttccacagcatttatcaagatataggttaataaacgtcgaattcttgctttggtataccgtttagttgcgactttatcaactaactcatccacagtctccacataacgaatttgactttttatacgattggctatctcttcattcacttgataaatttgtgtcaaatcagaatgcgtcattatctgatatttgagtaaactaaaataatcttgccaaactacttgtggactattcaaaaacaagtcactgttaggcatacctttttctacaaagaaacgatcagattgatgtttacgaagacttgttgcagaagcaaatatctctgttttttctgatgaatgataaccagctccttgacgttgtatcggatttaatcgaataccattttggctagctgctttggtgtaggctaagcctaaaatgtgatttggggtttgtcccgaaaatgtaatccctgcaaattcttgccacatagcttgcattttttgtggataggaaagagaatccgattgttttttcaaaaaagcttccatctcctcttttttattcacataaatatccccaatacgggcataatcaagcatttcttcggtaccgaagcataagttatccacacctaatcgtgccaggatagacacagctccactagcgaaataatccgctgactgtaccgaaaccagaaaagggagttcaatcactaaatcagcaccattttctagtgccatctgggaacgggtccatttatctacaatcgccggctcaccacgttgcataaaattacccgacatggctattacttttatgccttgagcttgttctaaaaggtacttatgcccattatgaaagggattaaattcggcaacaattcctgtaactgtcatacttctttctctttcaattgattatttaaagtaacagcatcaataatatctaggtgataagttttacgaaggtatatgagacgatctgtttctttttcaaatggttttaatgccgataataaatccaaatgaagtttagggttcatcaataattccaaaataactttagactttttctgacttacccgacgttcaataatataaagtatcccaaatatcatcagacaagcgtataagaatattatcatctttttacctccaaattattacttatttatgagctacaaaaaaccagcgagcagaagttgcagttggttttttatcttcaaaatctgcatacaccttaacatctttaaaacctgcctgttcaagtaaaatatcataagtcaaaatatcataagtacgctcttcatgaacttcatcatgacgtgtaaatcgaccatcttcttcttgaacaaaaaatgttaattcatggacaatagaatgaggtgcatcatcttcataagtatcccacaccatagcaaagtcatctgcattttcatgataagaataaccaggaaatactttatctgtttgataagtcgaatgaacatcaaaaataaagacgccattttcttctaaggccttatagacttcgataaaaacatcaccaacctcgacttcatcttgcatataacaaatagagtctgaatagcacgtgatgagatcatatttaccaacattagataaatctaacatatttccttcaataaactggatactttggtgagcagaagttgcacgttttttggcaagtttcagcatatcgccactaagatcaagtcctgtaacagcataaccagcttgtgcaaatcgaacagactgaattcccgtaccacatgctaattccaaaagttttttcttaccttttggaaaatgacgaagtgaaaaatcagtccatttagcatataaagtatcatccatgacagcatcataaacagctgcaaaagtttcatacgttgccatataatagttctcaaatctttcttgatattacatctctcaaaaagcagtcccaagactgcttagctttattctgtcataaagacttcagcatcaagcaatggtgcttcatgccaaagtttttcaaggttatagtgctgtctctcatcttcagagaagatatgaaccacgacgctattgaggtcaagaagtacccaaccagctttactatcgccttcaaggtggctagcatccccaccatttccttttacttgttcacggatattgtctgcgattgcttctaactgcctactattacttgcactcataatcacaaagtaatctgcaacactcgttacaggctgtaaatctaaaattacaatatcttctgctcgtttttcatccgcagccttaacgactagctgtagtaagtctttttctgtcattttattcctcgtttattaatttcaataagctatcttttgctaccattgtcgcaaaacgatgatgccaaatattctcgtaatgttttttaatagaatccccacttaaagttggtgtatcaaatgttaggtgtccaccttgtggaataaagatatcataaccatattcaaaagcaacttttactgatgtatcaaaacagtattctgtttgaagtcccatcatgattaattgactaatatgcttactttgcaagtaatcatgtaaatgagtatctttaaaacaactattgtaagttttatcaattattttgtgatgcgtcacaagatgtcgctgttcccaaatttcccactgtggagaaccttgaggcaattccttatcatgatgccttatccatatcacttcacaattagaacctttggcacttaaaagtaaatcatctaaaagcactgcaaaatttgttaaatgctttggtttcttatccataataccttgttggatatcaattagtaaaagtgcacaagtcatactttcctccaaaatgaccactgcatcgccaaacctatcatgaccattattcaataaaagaattagtcgagataaggtatataagcattataggtttcaatcgttttaggatagataggctgagccttacttgctaaaaacgcaactgttctagcagtctcataagctactgctttattaaggtcaactttcgctaactcacgagcttcttcaactcctggaaaatctcgattgtgttcaatgtaatctgctacataaacgattttatccaatgtggacatttgggctgaaccaacagtatgttttgcaatagcagctaaaatatcttgatctttgatagctagatcctcttgtattttataaatgccaacaagaccatgccaaatattattaccccatttttttaggtcgggatctggttggtatttatcaattaatctaagaaattcatcatcagatagttccttagcataatcatgtaataaagcagctagacccgctttttccttgtcataaccataccgttctgctaactctattgcagcacgctctactcctaacacatgattaaaacgtttgtcggacatcatatgacgcactttactcaaaagttcagtccgatctaaacctgtgtaatctttgtaggtcatttgtaaagaccttctttcctgatataatctaatacctctctaggcagtaaatagttgggctgacgattacttttaataaattgacgaatcatacttgatgagatatccatcaatggcagatccacccaaataacgggatatgatgtaccagctttatattttggacgttgaacaccaacaaactgcaccattttaacaagttcatcaatacgatgccacttaggtagatattccaccatatctgccccaataatgaaataataatcaacatctggatttttttcaattagaagcttcatcgtatcgtatgtatagctgatacctttacgttcaatttcaattggttcaatagataaaccatcaatgccttctattgctaattcaagcatcttgagacgatgctgttcatcaattgtctcttttttatcaatatgtggtggctgaaattcaggcatcaacagaacttggtctaaacacaattgctgacgtacttgatctgcaacaacaaggtgggcgttatgaacagggttaaaatttcctcccataattccaatttgttttcggttagtatctcgctttttctcttctaattcaacttttgtaaatggtgttagcaattcgagtgccataattcctccatgaacaagtagtatctctaaaaaaacaaacactgattatcatgatcagctatcatacggaagtgtaacttaggtaaatcgttttttagttctatactctatttcttaatctattgtagtttagtttgattttactgcttttactttaactgaaattttacgattttctttgcgcgctgactctttataaagaatcaagatacgtcctattttaaggacagtatcgcagccaatttcatcttccagaacttcagcgacatcgtggatatcttcatcggtattttgtaaaagggttactttgattagctcacgtgcatcgagtgcattacgtacgcttgttttgatttgatcatttaaaccatttttcccaatttgaataatgggtttcatagaatgtgcttctgattttaagaaagcacgttgtttagatgttaacatattagtttcctttttatctattataggattatgactgtatcatcagctaaattagatgaaaaaccgtcatatgttgctggttaatttagttattaaattaaagctttgcgtaaaacaactgccacgccttctggagcccaagcagctactactactggattttctgcttctgatttcacacgtatccaaccaagacccgaataaacaatatccattttatctttgattgtaaattcatgacgaactaatttaggaaaatctgaaacttccttacctgttggtggtgtcaataattttccaacatgtttagtgtaaaattcatctgctccaactagtttagtgcggtgtaaattcaggttattatcaaaatatgccgtaaaaccttgtttttgaccagaaataaaatcaaaacgtgctaggccagccaagaataatgtttgttctgaattaagctgataagttttgggttttatttcttttttaggactaacatatttaagattttttgctgtcaaataatgagccatttgatgacgatgaataatacccggggtatcaaaaatatagctaccatcatcaagaggtatttctattttatctaacgttgtacctgggaaacgtgaggtcgtaataacatcacgactaccagtaatttcacgaataatagcgttaataagagttgactttccaacattagtaaccccaacaacataaacatcttgaccatgacgatacttttcaatcgtatcaatcaaatccttaatagcatgatgattttgggcacttgtcaagatgacatcaacaggacgaagcccctcttcatgagctctctcagttaaccattgtgttacttttccatctttaaccgatttgggaagaatatcttttttatttcctactaaaagaacatcgtttcctgcaacgaaacgactaagaccaggaataattgaaccattgaaatcaaaaatatcaatgacattcaccacaagggcatcactatctccaacctcatgtagtaatttcaaaaattcatcatcagtgatatgaacgtcagtaatctcattatagtggcgcaatctgaaacaacgctgacagtataattctcctgtctctaaacctttttcaagtgctgcacgaggtgtatagccagcagcatctttattttcagtttgaatcctggctccgcagccaatacaaaataactcttccattaaattcctttttgatatacgattttaccgtaattctcttctatttttttccaaacgcgacgttcacgtaagcgattgaacttggtattccaagcatcagatttaacaattggttttaccaatacggactttattcctgcgcgatgactagcacgaatatctgtcatcaattgatctccaaccataatcacctcgtcacgatcaaagccataacgctcaattgccatgtttataccacgagtaaatggtttcatcgcacgacttacaaaatccacaccaaaacgtgatactgcacgttctacgcgagcatgattgttattagacactactacaactgaaatatccgctgttgtcatctcatctaaccatgcacgcacctcagcagtaccatctggattattccaagcaatgagtgtattatctaaatcaactaaaaccgcacgaatgccatgacgtaataaatcttctgctcttaaatcataaactgcctcaaccacgaaggtcggcctataatcatctatactcaatttcatctccaaaaaatatattttactattcattctaccataattcttaagagatagcgagtaaagaaaaaaggtctttaaagacctttaaattagggtttcaaccccaaaagatactatcttactcgtttcattttcttcaatgcaattaaatctttgtaagagattagagttacagcaagaaaaataaacagcatcccaagtaaatctattggataaaaaatttctcctaaaacaagtactgtcaaaaataccgaagaaactggctctaccgatgctaataagctacccttgacagcacctacaatactaacccctttaaggaaaaaagtgtaagcaaaaatagtcccaataccaataatgccaatataagcaagtatactcatcacattaatttgtaaggggtattgccacgcttttgtcaccaaactaaataaaatcccacctataaacattcctgaaccaataacaatcgtacttccccattcatgaataagtttcacaggtaataaaatataaatagaataagtaatggcggaaccaagcccccacattaatcctttcggtgtgatagctaaacttcctaacttcccatgcgttgcaatcatataggttcctaaaattgccatagcaattgctattatttcaaaagatgttggtctttgtctgtttaggatacaaacaatactcaaaataagtattggtgccatatattgcaaaaccgttgcagttccagcatttgttaaatgaatcgctctgagaaaagcatattgatttaaaactaaaccaaatatagaaaaaagtaaaacctgctttaaaaattttggctgtttccacgctgctactaaatgctccttttgttttgatctagctaaagacaagagaaagatacctgttatcaacaatcgtaaagaagtcaaaaggttaacgtgtactccgtgcgacatcaagtattgaccactaattccagaaatgccccatgctagtccggcagctaaggtcatcattgttcctttttcttttttagtcatttttcccctcatttttatttcttaaacactgtagttaaagtcatctgataaatatcttagcttcttaattatttatccctaggtgttcgtgctaaattagcgaataaaaaccagccaaaaggctgatttctattcttcttttaattttgctaattcttgcgctaacagcttcagagcaacttgtggattagcttgtccttttgttgctttcattagataacctgtgaaggccttatcagcattgcgttttcctgacttaaagtcaatcacagcagcttcattatctgcaaagacttgatgaataattgggattaatacttcaggatctgaaatttgaactaaaccagcctttttaacgaattcttcagctgaaccaccatttttagctaaatgcacaaaaacttttttagcaattttggatgaaattgtaccgtcagcaatcaagccaatcatctcaaccaaattctcaggagtcagaccaatttcttcgattgattttgattcactgttaagaaattgcgccacttctccttgtaaccaattggaaacttgttttgcatcacccccaatagcaacagctttttcaaagaaatcagaagttgcttttgtagctgttaattggctagcatcataagatgatagaccaaaagacgatacatatttcgcacgacgttcctgtggaaattctggtaattctaaacgaacttgatcaatccattcatccgagatatcaaatagtggtaaatctggttcagggaaatagcgataatctgatgagccttccttgacacgcatcaaaatagtctcacctgttgtttcatcaaaacgacgagtctcttgctgaatttgaccaccagatcgtaaaacttgtgcttgacgtttttcttcatgtatcaaacctttacgtacattattgaatgagttaaggttcttaagttctgctttagtaccaaactcttcttgaccataaggacgaagtgaaatattggcatctacacgcatagaaccttcttccattttaacgtcagaaattccagtatattggataatctctttgagagctgtcaaataagcataagcttcctcaggagaacgcatatcagcttctgatacaatttcaatcagtggaacaccttgtctattaaggtcaacataggaataaccatctgtcccatgtgtattttttcctgcatcttcttcgaggtgggcacgctcaatacgaattttttttcgtgtaccatcttctaattcgatttcaatccaaccattgtaaccaataggctcatcaaactgtgaaatttgataagctttaggattatctggatagaaataatttttacgatcaaaatgcatgttttgatggatatccatattcaaggcaagtgccgccttgattcctgcatcaataactcctttattcatgactggaaggacacctgggaaagaccagtcaattacatttgtattagcattttgttcctgaccaaaatgagcggaagaaggtgagaaaattttagagttcgtatttaattcaacatggacttcaagtccaatgactgtttcaaaattcattagttctcacctccaaaaattttaggttgttgtttatgataatctgtcgttgcttcgaaggcagcagcaacctgatatattgtttcttcactgaatttcggaccaatcaactgcataccaaccggtagaccttgatcaaaaccagcagggattgaaatacctggtaaaccagccaaattaactggtattgttagaatatcagctaggtacattgcaactggatcgtgatttaaagaatctaagtcaaaggctgttgttggagctgttggacctaaaatcaagtcataatctgcgaaaactttttcaaaatcttgaataatcaaactacgaacttgacctgcttttttataataagcatcgtaatacccagaagataaactgaacgttcccagcataatgcgacgcttaacttcgtctccaaaaccttcagatcgtgtattgacatagatatcatccaagtttttataattttctgtacggtatccataacgaataccatcaaaacgttgtaagtttgaagaagcttccgatgaagcaacaatataataaacagcaacaccgtatttagaatgcggtaaactaacttcctcaataactgcacctagtttttccagatgttttgcggccttaataatcgtttctttaactccttgcgctattccttctcccaaatattcttttggtaaagcaattttcattccttgaatatcttgaccaattttagcagtaaaatcgcctacagtacgctcagaagaagttgaatctcttacatcatgcccagaaataactgtcaaaagctgtgcattctcttttactgtttgagacatcggtccaatctggtcaagcgaactaccgaaagcaaacaaaccaaagcgtgatacacgtccgtaagttggcttcataccaacgattccattaaatgaagccggttggcgaattgaaccacctgtatcagagcccaatgataaacgtacttgtcctgaagctactgctgctgcagaaccacctgatgatcctcccggaactttactatggtcccaagcgttatttgtctttttaaaataagatgtttctgtagagcctcccatggcaaattcatccatgtttgctttaccaatcacaatcatatctttagcatataacttttcaacagccgtagcatcaaagattggctcatagttatagagcattttagaagcagctgttgtaagaatcccctttgttgaaatattatctttaactgctaagggaatacctgacataacattatcagcatcaattcctttatcatcaatttctttggcttgagctattgccatctcatcagaaatagtaataaaagatccaaccgcttgttcacgcgcatgaatatcttccaatgtagcttttgttaattcagttgctgaaatttcttttttaacgagaaaatcatgcaactgatcaattgattgattattaaacgacattaggcatctcctccatcctcaagaattgcaggtactttaatataataatcttgatgctgtggtacatttttaaataagtcatcacgattatggcctggttgagcaatatcttcacgcatcacggttttgcgatctgccatggtcgttgttactggtacgccttctgtgtcaacttcatttaagagttcaatcatatcaacaatctttgacaaacttgacgcaaattctttagtctcttgatcagaaaagcgcaattttgacagattggcaacatgacgcacttcttcttcagaaattttcatgagttctccttatctctgtatcattttcgttttaagatagtctctactattatagcatattaaactctcaatgttatcacattatcccagcttttcataataaacgcttcttacctatgataagaagcgtttactgtttatttatctattgttatatcatttctgctttgtttgattttagcctgtgcagccgctaatttagcaataggaatcctaaacggcgaacacgatacataatgtaaccccagttggtaacagaactcaatagatgatggttctccaccatgctctccacagatacctattttaaggtttggcttaacttcttttcctaacctcactgcctgcccaataaaccttcctattcctttttgatctaaaacttggaaagggtctttttttagaagtcctttatcaacgtattctcctaagaattttccagcatcatctcgtgaaaatccaaagctcatttgtgttaaatcattggtcccaaaactaaagaaatccgcaaactttgcaatatcatccgctatcatacaagctcttggtgtttcaatcattgtcccaatagggaatgataagttaatttttttagatttactctcctcaacaattgtctcttcaatcagatcacgtattatagagatttcttcatgcgctgtcactaaaggaatcataatttctggctttgcctcatatccctctttcattgcaagtatagcgccttgtacaagagctctcacctgcatttggtaaatttccggataggtaatcgcaagtctacaaccacgatgacctaacatagggttgaattcttctaatgtttgaatccgtttttcaatagctaaagtagatatccccatttgtcttgccatagattctatagactctttatcatggggtaagaattcatgtaaaggagggtcaagcaaacgaatcgtacaagctttacctttcaatactttaaaaatttgataaaaatcgtctctttggaaagataaaagcctttctagagccttccttcggctcaatatttcatccgctaaaatcatttctctaacgactggaatacgttcatcgtcaaaaaacatatgttccgtgcgacaaagacctattccttctgctccaaagtccaaggccttttgagcatctctcggattatctgcatttgaacacaccatcatatctcgattttcatctacccatttcataaatatctcaaaatcacgatctacgctagtctctgccatcggaacttgtcctatataaacatttcctgtagcaccatcgattgataacatctcaccttcttttatcgtttgatgcccaatagaaatttctcgtcttacttcatcaaccaataattgactacagcctgcaacgcatggtttccccattcctctggctactactgccgcatgggaagtcattccgcctcttgctgttataatcccgtttgcactaaccatcccctcgatatcttcaggtgatgtctcttgtctgaccaatagcactggatttccctttttcatctctttaacaacatcttctgcatggaaataaactttcccataagcagctccaggagaagctggaagtcctgtcgtcaaaataatagctttctttaaacttttcaagtcaaaagaagggtgtaataactgatctaattgtttgggctcgatacgtagtatagcttcttctttactaattaggccttcatttacttgatctactgctattttgatagctgccttcgctgtacgcttaccgcttctcgtctgaagcatataaagattaccattttcaattgtaaactccatatcttgcatatcgcgataatgagcttctaacttttgggtaacgcttacaaactcttggtaaataataggcatttgttctgccaattttgatatggattgtggtgttctgatacctgcaacaacatcttctccttgtgcattaatcaaatactcaccaaataaatttgctgctccagttgatgggtttcgtgtaaaagcaactcccgttccgctgttatttcccatattcccaaaaaccatagcttggatattaacggctgtcccaagcgtctccggaatatcatttaatttacgataaatcttagctcttggattattccatgatttaaaaactgcctcaattgctaacaaaagctgccttttaggatcttgcggaaatttttctcctgcttctttttgatatagttccttgtaaaattcaacaagtctctttaaatctgaaccagttagttctgtgtcatcttgataacatttatctgtcttaagtcgatctaaaatggtatcaaatttatattttggaatgcctgtaaccacatctgcaaacatttggataaaacgacgataactgtcataagcaaaacgctcgtcttctgtctttttcactaaaccttggacactacgatcatttaaccctaaatttaaaactgtgtccatcataccaggcattgaaaaaactgatcctgaccgaactgacaccaacaaaggatcatcaacacttcctaattgcttgttctgttcaacctccaattgtgccattgcttgatcaatttgactaagaatactctctcggatatggcaagcgttatcataataatcattacaagcctgtgttgtaatagtaaaaccttgtggtaccggtaacccaatactcgtcatttcagctagattagcccccttaccacctagcagttccttcatttccttacaaccttcatcaaaatgatacacaaacttagtttccatcagcgtctccttttacagatttttagctacttgtccatttgtttttaagatttctaaaataatcgttgctgtttcttcgattgctttatcagatacattaatgattgggcaacctaaatttttcataacttcttcagcatacctcgtctcctccaaaatccgttctaaactggcataatttgccgtactagaaagacctaaggactttaatcgaacttttcggacttgattaagatgatcaaccgaattagttagtccgataatccttctagaatcaatcatacgtaattctttaggaacaggaacctctggaaccaaaggaatattaataactttaatatttttatctgctaaaaacatacttaatggtgttttagaagttcttgaaattcctataataactaaatctgcttgtaaaatacctcgcggatctctcccatcatcatattttactgcaaattctattgattctactcttttgaaataatcattgtctaagcgtcgtaaaatccctggttctcccaaaggatctatacccgatatccttgatattccttgaataacatttgttaataagtcaacataagcataatgttcactttcacatcgtttctgtgcataggaagccaaagcaacatcaactaaactaaacatcataaatactgtcttctggctagcctcttcaaaaacttgttctaagcgttcctgactgttaatataggaaaaacgttgaaaatgccaatcatcatgtcctggaaattgtgacaaacatgctttcgcaatagctttggctgtttcccctaaagaatctgaaataataaatatagtgagttgatcttccatcagtttcctcctaataatctcttatttctaaaaacaaactagcgaggattgttttagataatttcccgatcactttaaatttttcgggatattgcttatcatgacgaacgacagggagactatccacttttctgctcactaatttatcagctgccgcaaaaagactttcattttctaaaacagttgtcacgtgtggcatacgtgtcatcaccattcctattggcattttagaaagatctcctccgccaatactgatttttagtaaatctttacgtgacacgactccacagagaaaatcatcatcatccaagataaaagcacaaccagcatcttccataaaaatatgtacaataacatcataaactgaatctttttgatgaactgtcagagggatccccataatttctgaaactgtcatcttttcaaaatgacttgtccctattgaagcatgatactgtcctaaataaaaataaccaaccttaggttttgcatctatgatacctagcatacttaaaaccgccaaatcagaccttagtgctgctcttgttactcctaatttctcagctattagctcaccagtaatgggctgaaactgtttgataatatcaataattctttcttgcctttgatttaattgaataagatcaccttctttatatattgtatactatttattttatatgttatattatatatctttttttactgaaatcaagtaaaaaaagatactattttaaaaataatcatactatatatttgcttttagacatatcttttgttaaactttcttcgaaaacgttttcgaatataagtatcggaggttgtaatatgacaattaaaaatctcactgttgcaggaagtggcgttctaggtagtcaaatcgcctttcaagcagcttacaaaggaatgtctgtcaccatatatgacattaacgatgaagctttaaataagggaaaagaacgcatcaaaaaattagctaaagtctatcaatcagaaattgaaacagcaaaagaagcatatagtgataaagctaaaagtatcaagtataataaaaacttattgcctagcttagaccatatttttctttcaaaagttgccgattcattagacttgattgctgatttaccaaaccaaattactttttcaaaaaacttagaccaagctgtaagtgacgccgatttagtaatcgaagctgtcccagaaacagttagtataaaagaagatttttataaacaattagctaaagtggcaccttcaaagacaatctttgcaacaaattcttcaacacttgttccaagtcagtttgctgatataacaggacggcctgacaaatttttagcaatgcatttcgctaacaatatttggcaaaataatattgttgaaattatgggacataagggaactgacgacgaggttatcaaagaagctttggcattctcaaaagatattggtatggtgcctttacatattcataaagaacaacctggctatattcttaattcaatactagttccattcttagagagtgcactagcattgtactatgataaggtttctgattctgaaactattgataaaacctggaagttaggaacaggagcaccgatgggacctttagaaattttagatattattggcatcgataccgcttataatatcatgaagaattattcagataccaacagcgatcctaatagtcttcatgctcaccttgcaaaaatgcttaaagaagaattcattgataaaggacgtaccggtaaagctgctggacacggcttttatgattacgactaaactataaaagaggttagataaaaatctaacctcttttataattcaactaaagaatagttgcaccaagaacagttttaaaatgatttaaagcccattgatgattactatcatttaagctagctacagctgctgctgggacctcaattttataacctaagttataagcatcaattgctgtgtgtaatacacaaatatctgtcaatactcctgtcaatatcaaagtatctactcgtctttcacgtaggcgaatatctaaatcagtgccagaaaaggcagaataatgacgcttatctatccaaaaaacacgactatcttccttaatagtttcatatagagttcccaaaggaccatataggtttctaccagaagtccctttaatattatgctcaggaaaaagattgctctctggatgaaaaacatctccaatatcatgattatcaatcgcaaaaaaaatataatcccctgaccggtatgctttctctgtaacgtcagctatagctgaagcgatagattgcgctggtttacctgccgttaatttcccatcatctgccacaaaatcatatgtgtagtctattgagatgagtgcttttgtcatttttcttcttatctcctcttgatttcaaaaaaggaactgaaagctactcccagtcccatgctatgattaattatattcttttaatttgtcaaaaataccttcgttaataactttgaggtatgttcccttcataccgagtgagcggctctcaatgattcccgcagactccaatttacgaagagcatttacaataacggaacgtgtaattccaatacggtctgcaataacagatgccgttaggcgtccttcaagtccatctaattctcctaagatagcagctacagctttcatttctgaataagatagagtgttgatagccattgtcaccgctgtttgtttacgaatattttcttctagattttctgtttgaaggttaagtaattgaataccaacaacggtgcttgcaatttcaactaaaatcaaatcatcgtcgctaaattctttatcattacgccagataataaatgttcccaagcgcattccaccaccataaattggagcgattgttgtaataccatcttggaagttttcctttgtctcaactgggaaaattgacaaatcattatctactgataagttagcttctgtatcataaacacgactagcagatttaacatagtaatctgggaattgttttgtttcaaaaaattcttccacacggtcagtgtttgttttatatttcatggcatagccaagtaagttaccaccaccattaataatacatgcgttacagtcaataatatcagctaattgagccgccattgtattatatggtagttcggcatctaagctatctacggaacgctgtaagatggatgtaatttttctagttttttctaataaattcggcatttccttcatcctttgtatgttttgcgttacaattatatcaaagcattttagcttttgcaaatcgatatcagtacattttaagaacttctattgttaatttaatgtttatctaataaaaattcattctagcgcttgtattggcttaaaaagcgagccattttttcttgtagttcagtcaattcatcaacacgtggtaagtaaacaattctaaaatggtcagcggtattcatattaaatcctctaccgtgtgttagtaatactttttcttgttttaagaaattaagcacaaactcttcatcattatcaatacggtacatatctgtatcaattttagggaaaagatacagtccagcatttggttttacagcagataaaccaggtatttcattaattgctttatggatataattacgttgctcgtagatacgacctcctggcaacaacatactatcaatagattgctgtccgcctaacgatgtttgaataacctgttgagcaagaacatttgaacacagcctcatgttagctaacatattcaaaccttcaatataacctttaacatgttgtcgcggaccagacaataccatccaaccaacgcggaaaccacagatgcgatgtgatttagataagccagataaagtaactgtaaaaatatcctctgcaatagaagcaattgggatatgctccattccatccataactaaacggtcataaacctcgtctgaaaaaataatcaagtcattttgtctagcgatatccacaatctcttgcagaatttcacgcggatagactgctccagttggattatttggattaatgaggacaattgcttttgttttggatgtgatttttgatttgatatcatcaatatcaggataccaattagcttcctcatcacaaatataatgcacagcatttccaccagcaaggctaacacaagctgtccataacgggtaatctggcattggaactagaacctcgtcatcattatcaagcaaagcttgcattgacatagagattccctcactaacaccattaacaatgtatatatcatccatgtcaacatggatgttttgtaactggtaatactgcataacagccttacgagctgaaaaaatacctttcgaatcagagtaaccttctgattcacgcgcattcgtaattaaatcacgaatgacttcatctggcgcttcgaagccaaaggcagctggatttccagtatttaaccgcaatatcttttcaccatttgccctcatgcggtccgcctcttctaaaacagggcctctaatatcataagctacatgttccagcttcattgatttatcaaatatcttcataaaaatacctcgtatcttccattataaaacaaatattctcaaaattgaaacttttactgcggtttatcaagcgattaagttaatattaagctatttcagaaaactaacataaaacgctttcatttttctagaaaaaacgttataatatagctataaaatgaataaccaacatatctaacttactcatcactcactccttctgataagatggctagttgagtgcaagaggttatctcttttggttatatttagaggaggacaggcttatgtcacaaaaatatgaacgcatccttgtcgctattgatggatcaacagaatctgaacttgcttttgaaaaggcagttaacgttgctcttcgcaatgattctgaattaatcttgacacatgttatagatacacgtgctttacaaagctttgcgacatttgatacttatatctatgaaaaattagaaaaagaagcaaaagatgtccttgaggaatatgaaaaacaagctcgtgaaaaaggagcagataaagttagacaagtcattgaatttggtaatcccaaaacattacttgcacatgatattccagaaaaagaaaaagtagacttgattatggttggtgcaacaggtcttaatacctttgaacgtttcctatcggatcttcctcagaatacatccttcgtcacgctaaagtagatttactcattgtacgtgaccctaataaaacaatgtaaatttaaatacgctcactttctaaaatatcctgagttatattaactcaggatatttttattttcgatttaaggatttctgaatttggctatctaattcacgtcgaattgatggctcaggagcgaaatgttcttcccagtcgtctggttttaaaattttatgagtaacaggatcaaaatgagctttgccatctggaaagattttccccatattggcctcatgtactgtatcaaaaagaggttttgggtcgactcccataagaacaaaggagccataagtcagataaagtaaatctgttaaggcatccacttctcccactaatggtgtttctggatggtctttagaaataaccttatctcttgctttatcaatagctaagtgtaaattacggatagattggtcaaatactttttggttaccttgactagcagcatacaagaactcaacgatttcttctactttaaagtctgacctgaaaccagcttccttactgtcatataagcgtggcgtttcaatagtttcaccatccattaatagatggaaggattttactttattgaaattctcgtcacgactactgaatgttttttcaatctcaaattggataagtccataatgggctaatgccttagagataccatcatcattattgtcagcagttgtataacgtgcattttctctcacttgctgactagcgttccccatggcaacaccaatgccaacttgagataacatctcaatatcattatcagaatctccaaatgctatcacttcggatagatcaaaaccatagcgttgaccaacacgttcaattcccttaacttttgactgcccttcagaaatgacatccattgagtaaggactgcttcttgttaatttaacacgaggaaattgtttttgaattcgctctgattcgccctctgttgcaactaaaacgacctgataaataggttctcgtaagataaccatgaggctatcaatattttgaggtttaatccgacgaataaaatgcttaaagcttcgttcaatcgcttttgcccattttctcggaacaaggctagatacaatctgccccaaacggctagttcctagaccaataatacctgaaccgagtaatcctgaggctgttcctaatgaaatttctcttcttcttgctccagcataacgaatcagacgatagacagttgtcttagataattgattggtataaataatttcacttctactatagatatattgaccattataggttacagcaaaatctaaaccaaggttttctaaaaaaggttgtacaaaactaggacctcgccccgttgctaaaccgactagtattccttggtctttcaaatttcgaattgctttaattgttgacttttgtacattcttacgatcattaagaagtgtaccatcaatatcaaaaaatactgccttaattgccactgggtcaacatcccctcttttttatgataaaataaattatatcacaacttgaaagaagtataaaatcaatgaaaaaaatccttgttctacacacaggtggaacgatttccatgaatgctaacgagaagggacaggtcatgtccagcgccgataacccaatgaaatacgttgatttatcattagatgaccttgatttgactgttgtagattttctaaatcttcccagtcctcaaatcacccctcatcatatgcttgatatctatcactatctgaagcaacatgccagtaattttgatggtgttgtcattacgcatgggactgacactttagaagaaacagcatattttttagacacaatgatactccctaaaatcccaatcatcattaccggtgctatgagaagcacaaatgaacttggtagcgatggcgtttataattacctatcagccctccgtgtcgctaatagtactaaagctgccgacaagggggtgctagttgtcatgaatgatgagatacatgctgctaaatatgtcacaaaaacacatacaacaaacgtttcgacattccaaacccctacacatggcccccttgggattattatgaaacaagacctgcttttctttaaagcaactgaagagagagttcgttttgatttagataaaattacaggaactgttcctatcgtgaaagcatatgctggcatgggtgatagtggtatcattagctttttaaattctcaaaatattagcggattagttattgaagcactcggtgcagggaatatgcccccaaaagctgcacaagaaatcgaagaattaattgagcaaggtgtccctgttgttctagtgtctcgctgttttaatggtattgctgagccagtttacggatatgaaggtggcggagcaaaattacaagaatctggtgtcatgtttgttaaagaactaaacgctcccaaagccagactcaaattactcattgcactcaatgcaggtctcacagggcaaaatctaaaagactatattgaaggttgataaaaaactctagaaatatttctagagttttttattaattttcagtttgtaatactctctcaacactgctaataggcatttcttgattcgttattaattgaaatgcttctgctccttgataaatcagcatccctagaccattataagcatgtttcactccattttgtctaacaaatcgtaacaatgctgtttctttaggcttgtaaaccaagtcgacaactactaaattcggtgttaaaatttctggatcgttaattaaactataattatctaatggcctcattcctaaactagtagcatcaatataaaaatgactagttctaatagcgtctttaaatgctgtcttattttctagataatcaacgactacctttatttgaaactgttttttaattttatctgataagtcaatgaccttatcgtaatttgagctgttacgattaaataatctaatttccgcaactccctccatagctgcttgaactgcaactgctttacctgaaccaccaataccagctattgtaattattttatttttagcactgaaaccttgagctgctaaagctttaaaacaaccaatgccatctgtcatatggcctactaaacgtccggttccaccttgattaacgatagtatttacagcacccactaatttagcttgaggagataaatcatctagcaaagggataacactctgtttaaatggcattgaaacattaacaccacgaatacccaatgccctgacacctcgaacagcttctgttaatttaccctcttctacttcaaatgtcagataggcataattcatgtttttttcttgaaaagaggtattccacattaacggggatagagagtggcgtgcaggattggcaattagaccagttagtaaagtttccccatttaatgaattcattgtataaccttctttcttaacaatttatttcagttcattttaccaaaaactgactcaattaaaaagagagtatgtaatttatactctctcccttagtttaaggcaatatattacctgcactacggtaaatatcataccattctttacgggttaaagcgatatcattagccttatcaatcgcctttaaacgagatggattcattgaaccaacaatcgcctgcattttggcaggatgacgtaaaatccatgcaatcacaatagcttcgctgctaacattgtagttttttgccagtttagctatggtttcatttaattccttataatccggatgattaacaaataaaccacgagataaatcaatttgaaatggagaccaagcttgaatggtaactcttttaagacgacaataatcaacaatgccatcatcatgttcaattgaagctttatttaacatgttaacatttaaccctgcatcaaacattggtgtatgtgctggcgataactgaagttgattcactgctaagggctcgtcaaggtaggattgtaacaactccatttgaaaccggttttgattgctaacaccaaagtgttttactttaccttctgccctcagtttggtaaatgcttctgctacttcttcaggctcaactaatacatctggacgatgaagaatgagaaaatctaaatattctgtccctaatctttctaaaataccatctactgatgataaaatatactctttagaaaaatcaaagtaaccttctcgtatcccacatttagattgaataatcattttgtcacgattgacatttaaatgtttgattgcatctcgaaagcgtaattcagatagccctcccccataaatatcagcatgatcaaaaaaattaatacccaaatctaatgctgttccaactacttcttcagcttgttttcctttcaagtcactcattctcatacaacctaaagcaattcgagttgcttgaatgcctgtttgtccaatgttttgtaacatatgcaccccattctaatctgtttgtattaacagaaagattaatcaattcattataacaaaatttctatgaaaaggcttactattacaaatgcaaaaagctgagtaaatttaactcaactttttttctgatactcattattgactaaataagtcggtaagaaaaatctattctgaaaagtactattataaattacagtaatcattattgtcataacatacctccacatctgtgataggaatatcatatgacagcaagcttaaactgagcttagcacagccttaatagaaacttaatcaaaatctgaatgttggcgtaaattatctagaataagtgcccattctgtattttctttccaattattatctttgacaatatcactagcaacacgtctggcttcttctaaaataggataatcctcaacgatatcagctacttgaaattctggaattccagactgacgagtaccaaagatttcaccagaaccacgcatttttaaatccgactcagctaaaacgaaaccatctgtcgtttctgtcatgattgtcattcgttttttcccagaatcagttttgggattagccactaaaacagcgtatgattgtttatatccacgaccaacacgcccacgaagttgatgtagctggcttaatccaaaacgatcggcatccataataatcatgatcgttgcatttgggacatttacccctacttcaataactgttgtagatactaaaatatgactttttttatccttgaaatcttgcattatagcatctttttcatcatttttcatacgtccatgtacaagagcaaccttagcaattccttcaaaataagtagataattcagcatgcaatgctactgcattctttaaatctaaagcttctgactcttcaatcaacggtgaaatgacatacacttgagcatctttttgcaattcaccttttacccattccaacacagtacctagctgctcgtgtttcacccagcgtgtaataataggtttacgaccggcaggtaattcatcaataatagaaacatccatttctccaaaagctgtgattgctagagttcggggaattggggtggctgtcatcattaaaacatcaggattttctcccttttcacggaaaattctacgctgtttaacaccaaaacgatgttgctcgtctgtaattacaagccccagtttatggtactgtaccgagtcctggataagagcatgagttcctacaatcatatcaaccgagccatttgcaatagctgctaaaaccgtacgcttaacagctgctttcatacccgaagttaatatagcgattgataaatctggaaataactcttgcagactaatgtagtgttgttcagctaggatttccgttggaaccatcaaagccgattgaaaacctgctgtataagctgcatacattgatagaccagcaatgactgtctttcctgatcctacatctccttgcaataaacgattcatatgagctcccgatgacatatcagataatatttcatctaaagagcgcttttgagcattcgttagaataaaaggtaaagaggaaatttttgtctccatagcatgtttactataaagaataggcaaaccatttgtttcagatttattttcggatttcaaaacttgaaggttcatttgaaagtaaaataattcttcaaatttaatccgacggagcgcttgcttatactctgtgatatcttttgggaaatgcatagctaaacaagcctgactacgacccatcaatcggtatttttccaataaagtagctggtaaattttccttcaattccaaatgcgcactgatttcaaaagctgacttaatagctttaatcaaagtagactgtgaaattccctgagctacgcgataaacaggttgcatgtcatcttcaacttgagctaaaaccttcatcccagtaatagctgatttagttgcatcccatttaccaaagacagctacctcttgaccaagttctattttatcagctaaatagggttgattaaaaaaactaacatttaagacagcttccccttgacgcaacttaaaacttaaacggttacgtttaaaaccataatattgtacattagctggagtaacgactaggcctgtaatgactgctttttcaccatccactaaatcaaaaacagattttgatttaaaatcttcatagcgaaacggataataaagaagtaaatcttctactgtataaatatctaatttctgaaatttttctgctgattttggtccaaatcccttaagattagaaattggtgattgtaatagcataagattctccttctaatatcttttattatactaaaagatcaccaaaaaggcgcctcaagagcgcctttattatgtctaattatttatggccaataacataagttaattgtgcagcttgtgctgaactaaaagtacggtaagagacaataccacgtcccattgcattagattctgaaataagaactgaaccatcttttttaacttcttcaacaatagctacgtgaccgtaagtgccatcagcaccagcttgtcctggtgaaaatgatacagcatagcctacttttggtgaatgtgttgtttcaaaaccagccttatgttgccaatctccaccattacccataaatggatcaaatgtataacctaactctttagcgcggttaaagacataccatgtacattcaccccatggataagttgatgcaatatagctagctgtgttaactgctgttgataagctaaaaccacttggtaaatctgctaaacttgctgtcgataaagctttcaaggcagcaggaatttctggtgtccctccatgttgatcaatccagcggtctaaatcttccataatctgggcacgacgtttaccagttccagagttatctgtataataaacaccaccctcagtaactgtattaagttgtccagaagataatttctgtgctttcaaatcttggatttcaaagctagagttgttgtttttaataattgtattttttgtcaacaacataattgcttcttcatcattataagcactagcatggctagagtcatgatcaaaggcaccataaccaaacatattagcacctggcatcttagccactccttgagttcccaatgaactttcaaggacagcaatagctacaatagcacggacatctaaaccactatctttttcccattgtaataacttagcaccattgatacgattagaatcatattgaatccctaaagattttaagtacccatctaattgttcagctttgataccgtaacgatgtgacaataaatagtgagagtaggcatcctgaccagaccagtgttctacgtagaatggcgttgctgtcactggtgaaatcggtgttgataataagttatcatcaaaggataaagcaggaacagaagcattctgatttgtctgaacactttctatctgagacggagcgggagttattttaggctctactaatggtaaggtaggctcaggttttaattcagtctttgttgattgacctggcttactgtctgcttgactactgtttgtagtattagtgctaggagtagatgctgttgaagcagaatcagatgttttagcatcttcgttggaagaagattgatgtgatgaacttgatgatgattcattgcttgatgatgtctctgtcgtaccaatctctgttttttctgttgagatacttccttcggctgaaggtgaagcagtttctgaatctgtaggttgtgttttttcctgtttctctgcttcagaagaactttctgttgatgctgttgccattgtcaggcttgtttctggattaatagtttctgctaaggtcactaaaggtgatgatagcgataagactaaagtggataacaacaaagttgccattactttttgttttgacatatactaatgatttccttctataaaaattgtcactgattagtttaacatatttttaaattttttaaaacagttaactactgtgtcatttgtttttaataatatctcggaatacgatcgcttaaaagacaaagtacttcataattaatcgtctgtcttttttgagcgacgtccgtagttgtaatgttacaactaccttgttgaccaatcaaggttactttagttccgatagtatatttttgaggtaaacggatagtcatttgatccatcgagacacgcccaataatttcacaaagttctccatttactataactgaaaatccttgcatatctcgtgtccatccatcagcgtagccaatcggtactgttccaacaaattcgtctccagtaacttgataggttgcgccatagccaacttgagaaccatcgtgtagttgtttaacatgtactagctcagactctaaacttaaagcagggtttatagggtaaggtaagtctaaatcagttccacttggatttaagccgtacataacaacacccaatctaacggcattaaaaattgtctcactatgccaaaggcttgtagcagaattactagcatgaacaaggtccggacaattatctaatcctgaaataaagtctttaaaaaaagtaagttgttgattgaatttacagttatcggcttcatcagctgttgcaaaatgggtgaaaatccccttgacagaggcaccactttcccccaattcagaaattagcttatttccttcatctaactggcgaacacctatacgtcccattccactatcaactttgatatgtacttctagaccagataaatctactgctgatgtctgacataaacgtaaccactccaagctagcaactgttagagtaatattttcatttttggctagtataacctgctcaggcataacaacacctaataccaatatcatttttacaattcctgcttgacgtagctcaatagcctcatctaaattggatacgcaaaaaccatctacaatagactcaatgtattttgaaacttcaacagcaccatgcccataagcattagccttaactacagcaaatgtttttttatcacttggaatgtgctcttgtacagatttaacgttatttgcaatcgcctctaaatctatcaaggctctggttggtctatgataacttgaaatcatttttcttcctccaaaataacactagcttgtgcataattaccactatgagatattgaaacaaaagattttccattaaacggttcttttgtaatcaaaggcgctcctttatcatccgataaaatttcgatatcatgaaaattaactttcccaattcctgttccaagtgctttgctataagcctcttttgctgcccatcgccctgttaaaaaagacatctgacgcttgggattggaaattcctttaaaaagaagcaattcttgttcggtcaaaacgcgttctgcaaaacgttgattacgctcatatgctttagtaatcgcctctatctcttgtaaatcaattccgtgtccaacaatcatgtgtaactcctataagttcgatacttacaaactattgtaaatatccctaattagcatttctgttttatcccaacctagacatggatctgtgatagacttaccaaaaacatctggtttatcttgtcttccatcttctaaataagattctatcaaaaaaccacgaacatagtttctaattttagtatgccactgtcggtctgcaagtactgatttcacaatgcgaatttgttctaaaaattgcttacctgaattgtcatgatttgtatcaacaacaataaagggattttgcaaatcagtctcttcataatgagtaatagtttctaaaaggttttcataatgataattagggatacttcgatagtcggcattatgatatcctctcaaaataacatgtgacagcaaattaccatctgttctaacttgcttattttgatagaataattcctgttgattttgtgctgcatagaccgcattaaacatgactcttaaattaccagacgttggatttttcatacctactggtgcatctatacctgaagatataaaacggtgtccctgatcttccactgaacgcgcaccaatagcatagtaagaaactaaatcatccatcactgataacatctctggataaagtaattcatcagctgtcaggagtccagtctctcgaatgatgtcatagtgcatcttacgtgcttgaaaaaaaactcctagtttgtcagaatggtgaactaagcctttataaccatcaccattcgttcttggcttagcggtataaactctcataaccaaaaacattttatctttaaaggcagcttccaatttagctaaacgctttgcataagttagcaccgcctttggattatccgcagaacaaggacctactattactagaaaccgctgatcctcaccttttatgatattttttaactcttcttctttggctaattttttttggctaacttctagatctaagctagttttctgcttcaatatttcaatattaattttatcacttaactgatgaaatcccatgttttttcctaatacaacctaagtctattaataagctctgctatacaatatagtcgtcatactattagacaagtaatgataaaacagtcttctcagactgttttatttttattttaaaatcattgttattgtaaacatctcagaccatgacaatttttaaacttcatgccagagccacaaggacatttatcattacgtttaatcccttggtattctggtgattcattattcataggtacatgttgtgccgagatattttgctctgctgttgtcgtagcatgttgagaagcacgttcacgctcttgttcatgaatttgagctttcatcaatgtacgtgtcacatcaaactcaatcgaaccaatcatatcttggaacatacggaaaccttctgattgatactcaacgattgggttattttgagcataaccacgaagtccaacggagttacgtaattgatctaaggcatcaatatgctctgtccattgattatccactaccatcaagattaagactttttggaattcgataatagcttctggatcttttaatttagcaatttgttgctcataaacagctaaggcacgttcataaagaagttctttaatttcagcctcttttagaccacgaagttctgaaactgtgatagcttcttcatctaataacgccgatcttgcaaaattaacaatagcttctgctgcagtatttttatcgcttctgctatgtgcatcaactgctcttttaatcgtacgtttaatcatccctttgagctctggtcctaaatcacgctcagcagtaatcacttctctacggttagcataaataatctcacgttgttcacgcataacatcatcgtattgcaagacttgtttacgtgtgtcatagttattaccttcaacgcggcgttgagctgattcaacttgtcgtgtcaacatttttgatttaataactgtatcatcttcagctaaattcattcgctcaagaaccactttaatacgatctgtaccaaagcgacgcatcaaatcatcttctaacgaaagatagaattgtgattcacctggatctccttgacgacccgaacgaccacgaagctggttatcaatacgacggctttcatgacgctctgtaccaataacacataaaccaccaagttcacgaaccccttcaccaagcttgatatcagtaccacgaccagccatgttggttgcgattgtaacagcaccacgttgcccagcattcataatgatttgagcttctttaaagtgatttttagcattcaaaacttcatgtggtactccagcagcaactaattttctagaaattaagtctgacgtttcaacagctactgtaccaaccagtacaggttgtccttgttcataacgttctttgacatctgctaccaccgctctaaatttagagtcaagagttggataaagtagatctgaatgatctatacgttgaacaggacgatttgttgggataggaataacgcgcatattataaatttcacgaaactcttcttcctcagtcttaccagtaccagtcattcctgctaatttatggtacatacggaacatattttggtaagtaattgaagcgctcgtttttgattcttcttggattggcactgactcttttgcttcaatagcttggtgtaagccatctgagaaacgacgtccttccatcgtacgaccggtaaattggtccacaattaaaatctcttgttcttcactaaccacataatcaatatttaacaacataatatagttagctcgaagagcgttatcaatgtagtgagttaaggcaacattttcgagatcatacaagttatttagatggaaatagttttcagccttgtcaatacctgtatctgataaaccaattgtttttgttggaacatcaatgatataatcatcgctattaagcgtttttacaaacatgtccgcacgtgtatacagttggttcatctcagagcttacaggacctgaaacaatcaatggcgtcctagcttcatcgattaatacagagtcaacctcatcaaccaaagcatagttgagtgggcgttgcaccatatcttcttggcgaacaaccatattgtctcgaaggtagtcaaatccgacttctgcgttagttgagtatgtgatatcacaattgtaagcttcgcgtttttcaaatggtgacttagctgctaagttaatccctacagataatccaagccaactataaacctcacccatttcggtcgcatcacgtgttgataaatactcattaacagtaataacatgaacacctaatcctgagatagcatttagataaacaggcattgtcgctgttaaagtttttccctcaccagtacgcatttctggaatatcaccatggtgaagaacgataccacccataatttggacgtggtatgggtataaacctaatacacgtttagaagcttcacgaactaccgcaaacgcttccggtaacaattgatctaaagtttcaccattttgataacgttctttaaattctggagtttttgcttgtaaagcttcatctgataacgcagccatatgatctgcgtaagagtcaactttcttagctattttatctaatttttttaattcacccttgtcattttcaataacagtgcgtagaatatttgccattctaattcctttcgatactcttatcaccacattttaccataaataatgttgtctttcaataaatggtcgttttaatcgagattaaaaagagtggtatccccactctcattattttttaacatgacttgctataatttctaactgtccatcaatatcccatttgacaacatcatttggcaagataaagtggtcaccttttttaagtgtataaactttgttatctactgtaatgtgacccgctccgtctaagacactaaccaaaaggtagggtgcaaattgtttaaagttggtaacaccagaaatttcccatttataaactgtaaagaaatcatttgaaactaataaagttgaagatagatgttttaacttcatattggcaggaacagtattggcaggtttaccaatcgtgagaacatctattgattgttcaatgtgtaaatcacgtaattttcctgaagcatctggacgatcaaaatcataaacacgataagtagtatcactagattgctgtgtttctaaaattaatatccctttacctatagcatgcattgtcccacttggaacgtagtaaaaatcccctgatttaacaggaattcgggttaaaagatgttcccaatctccagattcaatcatttggcgaagttcttctttagttttagcattatgaccatagataatttcagatccttcatcagcagaaataatataccaacattctgttttaccaagttcaccttcatgtttaagagcataagcatcatccggatgaacctgtacactaagccagtcattagcatctaagattttagttagtaaaggaaagacagtatcatcagggttgccaaataagcttttttcaccttgatacagcttatctaaaaaacaacctttaaagcgaccattcttaactcttgagacaccgttaggatgagctgaaatagcccaatattctcctgttgtttcacttggaatatcatagccaaattcatcccttaactttgttccaccccagattttatcgtgcatgcttgcttctaaaaataatggttccgacataagaatcccctatcttttgtaaaattcaagcctattatagcattttatccatcatatcgcttactttttttaatcttttatttgctaactaaactaagtagtggcttaagggttttattaaccttttgatattttctttgctaaagcaaaatttcctaacgttgcagaaccattttcttctatagctggtgtcacaatataatcagacaaatcgggaactggtaaatacccatttaataaagttgcaaatgtctggcgaacacgtcttaacatgtgctcttgtgccatgacgcctccaccaaatacaatgacttgtggacgatataatacagttgcttgtattgcagcctgagcaatataataggcttgaacatcccaaaccattgaattttcttcaatcaattcaccacgaataccagtcctagcttctagagttggaccagatgccaaaccttctaaacagctattatgaaacggacagatacctttaaaatcatttgcttggtcctgcggatgcatcgccatataagtatgacctgcttcagtatgaccagttcctcctataaattcacccttttgtatagctcctgcaccaattcccgtaccaatggtgtaataaacaagtgaatcaatattgttacgagctataacttcaccataggcagagctattaacatctgttgtgaaataaaatggaacattgaaatctttagaaattaagccgagtaaatcaacattagcccaatgcaactttggggtcgttgtgatataaccgtatgtctttgattttttatcaatatcaatgggaccaaaagaaccaatagcaactgcctctaacttcttttcaaatcttttaaagaaatcaacagtctttttaatcgtttcttgaggcgtcgttgttggaaattgcattttttctacaacttttaattcctcatcaccaactgcacaaacaaactttgtcccacctgcttcaatactaccatataactttgtcatcttttttcctatctataatctctatctcaaagacaaaggttgggataattatcccaacctttaatcctcacttaacatcaataatcatgtcacctgtagtaacaacaccctcttttaccaatggtacaacatcagcaaaatcagctgtattagtcacaataatcatagctgtattatccagacctgcttctgcaatcttggctgaatcaaaggtgccaagaatatcaccttttttcactttttggtctgccttgactttagaagtaaaccctgtgccattcatggtgacagtatcaatacctatatgaatcaaaatttctgcacctttatctgatttgataccgtaagcatgacctgtttcaaaagcaatttggacaaaaccatcaacaggtgagtaaattgtattacctcttggtttaatagcaaggccatctcccataatacctgatgaaaaaactgggtcacttactgtatcaagagcaataacctgtccatcaagagggctaacaatcgtttctgcccttaattggctagtttgagtaattgttggatcgtcatctgtttcttcaaccaaaggactaacttcagctactgctttttcatctttatcttcatatccaaacatataagttaatacaaaagccaaagacgtagttccaattaccataataaggtacttaacaatttgaccatttaaataaagtaatgttcctgggataatggtaataccaaaaccagttcctgctaatttcaatattgaagctaaccagccacctgctgctcctgcaattaatcccataataaatggcttaccaaaacgtaagtttactccaaatatagccggttctgtaataccaagtccagctgaaagcgctgccggaaaagcaagggcttttaattttttattttttgttttaacaccaactgccaaagtggcacctgcttgtgctgtcatagcagctgtaataatagcattaaatggatctttcccatcagcagcaattaactgagcttcaagtaaattaaagatatgatgaacacctgtaacaacgattatctgatgaacaccacctaaaataagacctgacaggccaagaggtaaattaaggacaaattttgtccctgctaaaacatagttttcaactgaatggaaaataggaccaatgacaaaaagtgctaaaattgacataactgtaaaagttaggaacggcactaatagtaaatcaagaacatctgggattttcttatgcaaccatttttcaagtttagcaccaagtaaacctacaaagaatgccggcaatactgaattttgataaccaactactggaataaaaccgaaaaattttatgggatgggcatcacctgaggccactgcccaagcgtttggaagggcagagttgaccatcatcaatcctaatacgagaccgataacaggatttccaccaaaaactctaaaagctgaccaagaaatcaaggcaggaaaaaaagcaaaggccgtgtcagtcaaaacgacagtataggtataaaaattagaacttgaaaatgcttttgaagtcgtcccaaataaagctaaaactgtatcattattaatcgcaccgcgaatccccataaataaaccagtagcaacaatggctggcaacaatggaacaaaaacatcaccgaaagtacgaatagctcgttggaaagcattcccttgtttagctgcttctgccttttgatcagaggttgacgaagttggcaaaccttgagccactacttcatcataaatcttattaacagtaccagttccaaaaataatttgatattgacctgaattgaaaaatgctccctgaactttttcgatattttcaacagtatttttatcaatgactgtctcatcttttaccataacgcgaagacgagtggcacagtgtgctacgctacgcacattactagcaccaccaatcgcattaatgacttgtttagcaatttctgtatttgaagccatctataaatctcctttgatattttgaaagcgtttcattttatttactctaatattctagcacgtctcataaatatatgtcaagcgtttgacataaaataatatttttcgatataaagtgttgatttcaaaagagaaaacgtttactatatagttattagatattaagacagtcaaggagtatcaaatgaatttacccactgaaatccgctatcgtccttatgatgaatggactgaagaagataaggaaaatattgtaaagaatgtctcaaaatccccttggagagcaacttatcacttagaagctaaaacagggcttttaaatgacccaaatggcttctcttactttaatggaaaattccatcttttttaccaaaattggccctttggagctgcacatggtttaaaacaatgggtacatacagaatcagatgatttagttcatttcaaagaaacaggaatcaagcttaaacctgaccatgtcaatgatagccatggtgcatactccggttctgcattagccattgacgataagctttttcttttttatactggtaatgtccgtgacatgaaatggaaccgtgacccccgccaaattggagcatggatgacaaatgatggcaagattacaaaatttgataaagtccttatttcacaaccaaatgatgtcactgagcattttcgtgaccctcagattttcaattatgataatcaattctatgctgttatcggggcgcaaaatagtaaaaaatgcggattcattaaattatataaagcacttaataatgacatccatcattgggagtttgtgggagatttagattttggtggtactggatctgagtatatgattgaatgtccaaatattatttttgtcaaaggaaaacctgtattactttatagtcctcaaggactagataaaaacgaattggactaccaaaacatttatccaaatacctacaaaatcggacaatatttcgatgctaactcatctaagatagttgaaccatcccctatctataatttagattatggttttgaagcctatgctactcaaggatttaacacttctgatggtcgtgcctttatcgtgagttggataggcttgccagatattgattatcctagcgatcaatttgattatcaaggagctatgagtttagttaaagagttaagcataaaaaatgggaacctttatcaatatcccgttcctgctatgaaaaatcttcgtcaacatcaagcagaatttaaaacacaacttcaaactaacaacacctatgaattagaattactggttcctagaaatgatctttcttcatttgttctctttgctaatccgaaaggacaaggactatccattactattgatactgtaaaggggaaagttatcattgaccgctcacaagccggacagcagtacgccacagaatttggtactagtcgccagtgtgacattccaaaagatgctactagtatcaatatttttatcgataagtccatctttgaaatctttataaataaaggagaaaaagtatttacgggacgagtctttccagatgcagaacaatcagggattcaactaaaagaagggcacgttcatggtaaatattttgaattaaaatattaatatggttgcaaaattaacagatgttgctgcacttgccggtgttagcccaacgactgtatcacgcgttattaacaaaaaaggctatttatctcaaaaaacagtcaccaaagtcaatgaagccatgagaacccttggttataaacctaataatttagcacgtagcttacagggaaagtccgctaaattaattggactcattttccccaacatccgtaacattttttacgctgaattaattgaacaccttgaaattgagttgtttaagcatggttataaaactatcttatgtaatagtgaaaaggatcctatcaaagaaaaagaatacctcgaaatgctaggagcaaatcaagtagacggtatcatttcaagtagtcacaacctaggaattgatgattacgagaaagttgaggctcccatagtagcattcgatagaaatttagctccacacatccctatcgtctcatctgataatttctttggaggaaaaatggctgctcaaacccttaaaaaacatggctgtcaaaagatgattatgattacagggaatgataattcagattctcctactggacttaggcggctaggtttttcctatgaatcaaaggaatccaaagttatcacagtcacaaatgggctatctaacatgagacgtgagatggaattaaaatcaattatctcgactcacaaaccagatggtatttttacatcagacgacttaactgctttattagtaatcaaacttatcagccaactagggttgtccattccagaagatatcaaagtgattggatatgatggtacaagtttcattcaagattacgtcccacatctaaccactattaaacaacctattcgagaaattgcgcaattgatggttgagatactcctagctaagattgaggggcaaaagacaaataaggattatattttaccagtcagtctcatccctggtagtagcgtttaggaaatcatatttatgaaataatttttagtaccgatagttatttttcaaagcaaattaaaaatgtggaagaagattcttccacatttttaattttcatttgttataaattgacttaataaaccattgacaaattttgctgacgtctcatctgaatattttttagcaatctcgataatctcatttagagctacacgatcaggcgtttcatcaaaatatttaatttcatagaggcctaagcgtaagagagatttatcaaccaatgttagacgttctaagctccatcctgattttaagtgactagaaatcaaagtatctaattcatctttgtgatctacaacaccattaacaagattaagtaaaaagattggaacctctaaaactttgtcttcagatactgttttatcataaccataagcaaagtgagccgcatcaataaactctccaccagtttctaagctaaatagtgtttgaaaagcacgttcacgtaaatcacgtcttgaatctttaaatacactagtcatctaagaaatcctcatcaaacaatgacttcaagtctggttttggtgttttctctggaacaataccttcaacatggatattgaccgaagaaatttttacttctgccatgtcatatacagctgttttgacagcttgttgaatagcaattgaaactgctggtacatttacaccatactgcaagtaaacataaatatctgcagctactgtatcatcttcttcatttttaaggtagacacctctacctagagatttcttactaaggctatccgttaccgctttgttacgtaacgaatgaacaccatcaactttagttgcagcaatacctgtaattacctcaagtacacgtggtgaaatgacaatttctccaagattttcagttgtcatagcttatcctttcttttagtgtttactaaggtttttccttaatagagtaaattcatcatgaatctacttaacacttttttgagagtcattaggcgcgtgaaacgtaagttccttctgctgtattgattactaacttttgtccagcttcaataaaatctggaacgttaacaacaagtcctgtttccatagttgcaggttttcctgaaccagttacagtagcacctttgattgatggttgagtttcagcaactgtcaattcaacagttgttggaatttgaacaccaataacttctgttccatagaattgaatttttacttctgagttttcaagaatgtagagtaattcattttcaatgttaacagttggaatttcatattgatcgtaagtttcattattcatgaagtaagctgtatcatccatcttataaaggtattgagcaggtacagtttcaataatagcttgctcaaatttttcttcaggacggtaacttgtatcaaaagttgaaccagtacgaacatcacgcaatttcatacgcatgattgtgttacctttacctggtttgtggtggctagcttcaagaacacggattaatttcccatcagccgtttcaaaagtcatgcctgctttaagcttacttgcttcaatcatttattaatacctctttgtaaaaattatttatcaactcattttatcacaaataacctgctttctcaaatagtttattgatttggtatgtgtctgatttcttgataaataaataaaatcaccaagagggcgtaaataagactgaagcacttgacactttcctcttacttcagttttgataacagttttaatattataccgatatcttgactaagattgaaatactgtttaggtgtttttagtgactttttagtaaattttgataaaggtagtaaactatagttgtcttattgaaacagataaaataaatcacctacggagctattcgtatgaaaatgtagttattctcgatataagttttagatacgaacttaatttgctctattgaagctggtaaaggaaatcggggtggtgttagtggacgtgcgctaagcattggtactgagcttggtgataccaatcttgcttactacatcaggtagctctctgttttagtgccatatgcaattggaataagagctgtcattggtattgaaggagccctagtccactgatcattgaattactaatttaggaggtggaatgatgaattttaatatgtctcattatagaaagttacaactatgtcgttttctaatcgtacagatacctgcgctggctttattagctattcttttatacgggattttcctaaagtacagtctattttcaaaagtattttttcttatcttttaggggttgaaatagttatcaattttgggaagtacataccagtttacaccaaccacaatttgtcgagtaaagaattgtaatttagtaaagcccttttcgttttcttctgataagtgtatcatgacatctatcaatagcatattcacactagtagcatattgatttgtttttgagtagaatttactttttagattatttctattctacactagtctttccctttggaagattctttccctctgtatttttccatttttcaatgagacgagaaactctttcttcctcctcatcatggtaaccttcaaaaacaacctcatcaatatcttcttgattaaaatagtaaacttgttcaagatttaaaccctcaggaaaaattccacctaggtaatcaaaataaacttcttgtccttcttgctcaacaattgcacctctatttacaataactaatttttgattgccatcaataagatagacaacactccctactggtaataacatacttcagttctccccaatataataatttttcccatttaacgatggttgaaactcaatgaactttataaaaaataaactgtttgaaaaaataaatccaaataaaaataagtttgaaaagttttcgtcccacaatgccattccccatagaacgatataagaaattatgattgataatattactataaatgggctcttccgtttttgattattatatttcaaaaaactagatttatatttggaaagatctaatgctttatttctctgatttagctaaaacaagactaaatatgctcaataaaataaaaagataaaaatgttctaatattaaatgcgatcttgttaagtatgcaatatttatattttttggaaaaattgagatatgaactaaataaaataaaaataaaattgtaaaagtttttaaagataaaggcgactttttttgtttactaaaaaattcttataatccgcagtcacatcataaatttgatatttttctactctttctggaaaaatacctataaaataatcttttatatcactaggattggcataatcaataatgtaataacgtccactaatactaactagataatatctaaaattaagttttgctacaagctcaacccgtctataactttttattcccattagttcacgtacctaactatttatttttgtaaaatgtttatcaatattgttaattacatttcctgtactacttataacatttctaaatgatttagaattattatacaatgcttttacaccaatcgaagcaactgctcctatcacaggtgcaatttcagtaccaattgctaatatcttattcaatcacaactccttttatatattggttccactattactatttttttctaattcgatcaataccttttttcttttataaggtctatattccaatattaatattagtacagacacaaaaagtattcccaaaataatgaataaattgaaatctaaaacttgtagaaataatttaaataaaagtaggatactaaaacttaatatgaaagagattgaaattattaatatattatgtactttagcatctttaataaatttttttaactgtccagggaaaatttctagctcttcataatcattttttcttctcatcaattttactgtaaatcctgaaactagtatcaataaagataaatatacaatagaaaataaaattgaaaaatttgaaatttctagattttcacttatactttgaattatttttccaataatagttgaaataataggagttagtagcattatacctgtgctattttttttagattagatttatataattttttcgttttcatatcataataaacagcattatcatgaaaccatcctaaattaataagattatttgtttctatttccgttttcaaatcttgctccttaattatataaagtacctaaactattattagctgaaatggatttaccaatatttttgatagtttcttgtccataattgatgatatcatctttatagttatcatacacccaatcaaatgccatattagcataaactggatttacatctattgaggtcagcaacaatatcttttctcttttttgtaaattatttttgcaattcgagattcccagcagtactaattttagatgttgataatagatggatcagctattctattatcaacatctaaaactttctgtgaaaaatcattaggaataatgactattaactggtgatcaccttttttaggccattttcagtaatcccatgactaacaattgaccaattttgagaattatctcgttcaatatatttaacataactggcccttagcttaaacgataaaaccttcaaggaagataggcatatactctatcttcctctttactcttccatccctagtgttacctctggaacatcatgttgaacataagcaactccttttgcttccataagttcaatagcaaatgggtgtgggcgataattagctttataagtaattttcttaaccccggcttgcaagagcgccttggtgcaattgatacaaggaaaatgcgtcacataaatttctgtattattagtagaaataccttctttagcacactgaataagggcattcatctcagcatgaacagtcctaatacagtgaccatcttccatataatgtcccacttcgttacagttatctgtctcagagactcctccgttataacctgtagcaatgatgcgattatttttgactaaaacagctccaacaaaagcacggtcacaggtagaacgtttagaaatcaactctgcatttgccataaaataatcttcccaagaaagtctattcattctattttcctttaaagtacaattaattctttaggtgcagatgtcaatacttcgcaacctgtttccgttattaataaatcatcttcaatacgaacaccgtatttattatcgagatatattcctggctcgtcagtcactaccatcccagatgcaatcactccctctgacttaccaaaataaggaatttcatgaacatcaagccccataccatgccctataccgtgggtaaaatgattaccgtatccagaattttcaatgacttgtcgcgccaagtaatcataatcacaacgcttcattcctgattttacattaccaataatagcttgattacttttcaaaacgatatcgtaaatctcgcgttcctgatcagtgacatgaccgatatgaatcgtacgtgtcatatcactaacatagtgctgatagtaacaaccaaaatctaaagtcagagtttctcccgattgaatagtcttctgactcgcaaccccatgtggcatcgctgatcgatatccagatgctacaataaaatcaaatgaaggaccagttgctcctaattctctcatgcgaaagtctaaaaaattagcaacttgcaattcagttgttcgatcaggctttataaaatccaacacatctaaaaaagcttggtccgaaatacgacaggcttgacggatgatcgcaagttatgttacatctttaatcatacgtaacttttcaacaacagatggagcttctatcaagcgataatcttcaaaaacttccaccatatgtttgtacatatgataagaaatatcagtttcaaaaccaatcgctatcaatgcgtcatcgcgaataattttcaaaatagccgcaagtggttctctgctaatgataatatcaaactctcttacagtattctttgctatcaaggcatatcgtgaatctgtaacaaaaatccggtgttttggactaatgagtaccgttgcattagttcctgaaaaaccagtcaaataaaaaatatttgttaaatttgttattaagagtgcgtcacatgataattgtgaaattgctgtttgacatctagttagacgttgttcaaaacccataagaaacctcgctattctaaccttaattaggttaattttatcatcttttaaaacatttagctataagaaaagcaactcatttcagttgcttttactttactattcttttatattaagagcttcttttaatgctttaacttgcatctcagcataagcttctggatttgtcttagctaatgtctttatctccatagctttcactgggtttacttttgcttgcgaagtcatttgttcttttagtttagccgcagccgattctaagtgttcggactgctctttagtcaaaactagccaagtttttcgtggtattttagcaactgatttctgagaaatcaattctccattttcacctgcaaagccataaagtagtttcgaaagactatctttccacacataacgtttagtctttgttgttactgtggcttttttcacatcagctaattggtagctagcagattttttcacagcacttgtcacttcttttgtatttggaacaaagtgagcttttgcttctttttgatttaaatctgttcgataaactaaaacattattactcgaatgagtaccaatctctttataaatcatgagaccaaatggagccttactatcacccgcactataaatctcacgtgtctttgtcttagtttcaatagtcatacctgtatgattaataaagtgatccgttaacatccaaactgaggcaaacaacaaagctaatgagagaagacctagaatataccgtagagcttttggacgaatcaacatccatgtgacaaatgtcaaaatagttgccagtgcaataatcaaaataatcatgctatacctccttttccgtctcaataattttcccttttctcaggaaaagagataccagtaaaccaagaaccgcaaatacaaaaccaatggcaaaagaaacatggaagccatcaagactagcattcaacatctgatttgcatattttaaaggattcattgttagcaaatcttttgatggtttattgttggtgataatattttgagcaacacttgaaagcaatgcaactacaactgctgaagcaatttgacgagcagtattattagctgctgttccatgtgcggcctcatgtggtggaagtgcgctcatcgcacttgctgtcaatggcatcataaccatagcaataccaaacatacgtactgcatataagagggtaataaaatgatctggtgttgtagtcgttaagaaaacaaaaggtaacgtcgctacacctagtatggtaaaaccaatcatagccatacgtcttgcaccaactttatcatatacagctccagaaattggactaactatccccatcatcaaggcacctggtaataaagctaaaccagaatcaagtgcagagagaccatgaacattttgcaagtaaagcggtagcatcatttcaacacccatcatcgccatcattgaaagtgcaatagctgctgttgttactgagaattgtttatttttgaaaacacggatatctaagaacggtgtttctagttttaattgacgatgaatgaataaggcgataaaaataataccaaccataataggagaaataacatatccaatatctccccatccataagttgccacatttgtgaagccccacaaaaagctaccaaagccaattattgaaaggataagggaaggcacttccaatttaactgacttattatcaaccacatcttttagaacaaagggggataaaattgtagtgaccgttaaaattagtaaaggaagaaggaaaattgcacgccatgttaaatcatgccctgcaaaatgaaattcttgttttaaaatccaccctgctaatgtaggcccaatagctggggcaagaccaaccaccaaaccattaagtcccatagcggcaccacgctgctctggaggaaaaacattcaccataacaacctgcatcaaaggcatagaaatccctacagaaatcgcttgaataatacgtcctactaaaaaaaggttccagttagatgtaggtgctaacgtcgtcattaacagtccaataagtaaaacaacgtaggatgtcacatacaaccattttgttgaaaaacgtgtcgctaaataagctgaaacaggaatcataatcccattcgctaataaaaaccatgttgttgcttgttgagccgttgacaacgaaatgttaaagctattcatcaaagttgggatagccgttcccaaacttgtctgatttaatacccctgcaaatgtagcaatcaacaataaggtgatcatggctgtacgattatatggtttgccatgaatatcatgttttgcttttgtagtcattttatctccaatctctatttctgattttaactaatatcttttaagaataacaaataggtcttataaggttattttttgattttttaatcaagaaataatattattttctgaaaaaatcattattttagttatcgtgagaactattttataatagctaaattttattgtcaagaaaaagattctcatagaaactatttttttcaaaacatcattatttcctttttttaaaatatctccccactatttttcctaataaagcgttctccatttaatgacttctacgcaatgttagcttacaaaaaggaactgagtaatattactcagctcccaataaactatcttgctaacttctcttttaaataatatcctgtataggatttaggattttcagcaacttcttctggtgttccgatagctacaatttgtccgccaccaatacctccttcagggccaagatcaataatgtggtcagcagttttaataacatcaaggttatgctcaataacaagcactgtattaccatcatctacaaaacgatccaaaaccttaagtaaacgagcaatatcatctgcatgaagccccgttgttggttcgtctaatatgtaaagactcttacctgtcgaacgcttatgtaattcacttgccagcttcattcgctgagcttctcctcctgataaggttgtagctggttgccccaaagtgacatatcccaaaccaacatccttaatagtctgtaacttacgagcaattttaggaatagctgcaaaaaatgtaactgcatcattcactgtcatatcaagaatttgtgcaatatttttttctttgtaatgtacttccagagtctcactattatagcgcgtgccgtggcatacttcacaaggaacgtagacatctggtaaaaaatgcatctcaattttgatgataccatcgccagaacaagactcacaacgtccacctttgacgttaaatgagaagcgtccttttttataacctcgaatctttgcctcattagtttgagcaaaaagatcacgaatatcatcaaaaacacctgtataggttgcgggattagaacgtggagtccgaccaattggactttgatcaatatcaatcaatcgatcaacatattcaatgccttctaaagaaacatatttacctggtttatctgagttacggttaagcttctgcgcaacagcttttttcaaaatactattaattaaggttgattttccagaacctgagacaccagttacggcaataaatttaccgagagggaacttgacatctaaattttgtaggttgttttctgccgcacctttgatttctaaaaagcgaccattacctactcttcgttcagatggcacaggaatcactttcttacctgacaaatattgtcctgtaatagatttagtatttttagctacttgcttcggtgtaccagaggccacaatctcaccaccaaacgcaccagcgccaggtcccacatcgattaaccaatcagctgccatcattgtatcttcatcatgttcaacaacaataagcgtattacccaaatcacgcattttcttaagactatcaatcaaacggtcattgtctcgctgatgaagtccaatggacggctcatcaagtacataaaggacacctgataaattagacccaatttgagtagccaaacgaatacgttgactctcgcccccggaaagtgttcctgcagaacgtgacagatttaaataattaagtccaacattatttaagaaacttagacggtcatggatttctttgataattggtcgagcaattaattgttcatttgaagataaacgcaatgtttctaaaagttctaaatggtctgctatcgataaatctgagacttgcccaatattaagaccttcttctcccccaactcttacgcaaagtgcttgatcattgagacgatagccatgacaagtgttacattttagctcgttcatatattctcgcataacattgcgtgtgtaatcgctattagtttcatggtaacgacgattaatattattgacaaccccttcaaaaggcaaatcaatatttctctcgcctccaaaatcgttaatataatggaaatggaactctcgttcgcctgaaccatatagggctaggtcctgctccgccttgcttaatttttcaaatggcgtatccatatcaacaccaaattgagtcatagcttgctctagcatcgttggataataatttgatgaaattggattccaaggaactaaggccccttctctaagggtcttacttctatctggaataaccaaatctatatctacttctaacttaattcctaagccatcacaggtcggacaagaaccaaagggagcattaaaagaaaaaaggcgtggctctaattcaggaacagtaaaaccacattcaggacaagaataatgttctgaaaacaataactcattgccatccattgtatcaataacgacataaccatccgacaaacgtagagccgcttcaacggaatcaaataagcgggaacgaatgccctctttattaattaatcgatctactacaatatcaatattgtgcatcttactttttgataattcaggcacctcagtaacatcgtgaatatcaccatcaatacgaacacgaacgtaaccatctttttgtattttctcaaatgttgatttgtgttgtcctttttttcgacgtataattggggctaaaatttgcatctttgttcgctctggaagcgctagtaccttatccacaatttgctctacagaagatgctgtgatggctccgtgaccattgatacaatatggggttccaacacgagcataaagcaaacgtaaataatcgttaatttctgttacagtcccaacagtagagcgaggattcttacttgttgttttctgatcaatagaaatagctggactaaggccatcaatagaatctacatcaggcttttccatatttcccaaaaattggcgcgcgtaagcagaaagactttcaacgtaacgacgttgtccttctgcatagatagtgtcaaaggccaaactagacttacctgatcctgatagtcccgtaacgacaactaacttgtctcgtggaatgtcgacacttatattttttaaattgtgagctcttgctcctcttatcattaatttatcttgcataatgttgtgcctcagcactcctttttgaatagtgttgacttattatatcaaattttaataaagtcagtatttttttagttttaaatttcatagaaaaaagagatgaactaatacgttcatactctttgttattatcttctttgttgtggtgccactggtgccattgagctttgaatattatatttacgttgtaaataaaagcgcaaaccaaacgatgctaaagcaataataaacaaaacaacctcaggaagtttaggattaatagttgcaggtagaagaggtactactgcaaataaggcaaaccaaactaacataactagtgccagtactgcgaaagatttaagccagcctggtctttcagattttggtttacccatatggcgataaatatagtaataagtaacgtacatggccgcaccaccaccaaaaccaagagttaaaattgaaataagccctgtattgacattagattgaccaaatagcaacattaaaccattcaaagcagttactaagccaagaaatagtaaggaagtatctaaccacatcaaccaaggattggtatttttttgtacagatactctagctttatcctcaggtcgctcagtgaatgaggctgcccaagtagttggtgctcctaagagtgagcgtgcggtaattccttttttctgattatctataatctctgggagatgttcttctaaaatagctttgatttctgcatctgattttccatcagctaaaagttgattagttgcaatatgaacaaactcttgattctttttagttaagtcttgtaaagtcatgtgaactccttgattaatatactattaaaaccattttttacgaataaaataaaatacaacaaatgaactcatcaaaaaggccaaaagaacaacatagataaagccatgtgcgagaccattcaaaggcatccaattattttgaaagttcatcccatacgccgaaaaaataaccgttggaatatccaatgtcatagttactagggctaaggttttcataatggtattctgattattaccgatgattgaagcagtcgtttctgtcatggcatttaagacattttcatagatatttgccatttcaatagcctgctgagtttcgatcaatgtatcttcaagcagatcttcatcttcaatgtatttttttaaactactggtactactggtcaattttttgacgattcgctcattaaattttaaagaggcctttagatagacaatagatttttccaattccatcatatcgatcaattgctcatttcgagttgcactctctagttgtgcttcaattttatcgctctgcctatcgatagtacgcaaagcctgtaagtataattcggcattgcgataaagcaattggaaaacaaaacgtgtcttcataaaggtataaaaatttttgacacgtcgtctataaaagtgatcaaacagcgtcaaatgttctaggcaagtagtaataacagcgttgtcagtaacgataatgcccataggaatagtcatataataacttttgttattgcgttcttcataggtaggaacgtcaacaataactaaagtataatcatcttcaaccgagatacgggaagtttcttccacatcgaggggagcacgtaaatcatcaatatcaataccaaattgatcagctacttgttcggattcttcctgggagggattaaccagatttatccaagcacctggctcgaatgtttcaatttctttaaattcaattgccgttgaaagaaacatttgcttcatggcgattcctcctttgttataaaaaatccataccttaatattatacaggaaaaccatttgttttgcacggttaatacggtggtatcctaaatttttctattatttgactcgtaaataccaataataatggtaaaaagaataaaaaaatagccgctagggctattttatattaatcttcatttacgtaaggcataagagccataacacgagcacgtttgattgctgttgttactttacgttggtttttagctgaagttcctgttacacgacgtggtaaaatttttccacgttctgaaacgaaacggctaagaagctctgtatctttgtaatcaacatattcaatcttgttagctgcgatataatcaacttttttacggcgtttgaatccgccacgacgttgttgagccatgtttatttctcctttatagttttaaattctgtccatctattatattagaatggtagatcatcatctgaaatatccattggatttgagttaccaaacggactctcatcacgactaaaattaggtgtttgttgagaagaagctgaataactattatttgacggagcattgttatagccaccgttattataagagttaggtgaaccaccttctcgtgtagcacgactttccaataattggaaactttccgcaacaacttctgttacatagacacgttgaccttgttggttttcataattacgcgtttggatacgacctgtaattccaaccaaagcacctttttttgcccagttagccaagttttcagcttgttggcgccaaataacacagttaataaaatcagcctcacgttcgccagattgatttttaaaattacgattaactgcaagtgaaaaagtggctaccgcttgattacttggtgtataacgaagttctgcatcacgggtcatgcgacctacaagtactacattattaatcataaactaccttcttagtctactttaacgatcatgtgacgaagaatgtcaccgttgatttttgaaagacgatcaaactcattaagagctactgcatcttcagcttcaacgttaacgatatggtaaagtccttcagtgaaatcttggatttcgtatgcaagacgacgtttttcccaatcttttgattcaacaacagttgcaccgttgtcagataagatagaatcaaaacgtgctaccaaagcgtttttagcttcttcttcaatgtttggacgaataatataaagaatttcgtatttagccattgatatgttcctccttttggtctaatgactcatgaatttttcatgagtaagtgaggttatgctcacaagatattattatagtagaaataagttaataatgcaaggtttttatgtttttatttccctgatatcatttaaagacattttttatttttctttattgaaatatgccttatatcaaacctatgtagccattttcttttactgacttatgttcaatccccattctataattcaattaaaaaataaaaaggcgaggtttacacctcaccttcaacatattatttaaagaattctttattggtttaagttttcgttggagaaaaattcagtgtctccgattttatatttttaaatattaaaatactatttagggagtccctcattatgttttattacctttggtaacaccaaaacatacacgaacttttattcatatgtgttaccattttacatctttcatattgagatatttgattagcaatacctccttgactaacaaaaattactaacacatctaggggtataccctagtttatatttgttcatgattacctcaagcaagcatgcgctaatggtaatgaactattaccacattgtctgtcttccttaaattatataaggacttatgtgtcaccgttactgtagcgacctacatctaaacctaacataagtgcccctccaactatttctaggaaatgaagaaaacttcaaatccttgtgactgtttgcaacatcaatgcattgataacaattttagtgtatcgccattcttatagcgacccatattaaaaattaacataagcgctacctccattaactaaagttagcttgcctaccaatctttcttttggagactagtctccattcttatacctagagatattgtaatagatcatggataacctccttgatttaaactttatctttataaattaattatagtgtaaacgcttccttaagtcaagaaaaaaatattgatgcaacatttttcttcatcattaagtacgatctagtcaacatacctctttgtcaaatcctctttctttgatacaattaatctatgatagatttaaaagactatggaattgagatgtggcctgaagatagaatcgcttcttttcgtcgcacacttttagggtggtatgaccaagaaaaacgtgatctcccttggcgaagaactactaatccatactatatttgggtttctgaaatcatgttgcaacaaacacaagttaatacagtaatcccttattataaacgttttctagagtggtttcctcaaataaaagatttggcagacgctcctgaagaacaattactaaaggcatgggagggactaggctattattctcgggtgcgtaatatgcaaaaggctgcacagcaagtgatggttgattttggtggcatatttcctcacacttatgatgatattgcttcattaaaagggattggtccttatactgcaggtgctatcgccagcatctcattcaacttaccagagcctgctgttgatggcaatgtgatgcgtgtcatggctcgtttgtttgaagttaattatgacatcggtgaccctaaaaatcgtaaaatttttcaagctattatggaaatactaattgaccctgacagacccggtgattttaaccaagcacttatggatctgggtacagacatcgaatccgctaagacacctagacctgatgaaagccctattcgtttctttaatgctgcttatttgaatggtacttatagtaaatatcccataaaaaatactaagaaaaagcctaaaccaatgcgaattcaggcttttgtcattcgtaaccaaaatggtcaatatctactggagaaaaatactaaagggagacttctagggggtttttggtcatttcctattatcgaaacgtcacctctttctcaacaattagatttatttgatgacaatcaatccaaccccataatctggcaaacccaaaatgaaactttccaaagagaatatcaattaaagccccaatggactgataatcactttccaaatattaagcacacttttagtcaccagaagtggacaatagaactcatagagggggtggtcaaagcaacagatttacctaatgctcctcacctaaagtgggtagcaattgaggacttttctctgtatccctttgcaacaccacaaaagaaaatgctagagacctacttaaaacagaaaaatgcttaatcacaagtgaactatgacggttcactttttgtttacaattcctttacgccgctgtaaagttttcctcagattatcttttaataccctataaatagtggtctatccctaatgtcaaatacatttgatagacccgttagcttatcatccttatactaatattatgaaaggagatatttatggaaattggtcagcaaattattcgctaccgtaaacaacaagcgctctcgcaagaagaattagccgagaaagtctatgtaagccgtcagagcatatctaactgggaaaatgacaaaacttacccagacatccatagcctcttactcctaagtcaaatttttcaagtgagcttagaccaactaattaaaggagacattgagaaaatgaaatataccatcactcaggttgataaaaagaattttgaacgagataccaaagtaatggtgacattgatgatactattaatgatttcaagttatccattagtctatttcttagagtggctaggacttggcatttttgttttattatcgataattactatgacttatgctaatcgtgtggaacgttttaagaaaaaatatgatgtgcaaacttataaggaaatcctagctgtttcaagtggaaaattattagacgaaatcgaaaaacgggaagaaagagcaaaacttccttatcagaaaccccttattgtcactgtatttttcctcattactgttgccaccttttttgcaagtcgttttattttcacatggttgttccatttaagttagtagataataaaataaagctcagcgtgacactgggctttattttatttaactcaattcagcaataatagctttcagttggtctttagtatgaacacctgcaacttgtttaaccacttctccgtcttttttaaacatcaatgttggaattgacataataccaaactgacgggcagtttccggattctcatcaacatccattttcaaaattttgagttcatcttcatcgatttcttgagataactgttctaagattggtgcttgcatacgacatggaccacaccaagttgcccaaaaatcaatgagtactaaaccttctttagtttcttctacaaatgtagcatctgttacttctaatgccatcttttttctccatttcatcttaatgataagcctattgtacaagaatctagttgtttttgaaactatttgctacgaactcgctaaataaataaacaaagccctaaaatcaagccaataaggtaacctacaataacatccttaggatagtgaatacctgctatcacacggcaaattgccaatagaaccgataatattaaacaaactattccaaagtaaacataatatcgtaacaaacacatactaatcatcgtagctgaaaaaacatgtctgctaggcattgaccttccctcagtatccttataaattaaaggtttaatattccatttttcatatggtcgtggaaaatcaaggcgtttcctaatgtaagacaaagctataaagccaacagcagggataattaatagccttaaccataattgaaatgtcatcccttgccaaagagtaaatatcagaaaagatggatagagtatgtacatcattcctgtgactatttttagtaaaaaatttaaaagaattattaactgtggggattttctaaaaggttgagatagtttggcataaaattgttcatatgattccataatttaccctaacgttacaattgtggcgccagatccccctgcattttgtggggcataagcaaaatgcttaacgtgcttattacgacgaagatattttgtcactccctcacggataacgcctgtaccaataccatgaatgatatcaacttgtcccatattgttaagcaatgcttgatcaataaaattatctaactcttgcatagcttcttcgtatcttttacctctaagatcaagtcgagctcttggtccagaactatcagcctttttaaccacattaatctgtttacttttgactttctgttcttcttggactctaacaagggtaaattcatcttgtgttaatgtcattttgataattcccacttgtgcttcccaacgtccatcttttaattgactagttaaggtacctcgctgtccatagctagtcactataatatcatcaccaattctaggagcacgagctgctttaatttttttagccttatttaagactttattttttgataaatcaacttgaggtgctaatttttttatttgtgccttagcatctataatttcgtgaggttttaattggctcttatcattgagtttttttaagatagtatcactctcattcaaagccatatctacaatttcttgagcttcttgatagattttttctaactctttatcgcgctcatgtgaaaattcattatagagtttcttaaccgcacgattgaatttgaggttttcttgttcaacttctttaatatgatccagtcttctacgtgtctcaagtgtctgtgcctctaactgttcaataatacggttaacatctgagtcagaatctgtcatctgcttagcttgtttaacaataaatggagctaaaccaaggcgagaagcaatttcaaatgcatttgatcgtccaggaactccttgcataaagcgatacgtagggctaagcgtttcggcatcaaattccatgctcgcattctctacaaaatttgtctcaatcccataagcttttaattctggatagtgcgtggtcgccatcgttttgatattacttaacctaaggtgttctaaaatagccatagccaaactagcaccttcttgaggatccgttcctgctcccagttcatcaaagaggactaaactattgtggtcagcctcgtttaaaatactgactatgtgcgtcatatgactagaaaaagttgatagactttgttcaatagattgctcatcgccaatatctgcaaagatattgttaaatactgcaattttactacctttatccgctaatactggcaaaccagactgtcccattaattgtgctaaaccgagtgtttttagcataatcgtcttaccaccagtattgggaccagtgatgacaattgcagttaaatcttgatcaaaatgtaagtcattagccacagggttacttaacagaggatgacgaacattgattaatgctaacgtgctgtcattagaaatctcaggtatcgtcgccttattatcagacataaaaagatatttagcccttacaaaatcaagatgcccaagaatccatgcattatttctaatagtggcgacatggggtcttaacaagtctgaaaatgcgtgtaaaatacgactttcttcatgacgttcgtcagctctaagctgcgttatctcttcgtttagtgtaactacagcacgaggctcaatataaacagtacttcctgaagaagagatgtcatgaaccacaccagaaatacgattccgataagtattttttactggtaggacacttcgtccactacgactagcgattagattctctgataaaagctctgctttttccttaagcatatcctgtaaaatctgacgaacccgtcgttcactgtttgttaattgacgacggatacgctctaattctggactcgcaaaatgttctaaaaaaccaccatcattgatagcttgaaaagacccttgcagattagggaattgttccaaattttcaaacaaacgatccaaagattggaaagaaacattatccaaatcagaataaaagtgaatcatatccgaagaactctgtaaaacttttttgatagccaaaagttcttgaatattaagatcagctgaaagctctaagcgttttaaactctcagagattgaacttaggctgactatgccaaatgagtgatgttcaacaaaaatctgttccatgtcagaaatttcattaaaacttttttctattttaggagcctccgtcatcggctccagctctgataattcttcttgtgattgttctgtcttgagataaggtaatatcaattccttaactttgttaaattctaactgttctaaaatcttgttattcatactcttcattatacctaaatttatcacaaaatgacaacgttaaaaaggttggaactcttactccaaccttactaaacattatattcaaagacctaccgcccaagtccttaccaaaaactgtgagaagaatggtaagtcgttaattaaaaatctaacaaacagactattccataacttttcttgaacaaatgacatagggactgttgccagaatagtcaaacacatactcataaataagagacaaaccagaacggctaaaaaaccactaataatattattttgcaagctatcaaaatgttcaactggtgctaaatgtagtaaaacacctaacaagcgacctactaagtaagataaactgtagataaaaacaaaggcaacacctgcataataaacatgactcaattgaaatttgctaatatctttaaaaaagtaaacttctactccttgtacaggattagaatacggtacccataacgtaatctgactagctaattcttggtaaaattgactagcaatcatcaaagataccattgacattaacacgtaaaagacttgtaaaaaaatacctctactgtagccaatataaaaatgccaaataacaataatcagcaaaagcaatgatagcatgattaatcctcactcactttttctttaatgtccgaaatcgttttggagcgtaacttattgagctcatcttccattttttcaatgtcaatttctcgacttagttgcactgataaagcattaattgccatgagaatagcaatcgtttcattatcagcattaggtaatttttctttaatagcttcatacttttctgtagctacacgctcaatctcttccataaaaaggttgtctttatctgtcgtcaatgtgagaggcttatctccaaagacaaatttataacgatttttctgactattatttatttttgtttccatactatacctctgctagcattataccgtaaaatagggctttcgtaaaattctaccccttatcattacttgtctattcccttattcctcttttttatgatagaatattgtctatgaacacaatcgtcatgcaagcagataaaaaattgcaagaaaagataagaaccgatttagctcaacatcatataagtaataacaatccttatgtggtattttcagctaaaatatcaggagctactgttcttttatatacttctggaaaacttgtcttccagggttctaacgcttcacatatcgcccaaaagtatggttttattgagcaaaaagaaagttgttcctctgagagtcaagatattcccataattggtactgatgaagtgggaaatggctcttactttggtggactggcagtggtagctagttttgtaactcctaaggaccatgcttacctcaaaaaattaggtgttggtgattcaaaaacacttactgatcaaaaaattaagcaaatcgcgcctcttttggaaaaagcaattccacacaaagcattattgttatcgcctcaaaaatataatcaagtggttagtccaaataacaaacataatgctgtctccgtaaaagttgctttacacaatcaagctatcttccttcttcttcaagatggttttgaaccagaaaaaatcgttattgatgcttttactagctccaaaaactatcaaaattatttgaaaaatgaaaagaatcaatttaaacaaacgattactctggaagaaaaagctgaaaataaatatctagctgtagcggtcagttctattattgcacgtaatctattcttagaaaaccttaacaaattaagcgacgacgtaggatataaacttccaagtggagctggtcaccaatctgataaggtcgctagccaattactcaaagcttatggtatctcttcgcttgaacactgcgcaaaacttcattttgccaacaccaaaaaagcacaagcattattaaaataaatagcagggaaaattatgaaagaatttattaaagaatggggtgtctttatcctcatcctctcactttttttactatcgcgtatctttttatggcaattcgttaaagttgacggacactccatggatccaactttagctgacaaggaacagctagtagttctcaaacaaacaaaaatcaatcgattcgatattgtagtggctaacgaagaagaaggcggccaaaagaaaaaaattgttaaacgtgtcattggtatgccaggtgatgtcatcaaatataaaaatgacaccttaactattaacaataaaaaaacagaagaaccttacctcaaggaatatactaaattatttaaaaaggataaattacaggaaaaatattcgtataacccacttttccaagacctagcacaaagctctaccgctttcaccactgacagcaatggcagcagcgaatttactactgtcgtgcctaaaggccactactatcttgttggtgatgaccgaattgtctctaaagatagtcgtgccgtcggtcccttcaaaaaatcaacgattgtgggagaggttaaattccgcttctggccaattcgtcgttttggaactatcaactaaaggaaattaaaaattcacctgacaaaagttgaaatagcatattatattgaaaatagggagtgacaaatccatttaaaatagggatttacaatcactccctttaactgtttattaaaaaggaaggtacaatggaagtattttttacaggaaccattgaacgcattatatttgaaaatgccagcaatttttttaaaatattacttctggaaatcgaagatacggatagcgattttgatgatgtagaagtaattattactggtactatggccgacgttatagagggagaagaatatactttttggggaacactaacccaacatccaaaatacggcgagcaactacaaagtgtacgctatgaaagagccaagcctacttcaggtggccttgtgaaatacttttctagcgaacaatttaaaggaattggtaaaaagactgcccaacgcatcgtagaactctatggagataataccattgataaaatccttgaatcccctgaacagttaagtacaatctcaggactatcaaaaattaatagagaagcattcatcgctaaactgaaactcaattatggaacagagcaagttttagctaaactcgctgaatatgggttaagcaatcgtgctgctattcaaatatttgatcactataaagaagaatcacttgaagtgataaacgaaaatccttatcaacttgttgaggatatccaaggtatcggttttaaaatagctgaccaacttgctgaacaagtcggtattgaaagtgattctcctaaacgctttcgtgctgctattattcatactttagttgagtcttctatggagcaaggagatacctatattgaggctcgtactctcttggaaaaaaccattactctccttgaagaagctcgtcaaatcgaactagatccttcaattgttgctaaggaattgacaaatttaattgcagaagataaagtgcaacatattggaactaaaatttttagtaatactctattttttgccgaagaaggcatcaaaaaaaacttacaacgaatactaaatcagcctcttgataaacaactaaatcacaaagatattgaccgtgaaatcagagatattcaaaaatctttaaatatccactacgataatatccaagaaaaagctattagagaagctttactaagtaaggtatttatcttgactggtggcccaggaacaggtaaaacaacagttataaatggtattattgaagcctattccgagttacatcatattgatttaaacaaaaatgatattcctattgtacttgctgctcctacaggtcgtgctgctagacgcatgaatgaacttaccggtttaccgagtgctactattcataggcatttgggattaaacggagatagtgactatcaaagtctagatgactatctagattgttccttaattatcattgatgaattttcaatggttgacacttggcttgctaatcaattatttgacgctttggactcgcacacacaagttattattgtcggagatagtgatcaattaccgtctgtaggtccaggacaagttctagcagatcttttaaatataaatgcacttccacacgttaaacttgaaaagatttttagacaatcagaagaatcaactattgtgactttagctaatcaaatgagacagggctttttgccagaggactttacagctaaaaaagccgatcgctcatactttgaagcatctgctaatatcatcccaaatatgatttctaaaattgttcaatctgcacttaagagcggtattgaagctcatgaaattcaaattttagctcctatgtatcgcggccaagcaggtattaataatcttaaccttatcatgcaaaatctcctcaatccattaaaagataataaccaatttacttttaatgatataaatttccgaataggagataaagtgttacatttagtcaacgatacagagcttaatgtttttaatggggatattggttacataacggaccttataccagccaaatatactgagagcaagcaagatgagatttatatgacttttgacggtcaagaagttatctatcaacgcaaagaatggcttaaaataacactagcctatgctatgagtattcataaatcacagggttctgaatttcaagttgttattctgccaataacgagacagagtggtcgaatgttacagcgaaaccttatttatacagctattacgagatctaaaagtaaactaatacttttaggagaaattggtgcatttgatttcgctgttaaaaacgagggggcaaagcgcaatacttatctgatagaaagatttgaaaacaagcaagaaatagctaattctcaaaaaattgaagatagctcaatagatcaaaagattgacaacacaataattaatacgtccattccaaaaacagcaacaccaattgagcagactaatctttcaaaaataacttatcgcctaactgaagaaaattatttaacaatcgatccaatgattggtattaatcaacaagatataagtgcaatttttgatagtaaataaattttttcataaaatcttgaaaactcttccaaatatgttataatatcattgtattaagaacgtagttcaaatttaatacttttattaaggtttatttagaaaaaggagatattatggtttcatatgaaaaagtccgccgctctctgcgcacagctacaatcactatcattgtattaaatagtttgtctttagtattcagattgtttacaggaatttcagtgcagctagccaaaactgaaattaataaagggaacacaggtaatcttcctaaagaacatatcgaagcagtcttgagcgccacaacaccatttatgctatttgtcactgctttaatagtattagtcaacattgccattgttattttctgtattaaaaatttaagagcaattaaaagaaatcaaacggttaattaccttccttattaccttggcttcgccattactgtaggacttgttattttgggttttctaactactaaagcaccatgggcaatagctataaatatcgtcttccaagctattttcggtcttctttatttccatgcttatcaaaaagcacaaaaactcaacgaacgtgatcttgaagagactaactaaaagtaaaagcactagaatctagtgcttttttcttttcaaagagagttaaatatagtcatcgtcccaacttttaaaaatctaaatagatagcttcatgttcattttccagggtcgttactgtaacacctaagagtcgtatgccaaaaactgactcttctaaggtatcaaatatcgctttagcaacttgatcaatgatttgaaaatcttgagtatactcttctaatgtcatacgtttcgtcaatgtttcaaaatccgcatatctaacttttaaaacgattgtcttaccaactttcttatttttctccagagaagcaacaactctctgaacgttctttgaaatctcagctttgatatctgcttcgttatatagtaatttcccataggttttctcacttcctattgatttacgaactctatcaggttttaccggggaagcattaatccctcttgccttacgataaaggtcatacccgaaacgaccaaacatatcaattaaagaaatttcagataaggaaaggaggtcctcaccagtataaacccctaaagcatgtaatttttcgacggagcgtttaccaacaccatgaaatttctctattggtaagggcttcaagaaatcttgagcttgatctggtaggatgagggtaagtccttttggtttctcaaagtcagaagccaattttgccaaaaatttattgtaggaaatacccgctgaacaggtcaaatggacatcattccaaatatcgtattgtatcattttagcaagtttaacagctgattttattcccattttattttcagttacatctaaataagcttcgtctatactcatcggttcaaccaaatccgtatactttttaaatatatctcgtacttccattcctacttggcgatatttttggtaatttcccgaaataaagatagcttgagggcatcgttcatacgcttcttttgaagacatagctgaatgaactccaaactttcgagcctcataattacaagtagaaacaacccctctgccgccggtttttctgggatcagaaccaataataacaggctttcctttaagagagggattgtcacgctcttccacagatgcaaaaaaagcatccatatcaatgtggataattttacgcgacgtatcatttattaaaggaaaaattaacattgttctctcccccattctctctactccattataacagattacaacttaatgatacagattaaaaaaactgtattataaaagaatcataattttgtcaagaaatatgcttgcgaaaacgtttactttttcctaaaatggatatgtaaacaaaattaaatctgtcacaatgtttaaggagaaaactatggcaacagttaaaacaaacacagatatctttgaacaagcttgggaaggctttaaaggtgttgattggaaagaaaaagcaagtattgctcgcttcgttcaagcaaactatgcaccttacgatggagatgaaagcttcttagctggagcaactgaacgttcacttcacatcaaaaaagtgattgaagaaacaaaagctcactatgaagaaactcgcttcccaatggatactcgtgttgcttcaatttctgaattaccagctggttttatcgacaaagataacgagcttatctttggtattcaaaacgacgagcttttcaaattgaacttcatgcctaaaggtggtatccgtatggcggaaactacacttaaagaaaatggttatgaacctgatccagctgttcacgaaatcttcactaagtacgctacaacagtaaatgatggtatcttccgcgcttatacttctaacattcgtcgtgctcgccatgcacacactgttactggtcttccagacgcttattcacgcggacgtatcattggtgtatatgctcgtctagctgtttacggtgctgactacttgatgcaagaaaaagttaatgactggaatgcattgaatgatattgatgaagagtcaattcgtcttcgtgaagaaatcaaccttcaataccaagctcttggtgaagttgtaaaacttggtgacctttacggcgtagatgttcgtaaaccagccatgaacactaaagaagccattcaatgggtgaacattgctttcatggctgtatgtcgtgttatcaatggtgctgcaacatcacttggacgtgttcctattgtccttgatatctttgcagaacgtgacctcgctcgcggtacattcacagaatcagaaatccaagaatttgttgatgattttgtccttaaactccgtactgtaaaatttgctcgtactaaagcttatgatgccctttactcaggtgacccaacctttatcacaacttcaatggcaggtatgggagctgatggacgtcatcgtgttaccaaaatggactatcgtttcttaaatacacttgacaatatcggtaactcaccagaaccaaacttaactgttctttggtcagatcaattaccatatgctttccgtcgctactgtatgtcaatgagtcataaacactcttcaatccaatatgaaggtgtatcaacaatggctaaagaaggctacggtgaaatgtcatgtatttcatgttgtgtatctccacttgatccagaaaacgaagacaaacgtcacaaccttcaatattttggtgctcgtgttaacgttatgaaagcacttcttactggtcttaacggtggttatgatgatgttcataaagattacaaagtatttgacatcgacccaattcgtgacgaagtactcaactttgacactgtaaaagctaactttgaaaaatctcttgactggttgactgatacttatgttgatgcgatgaatatcatccactacatgactgataaatacaactatgaagctgtacaaatggcattcttaccttcacatgtacgtgctaatatgggatttggtatctgtggttttgcaaatactgtcgattcattatctgcgattaaatacgctactgttaaaccaatccgtgacgaagatggttacatctacgactacgaaacagttggtgacttcccacgttatggtgaagatgatgatcgtgttgactcaatcgctgaatggttacttgaagccttccatggacgccttgctaaacacaaactttataaagatgctgaagcaactgtttctcttcttacaatcacatcaaacgttgcttactctaaacaaactggtaactcaccggtacataaaggagtatatctcaatgaagatggtagtgtaaacctttctaaagtagaattcttctcaccaggtgctaacccttctaacaaagctaaaggtggctggttacaaaacttgaattcactttctaaacttgatttcgctcatgcaaatgatggtatttcattgacaactcaagtttctccacgcgctcttggtaaaacatttgatgaacaagttgataacttggtaacagtccttgatggttactttgaaaacggtggtcaacacgttaacttgaatgtcatggaccttaaagatgtctatgacaagattatgaatggtgaagatgttatcgttcgtatctcaggttactgtgtcaatactaaatatctaactcctgagcaaaaaactgagttgacacaacgtgtcttccatgaagtactttcaatggacgatgcattaactaactagtttgtattcgatgaagtaggtttgattatatcaaacctacttttatctatattatcaatagtactaattacttctttatataacctcaaggaggggcctaatgttaaatcacaaatttcttcaagttctaaaatatgagggtgtcgtttcgataacaagctggatcgaattagctcctcacgttacaaacacttggaatagctacctgactattacagatgaccagcgtatattagctcctgcagcaggaatgactcatcttgaaaatgatctcaataataattctaaaattattatgactctgggcagccgtgaagtcgagggtcgtgatggttatcaaggtacaggctttagaattgaaggaactgctaagctattagaagcaggaagcgattttgaaattgttaaagaaaaatacccttttctgcgtaaagtattggaagtaactcccataaatgttatccaacttttataaaaaacttctcctagaaaattctaggagaagttttttattcaaagtacgatgttatcgcctcttgtacatgtcgtcgtttcttaatccaaagtggacggtcatcataggaaaaggttctgtttgtcaaaaaaatagctgctgcctgcttttgataatttagtgcaataaaaggaccagtataaccagtatggtttatccaatccttatctatatcccaagctaatgatcttgatttactcaaactataattattccacaaaggcttcgcaaaatcatcttttaaataatgaatagaaaatctttgtaaatcatcaatagttgaaaataaacctgcagaaccagtatgctttcctaataccttagctttaggatcgtgtacaataccatcgttaataccgactacagttggaacagcttctactctaggaccaaaagaggtttctttcatctgaaaaggagtgaaaatataacgtttgaaaagtttatccaaactatcccctaatacctcttctaacataaaaccaagtaaaagaaaattaatatcagtgtatttaaacgatttatcttccaaaaccttgatatgattaatggcatctttcagctgagtagcattcaactgatcacgatttggaataaaagggtcaattccactgctatgtgtagctaattgccttacagttaacgtctgatgatgaaacgtagggtaataataccttaatggcttatcaatatcaatagtcccttgataaactaactttgctagtaaagttcccacgccgacaacttttgatacactggctagatcatagaccaatcccgctttaactttctcattgccatcaattgtccccaagtaatgttcgtgccactctccattttcataaatagctaagcttgcaccatgataaagattatctttgatttgctccttaatgagttctaaaacagtattagttttaatcattcttttgaaatccaaatctcaatattactagtgtcagagatgactaaaatcttttctttagaatcaaggtaaacatcaagtcccaatgattcaaaagttgatttcaagtcatttaaattagtatcttcattaacacagcattctagtatctcaatatcccaagtttcatttggagcaatttgcaaatcttgtccctgtgcttctttgaaagataaattaattgggaacttcccagcaaatactttatcgtaaaaagcttcagctttcacggcatcaggtacattcaaactaatagattggaaagcaaagtttgatagacctgtagtgtcatcttttttttctaactctgggcgctcaattgccactaattgtgacaaatcatcttcagcatgaagtaagaaaaggtctccctcgggcgaaactgtttcataggcataaccattttgaccttgatatacttgaatggcttgcgcaccatttgccaaaagcttttcaatatcttttgcatcttgagacttaacaataatctttgctaacttcttagtaccattcaccgcacgagtacgataagttggggattcctcaataataaagctagcctctttgttctgccatgctgagaaaactgcgattgcattttcttcacttatcaatttaaatccaagagactcctgataaaatgcaatattcaagtctctattattaacacgtaatactgggtgtttaaatgtcaatgaatgaaataacgtcataaattcctccttgttcagtctagtctattttagataattttagataatttagcaagaatctttgtgctctcaataccataaagtcaaattgacagtttcactatttttttgtagactggatattatgaatgaaacactactattacatgggattcagcttattctgattatcgccatgattatcactttttatcagattgttagacatattaggtctcaaaaaataaatcctttcaaacgatttttcactggtttgtggatcggttttgtaactgatgctctcgatactcttggtatcggctcttttgcaacaacgaccacattttttaaactaactaagcttgttgaagacgatcgtaagatacccgcaacaatgacagctgcacacgtacttccagttttgttgcagtcactctgttttatttttgttgtaaaagtagaggctttaacactaataacaatggctggtgcagcttttattggggcttttgttggagctaaaatgactaaaaattggcacgctcctactgttcaacgtattctaggaacactgctcatcacagctgctattattatgctctatcgtatgatcactaaccctggcgctggtatttcagattcagtgcatggtctacacggcatttggttatttgttggtatcggcttcaattttattattggtgtattaatgactatgggactaggtaattatgctcccgaacttatcttcttctccctaatgggactgagtcctgcagttgctatgcctgtcatgatgctagatgcagctatgataatgacagcttctagtacacaatttatcaagagtggtcgtgttaattggaacggctttgccggtctggttactgggggaatattaggcgttattgtcgctgttctcttcttaactaaccttgatcttaacagcttgaaaacactggttgtaggtattgttttatttactggagcaatgttaatacgttcttcctttaaaaaaactatgcccaaaagtcatcattaaacgaaatcagctagcaagactggctgatttttatatttaaaacaaaaaaagaccggtaaaccgatctttctttaactattaaagatataatagtttgaacaaggctacagcgagtatacttgctacgattggtgctaaaactggcacccatgcataccaccattttgaatcttctttagcttgtccaagaatttgttttggtaataagcggtgaacaatacgtggaccaaggtcacgcgcagggttcaatgcaggtccagtcggtccacctaaagaagcaactagagtcattaccaagaaaccaatacctaagtgagctacagcaagtgaaccagttacgtatggtgaaatccttgtcgctgctgtcgtttggtcataaccagcttgaacaagtttaccaacaagttctacaccaaaatagttcttcgttaaagccaaagctccaaagaaaagaacaaaagaaccaacgaattcatttaagaaaccattaatgtaagccgctttacgacttgatttctgtccatcatctaatgcagaaatagttgaaaatgatccaagaacatgatttggattttctgtcttaacaaagtaaggttgataaaccataacgacaactaactgtccaaacattgctcctaaaatttgtgcaagaatgtattgtccaacgtgtgcccaagggaaaagacctgaaaatgccaatccaagtgtgaaagctgggttaatatggtttccagagacattaccaaacataagcgctggcatcataacacctaaaccataaccaattgcaataataatccaacctgaattatttccttttgtgccttttaagtcaacgttagctacagccccatttcctaagatgataagaaaagcggttgcgataaattctgtgatatacttcacagtccaagtgatttcgatcaatccttgtttcctcccaaaaaaatatttacaacattaaccattctaccaagtaagcttaatattgtaaagcttatcacaaaataaaattaataaaatttttaaccaaatatatttgataaaaaatagagtactaggttcggactacctagtactctattttatttagtttataaggttttcttactatcacgaacgactagcatatcaactttcgaatgacgtaaaatgtattctgaagttgagccgatcaatagtctttcaaaagtgtttaatcctgttgcgcctaccataattaaatctgctttttcccttatggggatatcctttgccaaaagagtcttaggatttccgatttcagtaatttttttaatctttgtaaggccttttgaatgtgctaatttctcaaaataggctagcacatctgctgactcttgttcttgcctatcaaaaacatagtcactaaagactccctcactttggtaagcgtgagcatctataacatgcgttagcagtaattcagcatcattacgaagagcaacatttatccctttttctaccgccaattctgactcgtaagacccatcaatagcaataagaatacgctcatatttttgtgtcatagcttaattcctcccttttatatagttttagtttcaacttgtctagatgattttaagaaatatagaataccacaaacaacaggaataatcgctgctatccagaataattctctaaaggattgcacaccagctccaagaaaaccatctttaacaagtcccaaaatgtaaggtccagcacctaaccctaaatcaagacctatcatgtaagttgacatggctgtattgaaacgatgttcctcaacacctttgattgatgctgcttggccacaagacataaaggtgccataaccaaaaccaatcaaagcacctgatagaaggtaggtaacacttcccatagcactccctaataaagcaagtcccaaagttaagaacagataacttggataaagcacccacttatctcccttagcgtccattaatcttcccatagatggtctggttaaagtgatgacaagtgcataaacaataaagaaataagctcctactgtcatcaaattaatttctgttgtatataatttttggaaacctaacacggaagcataggagatacccatcaaaaatgcaataattgtgataaaaattgcttttttctcaatgaaactatcaatagtccatgattttgatttagctaactgttctggatttaaagtaatatttttgactgggaaaacaaatgctcccaacactacaatcgcaattaaaatactacataatacaataaccattttaaagttaatatgaaggttgtctagcataaatgttcctacaaaaggaccaatagctgcggctaaacttgttgatagaccgtaaaagttaatcccctcacctcttttatcagctggtatataggctgttacaatagtattagttgctgttgacacgacgccataaccaaaaccatttaggaaacgaactaaatacattactccgatacttggcatataaaaataagctaaagttgttagtaagtaaaaaatagcccctccacgtaaaactaacttacgtcctagaacttctaattgcttgccaaatataagacgagcaatcaaagtccctacaatataaatccccgttgctaatcctgcttggctagtgctaacacctaactctttagtcgcaataaaagctatgataacggtaaacaaataatagaccatataaacaataaagtttaaaatagtaatgcctataaaatgtttgttgaataatttgtcttccaatgcaaatggctcctttttttcaatttcattttcataaacattttacaaaaatattagaagatacgatatttcaatggtataatataagtgctagtatcagactgcattaacaaatgttaaggtggtctatcaaacctaaaacatttggaggaagtcatgaatcatcaaattttacaaaattacattaatagtcataatcttccaattatcgaaaaagactaccataaataccttacatttgaaagtttagaagaagactatacttatatcctaaaagatggtattgttaaacaaagtgttctctctaaatatggtactgagttcaatctgcgttatgtgacaggcttagaaatcacttctatcctaaatacagactactcccaacacatgggagaaccttacaacgttcgaatcgaatccgaaactgcccacttttacaaagtacgtcgctctaccttcctaaaagatatcaataatgatattgaactgcaaggatatgtgaaagatttctatcataaccgccttgaaaaatctatgaaaaaaatgcaatgtatgctcactaatggtcgaattggtgctatctccacacaattatatgacctcagtaagatgtttggtgaagaacgagataacggtgatatctatattaattttgttatcacgaacgaagaacttggtaaattttgcggaatatccacaggaagtagcgtgagccgcattttgaaacaactaaaagacgatcatattattcgtattgaaaaacaacatatcattattacaaatgttgagaaattaaaagatcatattgtattttaatataacaatagaaaggatatattatgcgttataatcaattcagctacattccaactaaacctaacgaagcttttgaagagctcaaaggactaggttttccattaaacaaaaagaattctgataaagctaatttggaagcttttctcagacattcttttttaaatcaaactgatactgattacgctcttagtctccttatcgttgatgcaaaaaccgatgctctaaccttttttaaatcaaatagtgacttaacactagaaaatttacaatggatttatttacagttattaggctttatcccttttgtagactttaaagaccctaaagcattcttacaagatattaacttcccagtctcatatgacaatatttttcaaagtctacatcacttactcgcctgtcgtggaaaatctggcaatacattaatcgaccaattagttgctgatggtttacttcatgcagataatcactaccattttttcaatgggaagtctctggccactttcaatactaaccaattgattcgcgaagttgtctatgttgaaacatccttagatactatgtctagtggtgaacatgatttagtaaaagttaacattatcagacccactaccgagcatactatccctacgatgatgacagctagcccctatcatcaaggtatcaatgatcctgccgcagaccaaaaaacataccaaatggagggtgcgctagcagttaaacaacctaaacacatacaagttgacacaaaaccatttaaagaagaagtaaaacatccttcaaaattacccatcagccctgcaactgaaagcttcacacacattgacagttatagtctcaatgactattttctttctcggggttttgctaatatatacgtttcaggtgtgggtactgctggctctacgggtttcatgaccagtggggattaccaacaaatacaaagctttaaagcagtcattgattggttaaatggtaaggttactgcattcacaagtcataaacgagataaacaagtcaaggctaattggtcaaatggccttgtagcaaccacaggtaaatcttatcttggtaccatgtcaactggtttagcaacaactggcgttgaggggctgaaagtcattatcgctgaagccgcaatctccacatggtatgattattatcgagaaaatgggcttgtgtgtagtccaggcggctaccccggtgaagatttagacgttttaacagaattaacatactcacgaaacctcttagctggtgattacatcaaaaacaacgattgctatcaagcattgttaaatgaacaatcaaaagcaattgaccgtcaaagtggggattacaaccaatactggcatgaccgtaattacctaactcacgtcaataatgtcaaaagtcgagtagtttacactcatggactacaggattggaatgttaagccaagacatgtctataaagttttcaatgcattgcctcaaaccatcaaaaaacacctttttttacatcaaggtcaacatgtgtatatgcataattggcagtcgattgattttcgtgaaagcatgaatgccttactaagccaagaactacttggcattgacaatcatttccaattagaagaggtcatttggcaagataatactactgagcaaacttggcaagttttagatgctttcggaggaaaccatcaagagcaaattggtttaggtgatagtaaaaaacttattgataaccattatgacaaagaagcctttgatacttattgtaaagacttcaatgtgttcaaaaatgatcttttcaagggaaataataaaaccaatcaaatcactattaatcttcctctaaagaaaaattatctcctgaatggacagtgcaaactccatctacgtgttaaaactagtgacaaaaaggccattttatcagcccaaatcttagactatggtcctaaaaaacgattcaaagatacaccaaccatcaaattcttaaacagccttgataatggtaaaaattttgccagagaagctttacgtgaactcccgtttactaaagatcattatcgtgtcatcagtaaaggtgtcttgaaccttcaaaatcgtacagacttacttacaattgaggctatcgagccagaacaatggtttgatatcgagtttagcctccaaccaagtatatatcaattgagtaaaggtgataatctaaggattatcctttatacaactgattttgaacataccattcgagataatgctagttactctataacagtagatttaagtcaatcttatttaactatcccaactaatcaaggaaattaacttatgaaacttctcactaaagaacggtttgatgattctcaacacttttggtaccagatcaatttattacaagagagtaacttcggagcagtttttgaccatgataataaaaacattccacaggttgttgcaactattgttgatgatttacaaggttccggaagttcgaattatttctggtattttggcaatactactgatacttccatccttatgattgctcatttaaatcgaaaattctatattcaggttaatttaaaggactttgactttgcactcaatttaatagctataaataattggaagagtctcctccaaactcaactcgaagctctaaacgataccctagcaatatttcaataaataaggtagaatggagtgacaaagcaacgcgagggagactgattaatgtcatcttattggaataactatcctgaacttaaaaaaaatattgatgaaaccaatcaactaattcaagaaagaatacaggtcagaaataaagatattgaagcggcgctaagccaactcacagctgcgggaggaaaacagctcagaccagcattcttttaccttttttctcaacttggtaataaggagaatcaagatactcagcaactaaagaaaatcgctgcttctttagaaatccttcacgttgctacattaatccatgatgatgtcattgatgactcaccactaagacgtggaaatatgaccattcaaagcaagtttggcaaagacatcgcagtttacactggggatttacttttcacagtctttttcgatcttattttagaatctatggctgatacaccatttatgaggattaatgcaaaatctatgcgtaaaattctcatgggagaattggaccagatgcaccttcgttacaatcaacaacaaggtatccatcactatttacgtgcgatttcaggtaagacagccgaactctttaaattagctagcaaagaaggagcttactttggtggtgcagagaaggaggttgttcgtctagcaggccatatcggctttaacattggtatgacattccaaattttggatgatatcctggattatactgcagataaaaaaacatttaacaagcctgtcttagaggatttagcacaaggcatttacagccttcctctacttcttgccattgaagaaaatcctgatattttcaaacctattttagataaaaaaacagatatggctactgaagacatggaaaaaattgcttatctcgtcgtttcccatagaggtgttgacaaagctcgccatctagctcgtaaatttactgaaaaagctattagtgacataaataagctaccccagagctctgcaaaaaaacagttgctacaattaactaattaccttttaaaacgcaaaatttaaataataaaaaaacattccacaatgctagaaaagcagttagggaatgtttttttattatcatttatttatcgcacctatcaatcatcatagatcaccatcatcagaggctttcagctgacggtaacgttggctactttgagacaattcttgaggagaaccttccaactctaattgcccattttctataaataagatacgatcagcatgttcaataccttttaagtgatgtgtaatccaaactaaggtcttaccttccaattctttcataaatacccttagtaaggcttgttcagtaataggatcaagtccaacagttggctcatctaagataacaattgggacatcttttagtaagattctagccaaagcaattctatgcctttcgccacctgaaaacctaagtccagcttcatcaaccattgtatagagaccatctgataaatcagtgaccatctctttcaatccaactcgttcaagaactttccatacatcttcttcactagcatcttggtttccaatgcgaatgttatttagcagggttgtattaaaaaggtagggcgcttgttgtatcactccaatatagttagaaatgcaatcaccaactattgaaacatcagcatcgcctagggtaatctccccttgacttgctttcaagtcgccacgaagtagactggctaaggtactcttgccagaaccactacgccctaaaatagcaattttttctccttctttaatatccaaatctaaatgatgcaaaacccatttctcttgtggcttatactggaaacttaaattcttgacggaaaaatcgtatggcttattaggcaactgattttgagttgtttcaaaatacgtttctgataattcattaagacgatgaattgaatcagaatatttatttgtttcttgagcagcagcagacaaaccagcaaatgcctctgacaagggaaatactgttagaacaaatgctgcaatccagttagcttcgccacctctgtgaccaataaactgattactagcccaaataataaccaaaatagctagaaagccaaaaactaattccacaataagagctctacgattatcaaaggaacgaatttttttctgaacagccatgagttcactttccgaacgctcatgcaaggcgacgtactcttgaccacgttgactaaaaatccagtctgaaatacctaagacattatccgtcaaatcagtataaagatgattttttaattctttttcacgagtctgacgagcaccattagctaaaatcgaccaaagtggaaaaagaaaaatcataatagctaaataaagcaacatcattaaagcaaaccatagagaaaagaagcctgttgcaataataataaagctatataatatccacgctataatcgttggaaatattgtcctaagatacaaattttgcaaataattaatatcctccgctaaaagccccataacatctcctaaacgaaaatcacgcttcataaagatagcattgctttctaaggaatggtaaagcttcaagcgcagctgtgaagtcattcgtaatacccaattgtgactcgttaggcgttctatataacgaaaaacaggacgtccaatgccaaaagcacgtgttagtacaattggaacatatactagaagaatattactcggtagtgaagctgacttactaatcagatagcccgaattaaacataagagcactggcagaaaagaaagtcataaaaccaaggaaaagagcaattactaaggaaactttatattgtttgaaaaatggttttatccattgatctgtctttaattctttaaacaaagggattttaaacatcatttcctcccatagcatgcttcagttgatagagatatccttttttagctaataattcctgataagagcctacttctgcaactctccccttctccataacgactataacatccatttggttcaaccagtgaagacgatgagttgcaaagataactaaacgatctgacatcagtggcaacattttctcttttaattctaactctgtttcaatatctaaatgagcagttggttcatcaaaaaccataatacgacgattttgatcaagaaaagcacgagccagagctatacgctgggcttgtcctccactaagcggacgcgctccattaccaatacgcgtttctaaaccgtcaggtaactcgcttagcaagctatctaaacctaccatatgaatcgctcttaccacctcttcgtcactagcattgggagtatagaaggtaatattatcacgtaatgacatttcaaaaacataaggagtttgaggaatatagatcatctgtttatgccaatcttcttgatcaaggttagtcacttctctaccatccacttttaaagaaccattatcaggccctaaaaaaccactcagaaggttaattaagctagacttacctgaaccactaactcctactaaagcaaccttttgatgtcctctaaatcgtaaggttacatcctcaacaacacgtttttggtcgtacgcaatagcaatgttttctaaatccaaacgactctctttagaccaatcatctatgactaattgctcacctttaataccagttttgtttagaactttttgaatcgcttgaaatgcatttttcccgtctaacgttgcatgataatcactagaaaaatctcttacgggtaaaaagtattcaggggataaaatcaaaattgttaaagccggtaaaaggtaaatctgctcatttaataatcgtaaacctagaaaaacagcaacgatagcaatggataaagttgtaaaaaagtctaaagcaaacgttgataaaataccaattttcaaagtactcattgttgctttacgaaaagattcactagtttgataaatgcttttaccataacgtttactaagaccaaaatatttgagagtatcaatgcctcgtaatgaatctaaaaaatgattagaaagtacttgataggattcatattgtttatctgctttagcttgagccgcatagcctaaaataatcataaagatgataattaaaggaaaaacgataagtaaaattgcacctgattcaatatctaaatagaaaatataagctagaataatccatgggataatagacatgttaatcatcttattcaagactaaacgtaaataattttcaactaaagaaacgccatctaatgccattgtaacaacattaccagttccttgttcttgaacgactttaggacctagatcaaataacttatctaataattgacgtctcaaaagactagattgtgctgttgaaaagtcatcaagttttctatttttgatgtaatcaataacatgacggcctaaatatgagaccataaataacaaaatataaaccgtttgagaagaaagtttttgcccttcccacaaaccagttatagaaagactcaaataataagcttgtccgataataaagattgcttgaagaacatcaagtcccgcaagcaatcctaacaacttatgaatacctgacaagcgcataaccgctttatctagcattatttttctcctgtcacaatcactggcaaggtaatacgttttctaaagatataatatgcccatgctgtataagctagaacaaagggaactagagtaattgcgacaatcgacattacttttaaagtatatggcgttgaggatgcattttgaatcagcaaatcatatttagggctaattgatgaaatcataactcgtgggaatagaccttggaacaacagaacaaccactgaaacaagactgagaccactcgctaaaaatgctgtcatctctgctcctttaaaagttgaagcatgcgctaatacagctaatacaacaataaccaaaaccataattgtcgtaactatcggatgattgctaaagaaatctgtcttgaaatacaagagaactgcaaacaaggctaaaccaagatagagtacccaataaagcaactgagcataattacgggcacgctctctaattggcccttctgtcttcaatgcaatgtagtttaaaccatgaagataggctagcaataccattgcaactccacccaccaacgagaatatattaaagtaatcactgaattgagctgataagttaccactggcatcaagtggcataccttgaatcaaacttataaacataatcccaaagaagaatggaacaatagcggaaccaattgttaaggtccagttccaaaactgctttttctctgcaggaactttatgtctaaattcgaaggaaacaccacgaataattaatccaaagagaatcgtaaggagaatcaaatagtaaccactaaatagtgaagcataccagtatggaaaagaagcaaacattgctccaccaccggtaagaagccaaacttcattaccatcccaaactgggccaatggtttctactacttgatctttttcatgctcattatgtgttaaagtttgaacagccatcccaaccccaaagtcgaatccttcaaggaagaagaatcctgaaaataggaggccgattaggaaaaaccaaaagaattgtaaagcactcatttagtatgctccttcctcaaagggatcaattgaagtatatgcaccatgatgtccgtgttcatcttcatactctggccctttcttcaattctcttattgttaggcttatcatcatcaccgctaaaccaccaaacaacaagaaatacacagtattggaaacaaataatgatgcaactgaaacgtttggagagacagagtccttaatcttgaaaagaccatagacagtccaagggtatcgtccttgttctgtcacaatccaaccaaatgtattggctaagaatggtgcaaaggttgttaaagcaacaatccaaagcatccatttgtgtttataaagaattggttttttcttacgagttaaaaagagtcctaaaacagaaacacccataatagctgttcccatcgccgccattgtacggaaaccatagaaaagtaggttaaccattggatagtagttatctttaccatacttagcaaccaattctttattagctgtatccatacctttcacagaaccagatggtttcccgtaagataaaatactcaacatataaggaatcttaatcccaaaaacttgtttgtgttctgcttcatttgcccaagcaactacactccaagctgcaggatcacccgaatcttcataatcaccttccatagcagcaaatttcattggttgatcgtgaatcaaggctttcatttgtaaatccccaactcccataactgaaattgaaccaagaagtgctactactaaaccaatacgaaccgatttcttataaagttcaaccgttgtatctttcagctgttctgattttaagaggcggaaggctgacataccagcaaccactgtaccacccatcgtaatggcaccaaaaataacatgggtaaattcatagaagaactgtggattttttacaagtgcaagaaaatcagtcatttgcgctctaccgtttacaacttcataaccaacaggatgttgcatgaagctattagcagtaagaatccacatcgctgacattaatgagccaaaaaccactagccaaatgaatgtcacatgtaattttttactaatttttttgttatcccatgtaaacatccataaaccaaggaaagtagattccataaagaaagctaataaagcttcaatagccaatggagctccaaaaatatcacctacgaaacgtgaatagtctgaccagttcattccaaattggaactcttgaatgatacctgtcacaacaccaaccgcaaaactaaggagcatgatattaccccaaaattttgtcaattttttatactcttcattttttgtgataacatacattgtctccataatagcaaccactaggcatgtaccaattgtaaatggtacaaagaaaaagtggaaaactgtagtcatcgcaaattgaaaacgagctaaagtttcaattgtcatacaaaacctcttattttgttttaatcatttcttttatagaaatatctgcaagagctagtttcctagcttcgtaacaattggtaaataacttactttaatatcttaatgatataaatcaaaacgtcccttagctagaagttctttaagtccacccatatcaacaagtgatttgttcatgataatcttcttcataaccgacgcagggtattttttaattttagtttttccaacaacaccaagtccatgcgtatttcctactgaagcaactgtgccttgcggactatacgaaaagtcttctgtagcttcacctttgatttgatgtaaaaggtttttagcaacatgagctcccatacgagttgcaatttgagctgttgttgggaatgggcgaccagactcagtgtccataaatgcagacacatcaccgataacataaacattatcgtattttggatcacgcaaatcactgttgaccattacacgtccacgacgttgatcaaatcctgattctcccataaccggacttccactaacacctgttgtccaaatgatagtacctgcggtaatagatttgagttcttcatcctctttactagtaccataaacaacttcacccggtttgatttccttaatcatacttccaagcatcaaattaatacctaaatccttaattaagttgacaccatattgcgctaattcatcatcaaacattggtaggatgcgagttgctgcctctacacaaataatttcaatttgttcaggttttacacccgctaaagcagcatattttggtcgctcatcaaccatagctccggctaactcaatacctgtaaaaccagcaccacatactaagagtttgagaagattttcatcttttgtctcacggtacaacttcattgtattaacaatgtgattatggatgttttctgcttgcgaaatattggtcatctgcaaagcattctccatagcacccttgatgccaaaagtttcagatacaaagcctaaggcaactacgacataatcataatggagttcaccgttatttttaactgttactgttttattttcagcatcgactctaagcacctcatcttgcatgaagttaaccttattagtgttgataacatccttaattgggaatgtaattttttcttttggctgagagcctgcagctacttcatgtaattctgtagcttcgtagtgataatcattcatgtcaacaagggtaatatgaaaatcacctgattgtttttgtaaattacgaactgctttcaaaccggcataaccagcacctaaaactaggatttctttcatgataaaactcctctaaaaaatgattccaattagatacgttaagacttgggttgcagatcccagtgctagaatacgtaccgcacaaacaaatgtttctctcttaacctgtttttgccacaatagttttgtctgcttataaataaatggtattaataacaaactcaagagtactgtaacaggcgcaagtccaaaaagaaattcaaaaacaattgccaataaagctatactattagaaatagcaaacagcaagagtccacctcttatccctgtataatgtacaagggtatagcgatgatttttttcatcttcttctttgtcgcacagattattcgccaacattagattggcaatccataaggtgttcggcaaggaaatcaagaaaattttgcttaagttgaggatatcccacgaaaagttttgataagtgtttagatatacacaaattaaactaatcataaatcccattgtcaagccagaaaatacttctcctaagggcagactagataaaggtcttggaccaaaggaatataaaacaccaattccaaaacaaaaaagtcccatccataaaagaggcagaccaacttgggaaactaaaactaaaccaatcatactagaagtaatgactaaacttgccataataacttctatttggcgtagggataggttctcacgaccaataatgttagtgtcattcttataatccaaatccacagcattccgataatcattgtaattattccaaatgtcaacgaacatattgaataaaaacatagcaacgaagaataaaccgacatatacagggtgtactgaattgtagtaataagcactaaaacacaaaccaatcaaaaatggtaaaacactagctgttttggctttcatttctaccaactctagaaagattggtaatgtcattattaaagtcctctctatacataatcttcaacaatactattataatgcaatttctaccatttttaaaacaatagggcttgatttttgattaaaaatacaaaaaatttttcttaaaatgagttaatcacacttagaacactaaatactattttgaggagtcctattcatcacactatgccatgtaatattcggaaaaatagtattgcaaccctcaactatcccttatgttggcaccagcctttgaaagtcctctgattgcactgcttagttagtattttcatcagctgtatgatctctaagagccatcagcatactaaaaaaactagtattacactttgaaaagtgtaacactagctccaatttgttttaaatagcttaactatttaatcattaatctactttatatatttaagcatttaaagttgaatgttggttgaggatacctgagagagaaccttgaatataatttggcaatacttgtttttgagcacgttcatagatttctgaatctgttaactgacgttctgatttggggcttgatacttgcggtgtcactgctgcattttgttgtttgtaaagtgttgaatgctggttaaggatacctgagagagaaccttggatatatcttggcaatacttgtttttgggcacgttcataaagttctgaatccgttaactgacgttctgcttttggaggtgttgcttgcggtgctgtgaaagttgaagctgaaacaccttgtgtagaaccaagagctacgaatgctcctccagcaaacattgctgagacaagaccaagtttcaaatagttagcagttgagacgttgttgacttttttttctgtaataagtttgttcataagaattacctctttcttttgggttatttattttatgaactaagtataacaacaagaaataaagtaaggttaaactaaatataaaataattcttaagtcattcttaggaaaccataaaatcatacactaacaaaaaatttggtatctagctcaaaagtaaaagtagaataaaggcttttacttctgagctagtaatgaataaattatatttgcatctagtttggaattagccctagtgtattataatgatccctacaaatatgtgccaaacaccttcttcatatatacaagattgatttaacattcctatacccttaatggtgggcacattctcttcatgttccatatagaaatcaacagataattccgtattgtccctattattaaattttccagttaatgataaattatatcatccaccttgaggtgtcctattaccaatctgttcaacctttacacttgacgaatcgaattgaacagattctgtcttatcattctgtgatttagaacatcaacaatttcttgttcatgttctttgaggtaagctagttgttcttctttaacgtgcttttatctttcgtacttactgatacttgagagcatttttttgaccctacttcttactaatcagctgacgtccctataagatgaatcataaacacatagctgccactaaccattttaaccttttatgcatacataattcttcttgatatcccataccattatctttagtataaacacttaataaaacaagcatttaacaactaaggttaataaaattcaataaatctaatccttctacttactttagtttatcacttttttctctcatcctatgctataatagtaaggtatcaaaatttaggagaatatagtcttatgatgaatatgcaaaatatgatgcgtcaagcacaaaagcttcaaaaacaaatggaacaaaagcaagctgatttagcagctagccagtttactggaaaatctgctcaagagctcgttaccgtgacatttacaggcgataaaaagctaatttcaattgattacaaagaagctgtggtagaccctgaagatattgaaacactacaagacatgacaactcaagctatcaatgacgctttaagccaagttgacgatgctacaaaaaaaattatgggagcatttgcgggtaaaatgccattctaaaaaataaatcacatttactgaatcacctgtaaatgtgatttttatttcaaacttctttcattttttcacgaaaacaagttttattttcaaaaaatatttgcaaaaaatcagcagagaggtataataacattgaaaatattagagagaaggtgactaaccatggttatggatagtctaatcataaaacagttgattaagagtacatttgatatacccttacaagtcacttatccaaatgggaatattgaaacttataatggtagcaatccccacgtcaaacttaaactaaacaaaaatttctccgtctcggagctatcaaaagacccttccatagtattgggtgaagctgttatggatggagacattgaaatttatggttctatacaagaattaattttatcagcttaccgctgtggagacagctttctacgtaatagtaaatttagcaaattgattcctaaacaatttcatgataaaaaacacagtaaatccgacattcaaaagcattatgacatcggaaatgatttctataaactgtggcttgatgataccatgacttattcatgcgcctattttaaacatgaaaatgatagtctagagcaagctcaactaaacaaagtacaccatattcttaataaattaaatgctcagccgggagggaaattactagacatcggttgtggctgggggacacttatcattactgctgctaaagaatatggcttaaatgcgacaggtatcaccttaagtgaagagcaggcttctttcattactaagcgtatcaaggaagaagggttggaaaataaagtaacagtcctcattaaagattatcgtgacattcgtgaaacatacgattatatcactagtgttggtatgtttgaacatgtaggaaaagaaaatttatctcaatacttccaaaccatttctaaaagactcaacatcaatggtctagctcttattcatggtattactggacaagtgggtggtaatcatggtagtggaactaattcttggattaataagtatatcttcccaggaggatatatccctcgtttaactgaaaatttaaatcatatagctagtgctggacttcaaattgctgacttagaaccgcttcgtcgtcactatcaaaagactctcgaattatggacaaaaaatttccacaatgcccttcctgaagttcagaaaactcatgataagcgttttatcaatatgtgggacctctatcttcaatcttgtgcggcctcttttgaatctggcaatattgatatttttcaatacttgctttcaaaaggtgtttcaaaagacactatgcctatgacacgcgattatatgtattctgctaattgatatagttaatattatagtattccaacttattctaaataaaaaggactctcttgaattcaagggagttctttaacgttcttctctggctaactctatacaatgtgacttttggtgacaatgtggacagaatacttttcgcgtcttaggggtatgtttcgctagattaaatgcttgatatgtcggtgtaaaggtttgatgacaatttggacaaagataaacaacctgttgtttaaaataccaaaccataccattcatagctattaagaatactgttactgctatccacataagccatctttgatttagagaaactgctgctattattaacgtaatatagaccataataatcataacgacttgtagcactatgcttttttgtagtataccccattttcttttgttttcttccataagcacaatgtcagaaagatagcctaatgttttactatcttgtttttctacagtttttagtaggttgacagctttgtcaagtttgtcttttttactatcaatagctagccttaattctcttatctgcacttgtaaaaaaagctctaaaatctggctagcattgtcttcagtaaatagatttttgatattatcaattgaaaaatctaaatctcgtaaataaataatttgtctaagcttttctaaatcagcaatactataaaccctcctacctccttcagatagttctgatggggataaaattcctcttttgtcatagtactgaacagtacgaacagtaactcctgcttctttagctaagtcaccagtggaatatttttctgacatgtttcacacctcctttaatatagtaaacacttctttatcagaaacacctttactatatcaaatgacctaaggtaataagcaagtaataacgctaagtatttttaactttaaataaaactacaacaattaatcaaacaaatttcctaaagtcgcaaatgggctatcaactgctacctctttttgctgttttaaatagattttattttcatccaagtccagaaatttttcataaacacgcgcagtcatacgggcatcctctaagctattatgtgctttaccctttattcctaaaaagtcagcaacagtagtcaatttaaggttgacaataccatttaaatctgtactgcgtctcacaaaagcttcatcatataagtccacctgatattgactagttagatccaaaccattttcaactaaaaggggtaaatccgatttatacccattataaccaatcagtggtgtatctccaacaaaactctgaaagtctgtcaaaactatctcaattttaggagcccctataatatctctagctgtaatacctgttaaaccattaataaagctttgtaatggaacttttgtgtgaacataagtatcaaataaagcaatctcttgatgattagaatatttaacggccgacacttgaataatatggctatgctcaccaaccgtgttaaactctaaatcaaaagctatatattcttgtaattgtttcattatttctcctaaaaagcgcaaggaaactccttacgcttttattctattttttattgaagaaacgtccaaagaaactttttttaacagcttctaattcttgaattttttcttctttggcttcttgaatctcctcaacctctgctttagcttcatttaactcaagttgcagacgttgcgtatcttccatagcagttaaagtcaattgctgttgttgatctaattgcttatctttctctgctatttgaatatcttttacatgtaactgctcgtcttttgaagcaatctgaatatcttttgcttttaactgttcatataaacgtgtgatttcagtattcttctcatcaacgagaatttctaaaagttctcgtcttgatgcttcttcgtcaattggttcctcttccaaaatagtttttttatagatttcttccaatttaatcaagccatcacgattaacaactgtaacgcctttactattcttttccacacattcttcagggagtgttttaactctgttattcatcgcttgacgactaacccctaaaatttcagctaattcactaaccgtcttttcaactgtcataacttcctcttttgtactgattttcttataaaagaatatcacaatcctaatctagtgtcaatttactgtcaacttaaagtgtcaaacaagacattttgacgtctatttctctatttatatgctagaataagattatgaagcattatgacacaataattataggtggtggacctgctggaatgatggcagctatttcctcaaatttttacggcaacaaaacacttcttattgagaaaaataaacgtttaggcaaaaaactagctggaacaggtggtggccgctgtaatgttaccaataatggaaaccttgatgagctcttagctggtatacctggaaatggccgtttcctatatagcgtcttctcacaatttgataaccatgatattattaacttctttcaagacaacggcgtcacactaaaagaagaagatcatgggcgtatgttccctactactgataaatctcgtactatcattaacgcccttgaaaataaaataaaagaacttggtggtcaaattatgactgacacagaagttgtctctgtcaaaaagataggagattcattctatatcaaaactaaagatacacagttcgcatccgataaacttatcgtaacaactggtggtaaatcctatccgtctacaggttctactggtttcggtcatgacattgctcgtcactttaaattagaagtcacagatatggaagccgccgaaagccctcttttaactgattttccccataaaaaactacaaggtatctccttagatgatgtcactttgtcatttgaaaagcatattattacacacgatcttctctttactcattttggattatcaggaccagcagccttgcgaatttctagctttgtcaaaggcggagaaactatatacctagatgttttgcccaatatctctgttaaagaattggaaatacacttccaaaatgaaagagaaaaatctttgaaaaacgctcttaaaatacttcttcctgagcgtttagctgaattttacgctgaagacttacccgaaaaagtaaaacaagtatctgtaaaagacttagaaatgttaattcaaaaacttaaaaaacttcctattttagtaactggcaagatgtctctagcaaaatcctttgtaacaaaagggggagttgatcttaaagaaataaaccccaaaacacttgaaagtaaaaaggtagctggtttacattttgctggtgaagtcctagacatcaatgctcatacgggagggtttaacattacttctgccttatgtacaggctgggtagctggtagcttacactattaatacatgaaagctgaacaattccgtcagcttttttatatagaatttaaagataatatttggctcttaaggcttctttgattttttccaattcatctggtaaatttacctgatgaatagcatacccaatctgataaggggatactataaaacgaggaacaattttacaaataagacccccatcatgcttatagaaaaagagattataagatttacagcgccctcccaagaattcatttaaaatataatgacacaaaattggtaaactatctgcaatcaaaatagcgttttccaatttggatactttaattgtgaactctgtgaaatcaagcataggacgattggcaatactaatctctgcttgttgactcgtttccgaacaaacctcgataccatcaaaccaatctaagttcaacgtttcataagcatctacgttttttaagccaacaatttggctatgaggatgtcgtaaacttccgccagataagggcccaaaatttcgataaagaacgaccgaacggtaatgaccactttcttccattaattgccattttgacaaaagataatctaacaattggcgcatctttgactcactataaactgaaatatccccattgtgatcatttgattcaatcaccaatgtttgataggtttcttctaaagttgggtatttattttctacccagatcatatcgtctttcacgtctaggatttttcctaattggcttttatcacaaaatggacatttgtctttattgctgggtttttgtttcgcgatattagggttaaatcggatatatctttcattcatactgttattgtaacacattcatcaccattacaatataatacttatccagttaacattttccttgcattcttagctgaaaagagtataatagaatcatgtcttgtttactggttaattaccagtaaactaggtaccctgttttgggatagaaaaatctttttgggaaaggagaaatcatggctaagaaatcaaaaattgctaaatttcaaaaacagcaaaaactcgtagaacaatatgctgaactacgtcgtgagttaaaagaaaagggtgattacgaagcacttcgtaaacttcctaaagattctaaccctaaccgacttaaaaatcgtgatttaatcgatggccgtcctcacgcttacatgcgtaaattcggtatgagtcgtattaacttccgtaacctagcttacaaaggccaaattcctggcattaaaaaagcaagctggtaattcgtgaagacaaatagttactttttatgactattctattgagtgtggacgaatagttaatacattgtaattatttaacctgttgagtatttactcagctattacaaacttcttcaaaattttattatcataggaatgtaggatctcatcaatccttaaatgactaataataaaagatgaaaaaatttttcttatctcaaatcatagatgccaatttatttattttcaaaaagcccggtatgccaagataccgagctttttattattataaatactgataaaattcttttagttaatcccaaaaacaagactattattttgtaatagtcactactgaataatatttcttttattaaaaactcacaagacatttcttaaagcagttacatcttcgcgactagttgaccaactagttgctagacgtattacagtatgatggtcatcatatttttcccaaaaactataagctacattctttgctaaatctgctagttttgtattttctacaataataaattgttgattagttggtgattttaaatagaatgagtaacctttttcttctaaaatgatttttaattcctctgctaagtcgatcgcatgctttccaatttttaagtaaaggttatccgtaaagaaacgatcaaaagcaagccccagcaatcttcccttggctaataacgcaccatgctgctttacaattgtagtaaactgttttggacgatttttctttgtgaaaacaactgcttccccagcaagagcccccattttggttccaccaatataaaaaacatctgataaggctgcaatcgttgggaaatcaacatctgtatctttcgcagccaaaccataccccagacgagcaccgtcaataaataaggggatttgataatgtttacaaatcttcgataactcttctagttctgctttactataaagtgttccatattctgttggatgtgatatataaaccattcctggaaaaaccatgtgttggtaattaccatcagcataaaaagtctcaatataagttgcgacttcgcttgcgagtaatttcccattatgagaaggtaaagtcaataccttatgccctgaaaattctatggctcctgcttcatgactactcacatgacctgtttctgcagcaataactccttcataagaagcaagcatactactgataactacttgatttgtttgagtaccacccactaaaaactcaacttcagcttgtggacaggaacagacttctcgaattttatctgccgcttgttgacagtaactatctgtcccatatcccgatagaccttgatcattagtttcaataagggcatttaaaagctctggatgagctcctttattataatcattttcaaaatgtaacattccttaactcctttattagttaaaaaaatagcgacaatatcatttgctaatatttttgaatattcaatcattataacaaataaaaaatatcaaaacaagcgttttgatattatgaacacctataaactctcaaaagctaaactaggtttggcattcaattttaaagaagcaaaattctctttttcaaactctatcgctgctgctaatgcaatcattcctgcattatccccacataatctaagaggaggaataaccacatcaatatcaggagaaatatcagtagccaagcgttcccgaagtccttgattagctgcaactccaccagcaacgactaaagttttcactggatactttagcaaagctttttgagttttggccaataaaatatccaaaacagccgcctgaaaggaagcacataaatcttcaagaaccaatgcttcacccttttgttctgcattatgatgtaaattgataaatgcagattttaatccagaaaaagaaaattcaagatgatcttctttgatcatcgctctaggaaaatggtaagtatcttgacccttatgagctaactgatcaatctcgcgacctgctggataagttaagcccataacacggcctactttatcataagcttctccaacagcatcatcccgagtttctcctactattttgtaatctcccggttcagaaacatatactaattctgtatgtcccccactgacaagcaaagctaacaatgggtattgaagttccttaacgtcacgtgctgccattaaatgacctgccatgtggtttataggaattagaggtaatttatttgcccaagcgaaagcttttgctgcagccatacctaccaataaggctcctactaatcccggaccatatgttacagcaacagcatccaaatcgctagcaacaatacctgcttcttgaagagcatcctcaaaacaggttgttactacttcaacgtgatgacggcttgccacttcaggaacaacaccaccaaaacgtttgtgactttcaacttgacttgcaataatattagctagtaactctttatcattttttaaaatagcaacactagtttcatcacatgaactttccactgctaaaatatatctatctttcataatgatattaatccatcaatatcgtcttttccattagtattgaggactattcatatcctttctatcatcaactatttatcccttgcgcatcactatagcatcttcaattggatcatggtaataatttttgcgctttcttaaaactacaaaaccacacctctcataaagtttttgtgctacgatatttgaataacgaacctcaagaaaaactggcacctctatatcagcgatcattgacattaactggtaagcataacctttaccttgataattttttttaacagcaatattagtaatttctacttcacctaccaattgttgaagagccaaaaaaccaatgacttcaccgtcattataaacaaaaaaataatctgttgaatctttttttaaatcttctgaaatctgcgataaactccacggagatttgtcatagacatcagatagtacgctccatatagccagtgcttgttctgatgattccatctcaaactctcttaatatattcttctgtattcgtttcacagtggttttttaaccaattttcctcagcttcaacacgttttaagtatcgtggaacaaacgcatctacattaacgcttttcattttttgtcctttgcgcccaattgctactgcacaaggtaaagtttctgtaattttagcatgtggtaaggctttcttaatctgatcaaaaaatgctgcaacctctccgacaaaatgaacattggctttattccccacctcttgtaagacttcttcaagagaagtgtgacagtctggtttaacagtatcaccattttgatagaaaccaacataaacattattacgtcgtgcatctataagtggtaccaataaatcattttctgaaaatccatttgttaaagcgtacaggctagatactccaactaagtcaatcttaagcgtataagctagcatttttgctgtagcaacagctacacgtaagcccgtataagatcctggaccctctgctactacgatacggtccaaatcttgaggttctaaatcaattgattgcattaaaaaatcaatggctggcatcaaattaatgctatgattctttttgatattgatagtgacagtcgctaaacattccatattgtttagtacagccactgatagtgctttgcttgaagtatcaaaggctaaaactttcatcatttaacttcccttacttgattctacctcttattttatgatataatcatgataattgcaacgaatcaaggttaattctattactctataaaaacttaataatggtttgtcattgtctcacttaacggcattgacccatttttttatagttagaaaaaccgagagataagaaaggattattatgatttataaagttttctatcaagaaacaaaagaacgcaacccacgtcgtgagcaaaccaaaacactttacgttactattgatgcagctaatgaattagaaggtcgcattgctgcacgtaaactagttgaagaaaatacagcttacaatatcgaattcatcgagttactttcagacaaacaccttgaatatgaaaaagaaactggtgttttcgagctcactgagttctagaaaggagttaaacataatagctagagtaatctacccattatgataaacttattatgtcaaatatcaacttaaaacccgaagaagttggggtttatgcgattggtggtctcggtgaaatcggaaaaaatacttacggtatcgaatatcaagacgaaattattattgtagacgctggtattaaattccctgaagatgatcttttgggaatagattatgttatcccagactattcatatatcgttgaaaacattgaccgtatcaaggcccttgttataactcatgggcacgaggaccacatcggtggtattccttttctattaaaacaagctaatttaccgatttatgcaggtcctctcgctcttgctctaatcaaaggtaagttagaagaacatggtttacttcgtgacgctacattatacgaaatccacgctaatacagagctgacttttaaaaacttaagcgttacatttttccgcactactcactccattcctgaaccattaggtattgttattcatacccctcaaggtaaggttatttgtacaggtgacttcaaatttgactttacacctgttggggagcccgctgacttacatcgtatggctgctctaggtgaagatggtgtcctctgccttttatcagactcgacaaatgctgaagttccaaccttcactaattccgaaaaaattgttgggcaatctattatgaagattatcgaaggtatcgagggacgtattattttcgcctcttttgcttcaaacatcttccgactccaacaggctgctgaagctgctgttaaaactggtcgtaaaattgctgtttttggacggtcaatggaaaaggcaattgttaacggtattgaacttggctatattaaagttccaaaaggtaccttcattgagccaagcgaacttaaaaatcttcatgctagtgaagttttaattatgtgtacaggtagtcaaggtgagtctatggcagcacttgctcgtatcgctaatggtactcatcgtcaagttactttgcagcctggtgatactgtgattttctcatcaagcccaatccctggtaatacaacaagtgtcaataaattaatcaataccattcaagaagctggtgtcgatgttattcatggtaaaattaacaatatccatacctccggccatggtggtcaacaagaacaaaaattaatgttacgcttgattaaaccaaagtatttcatgcccgtacacggtgagtatcgcatgcaaaaagtccatgctggtttagcagttgacacaggtattcctaaagagaatatcttcattatggaaaacggtgatgttttagctttaacgagcgactctgctcgtattgctggacatttcaatgctcaagatatctacgttgatgggaatggtattggcgatattggtgcggcagttctacgtgaccgccacgacttatctgaagatggtgttgtccttgccgttgctaccgttgatttcgattcaaaaatgattttagctggaccagacatccttagccgaggctttatctatatgagagaatctggggaccttattcgcgaaagccaacatatcttattcaatgctattcgtattgcactgaaaaataaagatgcaagtatccaatcagtaaatggagctattgttaatgccttacgcccattcttatatgaaaaaactgagcgtgagcctatcattattcctatggtccttacccctgataaataaacaaaagaacggaaaatactttctccgttctttttaattgcctatattagcaaaataagttaatatatcaaattacttctgggataactatagaatataaaagaactccaaacagtatcgtacttttataccgtctatgtgaggagttctttatagattaattcggataaatgtagctaactacccctggtgttactgtattttgtggatcaaaccaaccacgataattatcaatccattgatgacctgcataattagattctaaaacctgaattttattagtgacaggatctacagctgtaacataagccacatgtccataactaccatcagtccaacatacgatagaacccacgcgcggttgtgtccctactgtataatcagctgatgcggcgctcgcagcccaatcaccaccgtttccccaccagttacctgcccatgttgccatctcctttacaccccatgtgcattgacctagtggaaacgtattactagctggatgtgcttgagcaatttcctccgcacttgctaggtagtctacatctactgcatagttatatgtattcgcatctgcatttgttgaagcaaatgaaaaagcggacaccaaagccactgttccaagcattgttttagactttaattgttttatgttcatgttttcctccatctgatgactcctagtttatcaaatccatataacagacaaatgaaaacctgtaacaagttttaggcaattttttacaataatttacaaaaaaactagttttagactttacaaaataaagcctaaaactagttataaacattcttatgattaatataaatctaggtaattatcaatttcccattgtgaaacataagtcgcataacttgcccattcaatacgcttagcgtctaagaaattagtatagatatgagttcctagggccgcttttaccacttcatcttcttcaagtgcttcaagagcattatgaagagtagatggtaaatcaacaatacctgcttgacgacgttcttctacagtcatagcatagatatttgtctcaattggttctggtgcttcaattttattctcgattccctcaagtcctgatcccaaaagtactgataaagcaagataaggatttgctgttgggtcaaccgagcgcaattctaggcgtgttcccatacctcgagatgcaggtacacgaataagtggcgaacgattgcgacctgcccaagcaacgtaaactggtgcttcgtatcctggtaccaaacgtttataagaattaacagttggattaatgatagctgtgtaattgtaagcgtgtttcattaacccacctaaaaagtagtaggcatcctctgataattgcattccacgtggatcttctggatcaaagaaagcattgttcccttcattatcaaaaagagacatattacaatgcatacctgaaccattgataccaaacttaggttttgccataaaagtagcatataaaccatgcttacgagcaattgttttaacaaccaatttaaataattgaatgttgtcacaggcttttaaaacatcatcatatttaaagtcaatttcatgctgtccaactgctacttcatgatgactagcttcaacttcaaagcccatttgtgttaagacattaacaatttcacgacgtgtattatctgctaagtctgttggagctaagtcaaagtagcctcctttgtcattaacatcaagtgttgggttaccattttcatccattttaaataggaaaaattcaggttctggtcctaagttaaatgacttatagcccatctcttgcatacgtttcatattacgcttaagatttccacgtggatctccggcaaaaggttctccttctgctgtatagatatcacagattagacctgcaacagctccattttcatctccccaaggaaagacaatccaagtatctaaatcaggatataaatacatatcagattcattgatacgaacaaagccctcaatagaagatccatcaaacattgctttatttgataaaactttgtctaattgttcatctgtagccggaatttcgacatttttcattactcctaagatatctgtgaacatcaaacggaggaaggtaacatttttttccttaacttcgcgacgaatatcttctgctgtgatagtcatatagtctccttaatatctagcttgactgcatgtttacaaatgcatatttccaatgtgctgtgaaggacttgaaaaacgcccttgattacggagctcatcttgtaaaagtcgacgaacctcggcatctgataatgacttttgtttctctttggacttatgttgtctttgcatgtattcatttttaatatcagaaatatgcaaaccatcgctaatgaagtcttttatttccagtaagcggtccatatcattcagtgaaaacatgcggcggttaccttcagtacgttcaggtgtgattaacccttgatcctcataatagcgaatttgtctggcagtcaaatctgtcaacttcataacagctccaatcgggaatacagccattgtacgcctaagttctctttctttcatgatggcctcctttcattaaaccattataaactttaaaaagtttgatgtcaactctcatgtgagattttatgacatcaaactataatttgttattttttagttttttccgaagtatttcaatatctgtattaaccatcattgcaataaaaacaccacaaaaagtttcaaaaatacgtgcaaaaacatatagaattgtctctccgcttgggatagataaagttataataagtaatgcggctgttcccccaataatacctgatttattattacaagcaacattaatcatgatacataacatggtacaaataggaacaattaataaagtgacccaaaaagcttgatgaaatatctcattgaatgcaaaaaatactaaggagagtaagccacctatactattaccaataattctagaaaaaccaaagtgcacgcttttatcaaagtcttctcttaaactaaatacagcagttagagcaccaatttgaagccctttccaaccaaataaatgaaaaaccaataaaactaaaaagaccgataagcctgttttaaatgttctcattcccaatttaaactttttaatatcaaacttgtaattagataataatttttttaacgttttcatacctatcccttcactatatattctaacatatcaatccataaaaccctttttgtaaacgttttatttattactagtatatcttttataaaccaatttatatcaaatcgtcataaacttttgaaaattgcagtgtcaaccaaataccactatatctaaaaactagtaaatgataaatgaagtcaaggaaagttcaataactctacattatcaactaaaaaaagacatgcatcagcatgtcctttaatataaattataatgactattatttttcagtcaatgctgccaaacctggtaatactttaccttcgagcaattccatgcttgctccaccaccagtagagatccatgagaatttgtcagcacggccaaggttgatagcagctgctgctgaatcaccaccaccgatgattgatttaacgcctggttgtttaacgatagcgtccattacaccgattgtaccagcttggaagtcagggttttcaaagacacccataggtccgttccatacaactgttttagcaccagtaagtgcttcatcaaatttagcgattgatttaggaccgatgtcaagaccaaggaacccttctgaaactgcttcaccttcagtgtcgcgaacttcagtataaccagcaaatgcgtttgcttcttttgagtcaactggcaagatcaatttaccgtttgatttttcaaggaggtctttagcaacatccaatttgtcttcttctacaagtgagttaccgatttcgataccttgagctttgtagaatgtgtaagtcataccaccaccgataagaactttatcagctttttcaagaaggttttcgataacaccaatcttatcagaaacttttgagccaccaagaatagctacgaatgggcgttctggagtttcaactgcttcttggatgtaagcaatttcgttttcaagaaggaaaccagctacagctttttcaacgtttgctgaaatacctacgtttgatgcatgagcacggtgtgctgtaccaaatgcatcgttaacgaagattccatctccaagtgaagcccagtatttaccaagttcttcgtcattcttagattctttcttaccgtcaacatcttcaaaacgagtgttttcaaccaaaagaacttgtccatcttccaaagcattgattgcttcttctaattttgcaccacgagtaacacctgggaatacaacatcttgaccaagtttagcagctaaatcagcagctaccggtgcaagtgattttccttctttgtcagcttcttctttaacacgtccaaggtgagagaagaggatagcacgaccaccttgttcgatgatatacttgattgttggaagagccgcagtgatacggttgtcgttagtgataacgccgtctttcaaaggcacattaaagtcaacacgaacgaggacttttttacctttcaaatcaacgtctttaacagtcaatttagccattagtaaaactccttatataatttgatattatttattataacatatttttgtgaacagttgtaattattgattactttttcacaaatagatttcatagattttcctagttgttttcaagagaattcgtatacttattaatcatacgaatgcaacattttttgtcgttctttcaattgtttttgaacatccagatgttttccttgataaatagcactttcccaagaaccgtacataggatttgggaaaacaataaatttactaccaaactcactttgaagtttagttagtagttgttctctatctgtactagatgatttagaaaaatcagcaaaatcaactaaattatctccaaaaagcataattaaattggtatctttttgaactgcctgacggcgactctctttagatttcattccttttttaaggaaaagcaagtggtctttcccttgaacaggtataccttccttctctaaattttctttagtcgcatcaacttgagcatctgtacgatctgagacataataaatttttattcccttttcattagcatacttcaaaaattctttggcacccgcaacagccttagctgatttcttttgcacccatttatcccaactctctggcgtgaaactagagccatctttaatattctttgcttgatatgggctattatctaaaactgtttcatctaaatctaagataattgaatatggtttttcactgggcttttgtaaccaatcatctaacttcattttagcaacattataaccttgtaaatataaagccttggcttctgcagaattttgataccaaaggacagacatagtgttttccttagccaacagtttattagaacttagagaaatatttttaaatttcgtcttttgctccaccttatctggagacatatcagcttttttagtactgtggtttgactgacatgctgtcatcataaatacagcaacagataacgataaaactgaaaaaacttttgtagtcttcataaaacttctcctctatattttttcaattaaatcataccactgcttactttcaaaatcaaaccttattttaacttatagtcaatataattcatttttcatttattttctgataattttctataataaaatgaaaaaacattcgtattattttttatttataaaaataaaagagggataaatccctcttttacatcatattaattaaaaattattttgcaatttttgcaaagtattcaagtgtacgaacaagttgtgaagtgtatgacatttcgttatcgtaccatgaaacaactttaaccaattggttaccgtcaacagtttgaactttagtttgagtagcatcaaacaatgaaccgtatgaaataccaacgatatcagatgatacgattggatcttcagtataaccgtatgaatcgttagctgctgctttcatagctgcatttacttcttcgacagttacgtctttttcaagagttgcaaccaattcagttactgatccagttggaacaggaacacgttgtgcagcaccatcaagtttaccgttcaattctgggataacaagtccgatagcttttgcagcaccagttgagttaggaacgatgtttgcagcacctgcacgagcacgacgaaggtcaccaccacggtgtggtccgtcaaggatcatttggtcaccagtgtatgcgtggatagtagtcatcaaaccttgtttaacaccaaagttgtcttgtaaagctttagccattggagcaagacagtttgtagtacatgaagcacctgagataactgtttcagttccatcaaggatatcgtggttagtgttgaaaacaactgttttaacgtcgtttccaccaggagctgtgataacaacttttttagcaccattttcatggatgtgttgttcagctttttcttttgatgcaaagaaaccagttgcttcaagaacgatttctacgccatcagtagcccagtcaatgtttgctggttcgcgttcagcagaaactttaacaaattgaccgttaacttcgaatccaccttctttaacttcaacagtaccgtcgaaacgaccttgagttgtgtcatatttcaacaagtgtgcaagcatgtttggatctgtaaggtcgttgatacgagtaacttcaacaccttctacgttttggatgcgacggaatgcaagacgaccgatacgaccgaaaccgttaataccaactttaactaccattagtgatttcctccttatgaaaatctcaaatattttattttagggatccccctaaccaatgtgaaaagattaacttgtacatatgtgcaaaaatctttcaacacaattattatatcttttttcgagaaaaattgcaatgaatttaccactttcaaaaagaaaaaaagatactctttcgagtacctttcataagttttcagaaattattcaccagagtttttcttgatgatttcttcttgaactgacttaggaacatcttcgtagtggtcaaataccatcatgaatgtgccacgtccttgtgttgcagaacgaagaactgttgcataaccaaacatttcagcaagtggaacaaaggcacgaacaacttgtgtattaccacgtgcttccataccatcaacacgaccgcgacgtgcagtcacgtgacccataacgtcaccaagattgtcttctggagctgtaattgtaacaagcatcattggctcaaggatagctggttgcgctgatttagcagcttctttaagtgcaagtgatgcagcaatcttgaaggctgtctcagatgagtcaacatcatggtatgaaccatcgtaaagtttagcttttacgtcaaccattggatatccagcaagaacaccgtttgccatagattctacaagtcctttttcaacggctggaataaattcacgaggaaccacaccaccgacgatagcattttcgaattcgaatcctttaccttcttcgtttggtgtaaattcaatccaaacatcaccaaattgacctttaccaccagattggcgtttgaagaatccacgtgcttgtgtagaagcgcggaatgtttcgcggtatgatacttgaggtgcaccaacgtttgcttcaactttgaattcacgtttcatacggtcaacaaggacatcaaggtgaagttcacccattcctgagataactgtttcaccagtttcaacgttagtttcaacgcggaacgttggatcttcttcagcaagtttttgaagggcgatacccattttatcttggtcagctttagattttggctcaaccatcaattggataactggttctggaacttcaattgattcaagaataacttttgatttttcatcagtcaatgaatcacctgtagttgtatctttcaaaccaacagccgctgcgatatccccagcataaacagtttcaatttcttgacgactatttgcgtgcatttgtaagatacgtccgatacgttcacgtttacctttagatgtattcaacacgtatgaacctgaattaagaacacctgagtacacacggaagaatgttaagcgacccacgaaaggatctgtcatgatcttgaaggcaagcgctgcaaatggctcttcatctgaagcaggacgtgtttcttcttcgtcagtatcagggttaatacctttgattgcaggaatatcaagtgggcttggaaggtaatcaataacagcatcaagcatcaattgaacacctttattcttgaaggctgaaccacacaatacagggtagaattcaacattgatagttgctttacgaatagcagccatcaactcttcgttagtgatttcttcaccttcaaggtatttcatcatcaaatcttcatcagtatcagcaactgcttctactaatttttcacgatattcatttgcttgatcaacatactctgctggaatatcttcttcaaggatatctgtaccaaggtcattagtatagatttcagctttcattttgattaagtcaataataccacggaaatcgtcttctgaaccaattggcaattgaattgggtgtgcattcgcttgaagacggtcatgaagtgattgtactgaatagaggaagtcagcaccgattttatccattttattagcaaaaacgatacgtggaactccgtattctgttgcttgacgccaaactgtttcagtttgaggttctacacctgattgagcatcaagaactgttaccgcaccatcaagtacgcgaagtgaacgttgaacttcaattgtgaagtccacgtgtcctggtgtatcgatgatgttaacacggtgaccatcccattgtgctgttgttgcagctgatgtaattgtgataccacgttcttgttcttgttccatccagtccatttgtgaagcaccttcgtgtgtttcaccgattttgtggattttaccagtatagtaaagaatacgctcagttgttgttgttttaccagcatcgacgtgagccatgataccgatattacgagttttttcaagtgaaaattcgcgagccatttggtttctcctatattttaaattatttacttctttattataacactatttataaaaaacggataggcaggacctacccgttctaattgctaacattgctatctaccaaacaatttgtttagtagctatgataagtctcaaaaagagagtaatcttaccaacggaagtgtgcaaaggcacggttagcttcagccattttgtgagtatcttcacgtttcttaactgatgctcctgtgttgtttgcagcatccatgatttcttttgcaagacgatctttcatagtgtgttcaccacgagcacgtgatgcgttaaccaaccaacgaagtcctaaagttgtacgacgttctggacgaacttcgacaggaacttggtagtttgatccaccaacacggcgtgcacgtacctcaaggacaggcatgatgttttccatagctgtttcgaacacttcaagagcatctgttccagtagcttctttaattgcttcaaaagcatcatatacgatagttgcagcagtaccacgtttaccatcaagcattacacggttgataagacgtgtaacgatttttgagttatacaatggatctggcaatacttcgcgtttaggcgcttgatttttacgactcattttctcttatcccccttctaattaccctttaggacgtttagcaccgtatttagaacggccttgtttacgatcagctacacctgcagtatcaagtgcaccacgaacgatatggtaacgtacccctggaaggtcttttacacgtccaccacggataagcacaacactgtgttcttgcaagttgtgtccgatacctggaatgtaagcagtaacttcaataaggttgctcaaacgtacacgagcaaatttacgaagggcagagttaggttttttaggtgtcatagttccaacacgagttgcaacaccacgtttttgtggtgcagataatttagtgtgaacttttctgtgactgttgtaaccaatattcaaagcaggtgaatctgatttttcaactttagatttacgtggtttacgtaccaactggttaattgtaggcatctacatttctcctgtaagttttttatttttggttgatatagcacttggtgacagcctatatctgcgtgtacttttgcaacaattgtcagcacgtctctgtacacttttgagagaccaaaagtaaaagtaccgtttatcatagtatcattttacacataatgtgtcaagcttttattacttttacaagcaaaaagaatcaaggatgtcaccttgactctttaatcaaatatattccccgcttctacagagactctattattttttacatcaatttcagatactctcagaagagatttataggccatcttctcacgttgttcctgagcattttctgcaaatacagcgacacctactaatgtgctatcgaattctgagagtaaactaatcatccccgaaacagtacctccacctttcaagaaatcatcaactattaaaactcgactgttaggttttaagctacgcttagaaagaaacattttttcaatacggccacttgaaccactagcgtagtttactgacacagtagaaccttccgtaatcttcaaatcacgtctcacaataacaaaaggaacatctaaaacatttgctactgcgtttgctaaaggaacaccttttgttgcaaccgtcatgacagcatcaattttttgacctctgtaagcgttcgctataatgcgaccaatactttgtaacatttttggtgtactgagtagatctgaaagataaatgtaacctcccggaagaatacgatcgttttcagataaacgctgtcttaattcttcaacgatttctttcgcttctgcttcagcaatagttggtgtaaagataacacctccacttgcaccagtcacagttttaatatctccgatttgagcttgttcaaaagcttttttgataatagcaatatcttctgaaatcgaagatttcgcggcaccgtatttactagcaaatgtatttaaactagttaatgtatagggattatttattaggtaatttgaaataacaaccatgcgttcgctacgtcttaatttcatattttctccttattcatagcattctttacatatagtataacataacaaatgctaaaaacgaacattttattttaggtcttaattattctacctaaattatttaatgttcggtttataaaaagaacggttatccatggcaaaaatgcgatttgtcatttcaccttcgttgacacggtttaaagctgttgtcatcatcatcatatttgcatcaatgttatcgatcatatggataatttctgcctccatgattctaggacgaaccgggcttccatattctaattgtccatgatgactcagaataacatggcgtaacactgtaacctcttcttttgtatcatcaatattaagctctgctagtatttttgttaattcctcatcaataagtgaaatatgaccgataagattacctcgaatagtatattctgtattatcaggacccgataactcaatgaccttggctaaatcatgtagcataataccagcaaacatcaaacttttattaagttctggatagatatctccgatactatctgccaaacgaaccattgttgccgtgtgatatgccaatcctgattcaaaagcgtggtggtttgttttggcggctggataggtaaaaaattccttattgtatttacgataaagtgctcttaccacacgctgccaggttgcattttcaattttaaagagcatttgttccatgtactctctcacgttgtcaacattgattggaggtttttctttaaaatctctaggatcattaggttcaccatctttgatgtttcttaatgtaatttggttgacttggggagttccattataaacttcacgacgccctttcatatgaacaattttaccggctacaaactcttctacattataggtctgtgcatcccacatatttcctgaaatttcgccagtatcatcttgaaaggtaaaggcaataaagtctttacctgcacgcgttttacgaacttctgctttctttataaggtaaaacccctcaaaaagctcgtcttttttcatttggttaattttcattaatttcctcttcttctgttataggaaggtttaacaagctagtggttgcttgatcttgatgttcttcaactgtatttaagactctgataatagcgtttgtccgcgttgtgagtaaactatcaatacttttacttgctgtatttaattgtttttgagcttttgataacatgccaccaaattttccaaattcaaccttgacattccctaaaattttactaatatcattagcattcttttgaatatttaaggttttaaagccaacagataatgaatttagtaaagcagataaggttgacggtccagctactacaatattttcgtcacgtcttagactatcaaagaatgttgcatttcttaccacttcagaatagagcccttcagttggtaagaacatgataccaaaatttgtcgtttcaggaggatttaagtacttattgtttatatcttttgcaaatttacgaatacttgccagtaaagatttacgatagagttctatttgaaccttgtcacccaattcataagcatcttccaatcggtaataatcttctagaggaaacttagagtcaataggcaaatagatataatctccctgaccatttccaggtaatttaatagcatattcaacacgctcagaagagccagacaccgtaggaaattctctctcatattgactaactgtcataatatcttctataatttggccgagttgtaactcccctaatattccccttgtcttagtatttgacaagactttgttcagtgtaccaacatcttgggcaacagttttcatctccccaagaccttgattgacgctctctagttgacgcgatacagtttcaaaagaagtttgcaaacgcgtttgtagcgttttttctagcttttcctcaacagtttggcgcatttgatccaagcgtttttcattggaatcttgcattttctgaactgactgagataaattggagttaatcaattccaagcgtttgtctgatcgatctcgactctccgttaaatgctgatttaattctgtacgcatatcggtaagcaactgataaatttcctgttgcatacggtttagctgattagtcaacgttagaatttgatctttttgcgccacttctatctgatatgtcagttggtctgatagattatcagcattatcttcaagttgtttttcaacggactttgttaattccgtcattttttggtaagaaattatcgtcactgtcagactagctagtacaatgatcaaaatgatgacaagcatattaacctctatccttactataaataatgattaagtaaccatctttgagctctacttcaattggcgaagtcataaattcattactggaatacatttttttcttaaaataattacttttgttcaattcatatttagccccagaaatctgcaaagtagactcactctcaggcatgaacgagacataggacatcccttcaatccttgagacttgatttttcccggatggtagataagtcactatgttttgttcatctttgagtctgatttgtgacataaatggttctagatctctgtcacttggtaaaaagatattagacatcatatggtcaatcctgccaccaaatgctccaaatacggtcacctgagcttctggaaattctttgaaaatagtttttaaagctaattctgtatctgtatcatttttttctgcactagcagaaacgatattgctacaatagtgtttgatataaagcagttcatcttctgttatagaatcaaaatcacccactgccatgtccaaagaaagcccattttttaataaaaataggcttccacggtcaattccgacaaaatagtcaaaatcatattcaaaataagttaagtcaccgccagcaaataaagcaattttagtcatcgagcgccacccttaaggtttctacttgtgcaggtaaatcacttgctttaaagagataagaacctgcaacaaagacatttgcaccagcctctgctgctgccttaattgtagtattatctataccgccatcaacttcaatatcataatgatgaccgtactctttgcgccatgctgcaactgtctttacttttgacatcatttctggaataaaggcttgtccaccaaagccaggattaacagtcataattaaaatctggtcaaccaaatctaagataggaataagagattctacgggtgttcctgggttaataaccacacctgctttcattcctgcctcttttatcttttgaagcgcaccatgtatatgtttcgttgcttcaacatgaatggtcatgatatcagcaccagcttgagcaaaagcctcaatataacgttctggatcaacaaccatcagatgacaatcaaaaacaagtttactgtgtttacgcatgctggatacaacatccgcaccaaaactaatattagggacaaattgaccatccatgatatcaatatgaacgtattctgctgttgtctcttcaatacgtttcaattcgttagcaaaattagcatagtctgctgctaatatcgatggggcaattttattggttgacatagaaacctactttcttttaataactttcttatatgtttcacgacggctctcaatttcacttaaaaattggaggtagttatcatagcggacttgccataactgaccttgagttaaggcttcttttacagcacatttaggctcatgtgtatgcgtacacgagcggaatttacaaaaatgactaagtctacgaagctctggaaaggattcgtttaagtcctctgcattatccacttcatagtccaaagaagaaaaaccaggagtgtctgcaatttttcctttatgaacgttatagaaactaactgctcttgtggtgtgtcggccacggcctaaactacccgaaatttcaccagtttcaagtttcaactcaggagcaattttgttgagaagcgttgattttccgacacctgtctggcccataaaaacagtcactttatttgctaacagaggcaagagttcctcttgagaataacagaaaacgtagcctatattctgataatgttcgcgaatatcatcaataacaaccaaatcgtctaacaaatccaacttggaaatataaatgataggctgaatcatcttatattctagaagtactaagaaccggtctaataagttagcgttaaaatcaggttctttagcagacatgataacgacagcttgatcaatattaacaataggtggtcgtacgaggctatttttacgctcttcaattgatagaatatatccttctgattgatcttgcgaagaaaattcaacccaatccccaacgtagggaatttgacctttttttctaaaatttccacgcgcacgtgtctgataaacaacaccgtcagattccacataataaaaacctgctagcgacttgacaattctaccttgcaattgttctccttaattgtttagaataccactattatatcataaaatgagaaataagctctactctcagagataagctaaatagaaactatttgtaggtgttcgatttctctcaaataacctcaattttatgaattcccaacataaaagcagtgatcttatttagatacactgcgcttttttccaattactattaaggcacctactgtaatttctgatatactcgcccaatcaatagtcgttttatctacgctgaataacaacggtgtcatatcaataaaagcttgacgttcttgttgagaacagttatagctttgaacaactttctgctcagaaataatttcaaaattttctctaaagtgatctagaattttttgattagagtaatctttctgtttcaagtattgactagctttttctcgcaattcttgaacatgttcagctacaggaacaacctttacaaggataccatcatcactcagcacccgcctaaattctttataatttgcaggagaaaaaatgtctaaaatgatatcaattgatgagtcttgaataggaaggttagctaaatcagaaacaaaccatttcacaagcctagactgatcacttttagcagctaattgaatcgaatctttagaaatatcaaaagccaagaaagtcttctcatgcttgttaactaattgacgagaataaaagccctctccacaaccaatatctaaaaccgaatgaaactgagaattattttccaaaacctttgaaatagcttctaaaatatgattataatacccgttttctaagacaagctgccgattttcaaatgattttttatcataatgttcatctaccttctttcctccaagaagattaacatatccaaatttggataaatcaaaacaatgattatcagagcatttgaggctattactttcttttatcaagggattttgacatttaggacaagcgaaataacttgcactatcttcaaaacgccacttcttgtcaaccaacatagtttatatcccaacctctttcaaggcatctgctaaacttgcaaaatcagggatagataaggcttctccgcgaatagatggcttaatttttgctatttctaatgctttttccaattttgctttagtatcttctgattttccaaaatgactcgttagattattccaaagtgttttacgacgatgtacgaaggctacttttgacactctgaaaaagaaatcctcatcttgaacactcactactggttgatctctacggaccattttcaaaatagctgaatctacatttggagcaggaacaaaaacagttctcggaacgataaatgatactttggcagtcatataatactgcactgcgattgacaaagaaccgtatgctttagtatttggcatagctgaaatacgatctgccacttctttttgtatcatgaccacaaactccgcaaaaggaatcttgctctcaatcaagtgcataaggattggtgttgtgatgtagtaaggtaggtttgcgaccaccttgataggcagatcaggattcttgaaagcctgaatctgggtctgcaaatcagccttgaggatatcctgattgaccacttggacattgtcaaaacgcgcaagcgtatcagcaaggataggaatgagacgatcatcaatctcaaaagccataacctcagctgcattctcagccaaaaactctgtcaaagccccgataccaggaccaatctcaatcacgttgacacccttgtcaatctctgccgtgtcaacaatcttctgtaaaatattagtatcggtcaaaaagttctgaccgaatgatttcttaaatgtaaacccatgacgctccaaaatagcgcgggtaacggttttatctgcgattctcataattcctctatttcttaatattgatcatttttgaaataacatttgaggctatttgtgatattacaactggattataccactacttccttttgcctttactattctgagttataaacttatttttaattgcagttgcacaagcttcggttagtggtcctcctattgcttgcttataattaaatccaatcaactgcattgtttttaaagtatctttattcaataatgtaaccaattgtttcattgttcgttcctgttcctcatttagaccagaaaaattatataacaatgagattccttgctcgagagtattggatagatattcaatatcctcatcatctatattaattttttcatactcttctttatatgactgtgcaatgcgaattgcttgctcccgttcagctaataattcgttaattaaatcatcataagtagctctcaatgttgcagcatcttttacatcctttattgattgaattttactggttaccatagttgcagtccctttgactgcaagcgttgctaaatctaccccagctctagtcaatgcttccgttacattatactccactatttttctccttttctattaatacccctccatacactcttcaacttctgccttggtcactccgaagagtctgaggcgtttgaggagttgtttaccatttgagtagccgatacggagttgattcccaagatactcacggcgttttcggctatcgctagcagtaatgaatccccaacgaatgaggtctgcttgggtgatatcgaaatgatcttcatcatcgaaatgctgagtcacttttgagagtgccttctgcaaatcttcaaagctggcatgctcgacacccagagatcgtcccttggtctttgagcctggctttgcctcgtctcgattgaggaaggcatggcggactgtcggaatggcattcatgatgattttacggatacgctcgccattataatctgggtctgtaaagacgataactccccgcaaattgtgcaaacgttcgatacgctctaaatcatcttcatcaattgctgaacctctagtttcataggtatcaacattgtaaaagcgtcgcagattagcagtatcatctttcccttcgacaacgatcacttcttgaatatcaatttttttcatcaagtctaaatatccttactgcattttggtatgtagcctccgctacctcttccacagttatgcctcgtagctctgctattttttcaacgacatatctcgtataagcggttttgttttctcgacctcttttaggtacaggagccaaataaggagcatctgtttccactaatatcttatctaatggcaactctcgtgcagcttcttgtacatctaatgccttcttaaaggtcacaacaccagaaaaggaaatcatcatccctaaatcaataaatttctgagccatttccaaagaaccagaaaaagagtgcattataccaccaaaaggcccaactccagattccttaatgacttcataagtgtcttctaacgcatcacgtgtatgaacgacaaaaggaaggttatactcttttgaaagttcaatttgacgcttaaacacctcgatctgaatatctttgggatcctccatccaataataatccagaccaatttcaccaagtgcaataaccttgggattttctaaatgactgataatcattgactcaatattatcatcataagaaccagcttcagttggatgccatcctattgtgctatatacctgtgcatattgggaagataattccaaagattttgaaatggtatcttggtcaaagccgacaacattcatttttgtaacaccgagttcgctagctaaattaatttcctcgtctatctttccttcaaaattttctacgttaaggtgggtatgggtatcaaatatttttatcatatcatcgttctttctttgcttatcgtagctacaagcattaatctttattattataacataagactgaagcattctgatcagaaagagtaaatcaaaaaagtcaaaacatttttgctctgacttttgaatacttgctgtaaaaatcctctacaagtgtctagctaatggtagagaaactagactataaatgattatatttttgctgattgctttcaatagcctcctcaacctttgaacgaaattctccttttattgcctcgtccaattgattagcaactttatgaatagctgtctttgtgttgatggctacttcgtctatttctttatgatgcgacgtaataatatcgtgaaacttagatctcttgcgtggcgcgtacacgctatgtatcaattctttatccaattgtttttttaaagtccttactgactccttaccagtcaggacatcccacattaaactcaataatttctcctacttcattaattctcttttcttttccctttgcaactcttcaaaggttagttcatgttctgaacgttgccgaatatagttagctctatattcttcttcttgagcggacaaggcatagtactctttatggtaagcttgctctaagtcgtcatgataagaatctaaaatacgattgagcgtcatcatatctgagctatcattactatatctcaaatcatattcaacagcgtcgtaagtttcttgaagcatattaataatcttattttttcttactgagagatcgtctaatttttcttcaaactggcaacaactatggtgataggcatcatctaaatctgatatttttctctgagtatcagctaattgtttttcaatgatatcaatcagtgccattgtttaaactcccctgacaagttactatcttgtcgcaacatagcttcaactcctttattaatttggttttctaattcaacgtaagcgtgagaaatgctttctgccgcttgagttttatttgagaaaaaggtttgagcttctccgacaatgctcgcatagctaacacctgactgagcatacgcttcttccaattcttgaggacttagttcagtaactcctgtaggagctacttttaaagattgataaagctcttctgctttagcaactgctttttgctcaacttttttaacttcttcaactgcttcttttgatatcgttaccaaaccactagagatcacttttgcttgttgactatctaggaaaatagcttgattcttactaacttcttttcccgtacttttaaagctactaagtttcgctttaatagcatgcattctttgattcacattcgtatgaactactgaatagttttctttgtaagcaaatttatcttctgctaattttaaagaaccatctggattgtactggtagcctccccaaatatgctgattggtaaaattagcaacccagctacctcctgaaacagctttactgtcaactattttaacaattccgacagcattatcgcttccttctttaggataacctattccaattttatccttggaatcaacgtaattattgaccaccccttttattttatcaacctgttctttttgtttatctgtcaaaatactataaaggtttggaccgttatatatccaagctccttgaactcggtaaatttgattatcatccaattctgcaatagcatactgtgcattcattgaccctaacgagtgtccgtagaccgaaatttttgcgttaggatatttattcataacttcttttagcagatgagctgattgttctaactgctttgtaccttgtttatgagatacactttgtgaaccaaatttctttaataatagtttactagctattggaatatcatttttaaaccagtctgttttccaatcatcccctccaaacggtgctgttgaccccttaaataaaaccgtaacttccttaacatcctctggcttgtctaaagttccatttggagtgatggtataaatttgttccccggtttctttgcctccatcttgaacgtgagcaactttaccgatggggagtaccttatcttggctcattattttgactagtgtatcaagttggctacctaattcatactcttgcttcgctatatttaccctatctaaatcagtcaagactttttccattaatgacctctactttccaataaatgagttaactggggagattgatggctactttgactgaccaaatgcccttgattatccctatccaaattacaagtaatatataagttaggatctttattaatgattaaccttaccgaaatccctcccataggattttttttgatactttctttgtcaatatcatacgacttaataacagcattctctttgaaagcatcttcatcttctgcataaatccacttttgataagcatttttagcgtctttgctattagctatttcccataattcttgttgtttattgttttcagtcacttttaaacctcctacagtgaaaccaagccctaaaaggattattacaataaaactaagtaattttattgacttcatctctcctccttttatcatataacactcatttgatatctagtttatcataaatttattctcattataaatgaaaaactataaaacatggattagttatcttaggattaccaaatacaaagatattaaaaaagatgattaatagctctaatgctataaatcatctgactctactatttacttgtaatcacttggacgtcctgtatattttgcccaagatttcttcaaaaatttattattaatgtgataattcggcttgctgttttcctctgttaaaaatggattgatatgcttatctagctctaaccaaccattccaacctaaatggattgtatcttgcataaagtatggcttacctccatctcgagaaaggtcagcgatatgattgaaaccttgactttgaagttggtgttttattttttctacagatttttgatacattttttgatcaagccctgtgtagtctgtccactttttatttactggtggtatgacaaaaaggacatctgtattttgttttgagaattcattaagaaccaactgtaaatcattaaattctggtgacttagtataattgaaatgtcgttgtgaccctttcaatttttttaagtgctttttaattcttgtttggtaaaagcgatcatcaataccaaattgatttgatctcgttgctactttagcatcttgtgatgcaatacgcgataaatgattatatgagaatgctttcggtaatttaccaacatgaggcattattgcctgattataagtttttcctagtggtagatagctaaaaatagcatctgtcttctcaaatacccaatcattaaactttagtctttgtttgtctttatttgatagtttttggccatctgcaactttttctatcaaatctgacatagaagcttcaggatataattttaacaatcgacgagcagcatacctatcgtaggttgtccctgtttgattttgcaaaaatcgaatggtttgatcgttgctgaaatagttttgaaaagcacctttgttggctcccttgcgaacaaaccattgcggagaaataacatagatagcttttttatttttgatttgtcctttaatctgttgaatgccatagtattgtgtcagagaagccgcccctttttgacctaaaagatatgggatataagacctattgtaagcctctgctaaaactgatggatgcattgcgtcaaatcttagccactcacttgaaccaaagaaagggacaaaattggctttaggatcactgaaagctctaactttttgaactctgcttttaaaacctgccttcgtcaacgctactgcactgtttttttccttacctaaatgatgaggctgagaaacaggaaaaacaaaatataatcctaccaacaatagtaaagcacaaactagaggtccaaatactttacctagacgtttaagcattgcagagctccgttactccagcaacaattttattagctgtgttccagtcattacgaccaaattccgcaatcggaatatcaatattaaagtggctttccaactcaacaattagttcaacagtacccatgctgtctagaactcctgcgtcaaataagtcttcatccatcatagaagaaacatcctccataaataggtcatcaataattgctaatacttctgatttaatatccattataatactccttattatttgttatgcggttgtgggaaccacaaaagatctaaaaatcctgaaaaaatcaagaaagaaaacataactacattaaaggtgatgaagacacccaaagcataagtccatttgttttctggtaaaagtggttttttagccaatcttctttctttattaatatttttcttcttacgtacccaagcgtcattaataactaggccaatcccatgaaagagaccataggctatatagtaccaagttaacccatgccagaatcccataagaagcatattgataatataagctacacttgaagtaacattacggtttttaaaaactttatttttaactaaaagcttaacaagcctcatgaaaacaaagtctctaaaccagaaagaaaggctcatatgccatctattccaaaattcttttaggtcgcgtgatttgaaaggtttgtcaaagttaatcggagacttaatccccattaggttagaaatagccaacgcaaacattgtgtaacctgcaaaatcaaagaacaaatcaaaaccaaaggcatacataaccccaagtgttggccaattaaacacaccaccctgttctagcgctaattcttttagaggaggcataatcagacttccaaaaatataggctaaaataaacttatagagaaaacctaacatcaaataatgaatcgcttgacctaacatatctaggagttcgtttcgatctgggatattaatgtaatcctcattgaatcgtttaaaacgatcaattggtccacttgagaaagttggaaagaagagtaaaaatcttaagaattcccataaagtaaattctttcaagacaccgtctctcatttcaataatcatagcaacagctctaaaagtaaggtaagaaattcctagaaacccaaaaagtgactgatgcccatcctcagatatagctggaattaattttaccaaaaatagcggaaaaatagataaacaaaccgttacataaaagaccaaagtatgattaaatcgtttccggtaagctttatagataaaaactagcagagactgtccgacaacgtatgccaatagtgacttcaattgattaaaagtactaccagtcaacatcattacaataaaacttagactaaaaataatctcatataaggcaaaacgcttcttaaagaataagccgatgtaaattggtaggacagctaagataaggtagaagaaatattgtggattcccataaacatccaagtgaggaagtttttctaaaaatgcctgtatcacttgtttacctcgctcataagacctttgatatcaattttcccatttggtgtcaaaggtaaatcctctcgatagataaatttagatggcatcatgtaatccatcataatgtcctttaagtcttccttaattgcttttgtcaaatccaaatcacgttcaaaatcatctcttacaccttcttttaagacaatataggctaataagttttgaactttatgatccttgttataacgtggcactgctactgctgattttacatactgcgatttgtttaagttttgagaaacatcttctaattcaatacgatagccgttaaatttaatttggaaatccatacgcccaccgtaaagcagaagaccttcatcggtcatacttcctaagtcaccggtatggtaagcaggtagaccttcgaattggaaaaatgcctcagctgtcttttctggattgttaagatagccttttgatactgctggtccagcaataatgatttcaccttgctctccgtttggtaatttatgaccttcttcatcaatcacatacgttggtgagtcatctttagtgtaaccaattggaaggcgtttgcatgtttctaacatttcatcagtaattgctactgcggatagagcaactgttgcttctgttggcccatatgcattaacgatacgagcttttggaaaacgttgacgaagtttttgtgcagtcttgacagttaactcttccccatcaaaataaaaatgtgttaactgtggcaaggtctctgaattgaaatcgttagatagtagcgccatatcagcaaatgatggtgtcgaagtccaaacctgtattggcaattcattaatggtagcgaatagttttttgaaatcattaactactgtctttggtagggcaaacagggtgcctcccatagctagtgttggtgcccaatacataactgataagtcaaatgaatatggcggttgagccaacatttgcggtctttcaggaactgaaaactcatcatcagaaatcatccaatttgtaaagctcaataaattgtcatgtgaaatttgcacaccttttggtaaaccagtagtccctgaagtgaaaataatatagtaattatcatcacctttaacagaatgtgttacctcataaggagtcttttcttcaaaaatagctgaaacttgagaaacgtctaggattgggacattatcaacttcaagaggaaattcaccaattgaaatgataaggcttggttgagcaactgtcataatagcctgtattctatccaaagcagagtgttggtcaaccggtatataagcatgccctgactttgttaaagcaacaaatgtcgccaacatttcatattcttgaccaccgaatactaagacaggtgatttttcaacaaggcctaggctatcaatatgagcagctagagagtcagagtctactttaagttgtccataagtatggacttcccctaaaatatcatacactggaaaatcagcttgtgtctcagcaaaatgctcaattgttttaatcatatcatgtatcatttgtaccatctcctagaattcattataaataaaactgccttgtccgcgactaaggtatgcaaaaaagtaaattagtaacaataaaataccgaagtataataacgttctaccaataaaagataaatatggtttcatcattcttcctttaattaatcatggtattggtccaaaatccatcaattggtaactggacttcaagacgtaattggtctttttcttgatatgctctaattctccccttatggcgttccacgattgctttagcaatagataagcctagaccaaaactgagagaatctgcatgatcatctttagcttgataaaaacgctcaaagagattatccataacctctttggaatagatagcacttggatttgatattgtcagaatagcttttcttcgagcttgtttaagactaaactggattgctgattttgacaaagaatgcctaatagcattatccaaaagaattattaaaatttgcttaatctgactctcttctccaacaatccagacatcatcttcaatcgtatcatttaaacacttttcttcttcatatgccaaactttcatatgttagaagtacttcttgacataagacagataagtttaactttttgaaatttaccttggagcgtttttcatcaagtctagacaaattaagcaaatcttcaattaaaaactccattcgcttagtctccgaaacaacatgatccagataacgattccctggaatttgctgttccagaacctgaacgttggctcgtatagctgcaataggggtcttcagctcatgactcgcatctgaaacgaactgtttttcgcgagtcatttctgtctctacaggtcctacaataaatcgagaaagataaagacttacagctgctaataaacaaaatccaaaaatagtaaaaacaagaattagaaaacgccttgcataagggacttcataactagccaaatccataatagctatggtgtaggttttatctttatattcttttatggaatatataaaagacttccattttcgtgacttctttccttgctcaaggagcttcaaactagatttttcgataacatcatttgtcaaatcagtattattgctttgaatcttaaccatcttttggttatctatagtcaccaaagcaatcggttcatcgcctggtattcctaaataatcatttttggcaactaatttaacaatcctatatgcatcatattcatcccaatattgattgtagcgattactaactgcaaatagaaagagaacaacgacaataaggattgacatggtcaaaaagacaaattttttgcgtaaatcactaaacattatgtcctctcctccaaggaatatccaaagcccttagtggttattatttcaatgtctgcttttaaaaagcgcaatttttttcgcaaaaaagaaataaatacttctaactggttatattctgaattgtctgaaggtccccaaaccttagaaatcaactgatttttaggaataatctgctttgcatttcgcataaaaacttccatcaagagaaattctttattggataattttacactactttctttagattctagctcatgtgaatctgtgttaagccttatatttccaagccgcaattgatttgctctgattagagaagattgtctggttctcagcctaattctagctagcaattcatctgcttcaaagggttttgtgatataatcatctgcccctaaatctaaaccattaactttatcataagtctgtgattttgcagttaaaaagattattggggtttctaaaccagcttccctcactctttttaaaacagataatcctgagcgtttgggtaacataatatccaacaggactaaatcatagagacctgtcaaaatgtattctaacccatcatctccatcaaatgctaaatcaacagaataacctttatctgccaataaagcctgaatagcctctgctatacttttttcatcctcaactacaagaagtctcattttctagtcaccttaccatatatattatagtataaactagcaaaattgaaataaccttgaaaaaacgatattaataaaagtatttcctaagtcactaaactacttcaataatacaagcgtctaaaaaataaaatatcactcgctataaagatatttctcaataagaaatctcctcatattttaacaaaaataggggctatttgtctacgaatttccgcattataaactcacttttcattaactttatctataatatactcaaactactctcacaaaaacctttatcgttatgaaggtaccaaaaaagccaccagactcgagtacctgttggcttgatattattttgctatctatattaagctgataacactttacgtcctttacgacggcggctagcaagcacgcgacgtccgtttttagttgacatacggtgacggaatccgtgtttacgttggcgacggattttacttggttgataagtacgtttcacgttgaatacctcctgatagattttcgtattcgtttagccggctattttgatcagttactaaacataccatactattttataacaattttaggcctcttgtcaagaaatactttcaagttcatttgtcttttttcagtaaatagttccatttgttagcaagaaatgcttctctattttctccaactaaaagaaaagatgtgccatcaaaacaataataggtaatgaaataattgttctctctataaaaatgataaataattctagaatgttgatagggatcttggaacctaatatcaccgcaccagtctcagacatataaattaattgcacaatagaaactgttgcgacaataaatcttgtcatctcactgtgaatttcagccgccattatcgaaggaacaaccatatctgaaaaaccaacaatcatggtttgactcgcaatatctgcttctggaatccctaaaagttcaaggaacggaaggaatggtgtacctaaaattttaaaaataggtgttgatactgaaataatcaaagctattgttccgacagtcataattgttggcataacgccaaaccataaactaagtactgtcttagaggcattattgacaaaagtcttcatgtttccatttgcttttgatttatcgatggcaagcttaagtccccactctatcttgttataaccatccggaattacctcagatgtttctttctttggtttagtgtaataactatttgattgacgagataagggagggatataagggataatgaatgcacagacaacactgctaatgatgactgttagataaaaatggccaaaataatcagttaagccaacattctgcaaaacaacaagacaaaaagtgattgatactgctgaaaaagtagtggaaatcgttgcagcttctctactggtataataaccctcaacatactgcttatcggtcaaagcaattccaatagtaccatcacctacaaatgaggctacacaattaactgctgaccgaccaggtagctgaaagaatggacgcataatgggagttaggaagacaccaacaaactccagtagaccaaattctgtcaaaaatggaagaataaaacccgcagcaaggaaaatggtaaacaaaccaccaatcaaatcaaaaaggataaggccgcctgtctctttcccccataccatttcaggaccaatatgtaaaaccgtcatcagaccaagtgccaaaccgatcaaacgaataatcagccagaaaatggtaatgtcagaaatttcttttagcaagtcatttttttcaataaagctaggtctaaacagacgataacaaagtgctaacacacatgaaataaaaatgattagtaaaataatataatgtataggaaaaacagcgttaatccattgattaattgtcttagagattacagagacagctactgttgtcataccattatatttaaatggagtcattaataataatactccaaataacgacggaataataaaccacaagatatctttaatagatatactttcttttttcatacaatcctcctggataatatggaattgtttctaaatatactcataacttccattgtaaaattttataataaaaaaaacaaccttgaattaaagaaaattttacttagtaatactttagtaatttctcaaagtaagttccgtctgccctccaaaaccggaagttagtgtgaaaaggatttttatggtggaattaagtctgagacgtttgggttagaaatgagtttatccatcatgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacatgaaccaatcagagctgaactcctggcttgaaatggacacggttattggacggattggtggaaaggtccttctcaccttcaatgtcgccttctgtaacttcatctttgccaaactgatggattctaagacagctatcgaaactgctaaacacatacaggtcattaagaggacactctatgataacaagagagacttcttcgaactctttcctgttatcctaacggataatggtggggaattcgctagagtggatgatattgagatagatgtttgtggacagtctcaactcttcttttgtgaccctaatcggtctgaccagaaagcaagaatcgagaagaatcataccctcgtgagagacatactgcctaaggggacttccttcgacaacttgactcaagaggacattaatctggcactatctcatatcaacagcgttaagagacaggctctaaatggtaaaacggcttatgagctattctcttttacttacggaaaagacatcgcaagtatactcggtattgaggaaattactgcggaagacgtctgccaatctcccaaactattaaaagacaaaatctaacctaatcaactaactgatacaacctaaacgtctcacactaacttcaaccatagcggaacttaatctgaaacgctttcagatgaggatgttttcttgtaccctttttttgcgatttttaactctgaaaacctatgaaatcaagtattataaaaaccaacggaacttagtctgagacggattttcgttggtttttattggtttttatcagactaaattccatttctactagaggtggaacttactttgagaatttagcttagtaatactttataacctgccatttctttcattctctcacttttgatgtattaaaataatataaaacttatattaaatagctaaaacgacttaagtcacattaaaaaacacgctctaaaagagacgtgtttttttctatactatttagtccactctgaaacttcttttttgtggtttttaatccatttttgagctgctttagcaggctccatacctttatccatatctaacatgatagattccatatcttctttagtccacttgaacttatcgataattttatatacttttggcatatcttttttcaaattcttgcgtgctattgtattgatatgttcttcaccaccaaatgatttcttaggatctttaaggtattttaaatcatacttagcaaacatccagtgaggtgaccaacctgtaatgactacttgatctttgtttttgatagccttccctaaggttgttgtcatagctcctgttgatgctgataacaacttccaacttgaaaggtttggataatctttaagggattgtttagcagacttcataatacctgcacctggttcgatacctgtaatttgtttatctgcttgatttgataattcttcaatactatttacgttcatgtatttaggaacaactaaacctattttgacgttctcaacgtgaggacctaagtcatctaaactatttttgtatttattaaaatattgcccgtgggtctttggtaaccaagcacttgttgtaaaatcagcattcccattggcgactgtttgccacatgaccgcattgtcaagtggtgtcaattcaacatcatatcctttagattttaaaacttcagcaataacgttggttgaagcaacttctgaatcccattggacataagctatcttcactttttgacctttggcttcatttcctgaagtcatattgacaacaatgcgaccaagagctgctagaatgaagagagccagggcccctaaacctacccattttttaacttttgatgttttagcttgcttctcacccggtttggaattaaagaattgactaacacggtctaacacgattgctaaaataactagcgatagaccactaacaaatcctgtaccaatatcagcatgttgaagcgccgataacacctcacgaccaagtccaggtgcaccgatcatagatcctgtaaccaccatagaaagagccaacatcatagtttgattgattcctgccataatagtgttcttagcaagtggtagttcaactttgaataatttttgcttaactgttgaaccaaatgaatcagatgcttctattaattcaagtgggatttcacgaatagccaagttagtaaagcgcactgttggaggcagagcaaatacaacagaggcaaagacacctggtaccataccgataccaaagaaggctactgcaggaataaggtaaacgaatgccggcatagtttgcataaagtcaagaattggattaacaacttgtttaactttatcactttttgccatccaaatacctagtggtacaccaataataatagaaattaaacttgctactaaaaccaagttaaaagtattaatcaactgttcccacagcccttggttatagataaatagcaaaccaatgaaagtaaatgtcggtaattgccattttttcttagctaagaaaaatacagcaattgtaattagtacaataaaaagtaaaggattaatgaatagtaatgtttttgtcatccaatccatcaatgcattaccgattgtctggataaagtcaaataaaccagaaaaagttttcgtaatccaattggtcgttgactctacaaatggtgcgaccggtaacttatgttgtaataaattttccaaaatgatttgtcctctctattaagcttctaccgtttcttttggcgattctactactgtttcatcttgaacgttagcaagtgcttcgatcacacgtcctctaatgataacccctaggagtctatcattatcatcagtaacggctatcggagcagatgaatcataaattaaaggcatgatatctgtaataactgtatcttttgagaccgttacaacatctttatcaatcacttcagaaagcggcaaatctttcttacgagcttcaattgcagcatctgcagttagggatcccagaagttggcgacgacgattcgttgccattaacattgagacttcctcacgatgcattcttgttaaagcaacttgtgggccatcaatttctaaaacagttgttaaaggttttatcataatattttgagcagttaacacttttgagcgatcaacgtcttcaacaaactcacgaacaaaatcattagccggattagtcaaaatctcttctcctgtaccaatctgcatgatttctccatctttcatcagagcaatacgatcaccaatacgtaacgcttcattcaaatcatggctgataaaaataatagtttgtttattcgtgtcttgaagatcaagaagctcatcttgcatttcacgacgaattaatgggtctaaagctgagaaggcctcatccatcagaaggattttagggctgttagcaagggcacgtgctaaaccaacacgctgttgcattcctcctgataattgactggggtactgatctttaaacggtaatagacctgcattgtccaaagctttttcagctaacgttgtacgttcttccttagaaacaccacgcatctctaacccaaactctgtattttctaaaattgtacgatgtgggaaaagaccaaaattttggaaaaccatgttgatatcatgacgacgaatgttacgtaaatcttctacattcatctttgcaatatctttaccatctaaatagatatttcctgatgatgggtcaatcaaacggtttaacatccgaactaaagttgattttcctgaaccagaaagtcccatgataacgaaaatttcgccttcttttatttcaaaactcgcatcatagacacctacagtcgctcctgttttttcaagaatttctgtcttactttttccttgcttaaccatttcaagagcagctttttgctttttcccaaaaattttggttaaattcttcacttctaaaatatttgtcattcttatctcctactaaaaatttcgtatcttatttttaaggttatgtgtcttatctataaagtgacgttaagttatcgtaaaagggtagtcacttttttactcaaaaaaataaactgccgaaacagaacataactataatatcatgtatggtctctttatgtcaacacctttgcttagagatattttaattagcccacaccattattgttatggcattattgaattatttaaagacttattagtattaatattacaactttaaaagtgaccacttaatacttttgaaaaagcggtcattcttctataaaataacaaaacacccttagaaaaaatctaaaagtgtttttgtttgtaagtataggcctgaaaaaagtgactacttgatattttcccatttccaattttgtacttctggaatatcgtctccgtgttcacgaatatagtctttgtgataagcaaccatttgattcatttcatcactgaaggcttgtgctttatttcctaaagaagcaagagctgcatcctgtgccagatggaatcggtccaattctgacatcacgcgcatatcaaatggtgttgtgatgtcaccattttcacggtaaccatgcgtatgcaaattatgattgtgacgactaaagaaaatatctcgaatcatatcttcataaccatggaaagcaaaaataacaggtttatctgtggtaaagactttgttaaactcttcatctgataaaccgcgagcatcttgtgaaggatgacgaagttttaggatgtctaatacattaacaaatctaatcttaagttctgggaaagccttatgaagaatgctaatagctgccaaagcttctaagttaggttctgttcccgccgcagcaaagacaacatctggctcttgattaagcgacacatttgaagcccagtcaatcaccttatatccttctgccactaactcttctgcttcagcaatagagtaaaattgtggacgagggtgcttagatgtcacaattaaattaattttatcttcagctttaaacgctttatccataacagctagaagtgagttagtatctgctggtaaatattcacgaatgtattcaggtgttttttcagctaaatgagttaaaatacctggatcttggtgagtataaccattatgatcttgttggaaaacagttgaagctgcaattaggttaagcgctggataatttttacgccatgttgtgtgtgtttttgatttacgtaaccatttgaaatgttgtgttaccattgaatctacaacgcgaaggaatgattcgtatgaagcaaagaagccgtgacgaccagttaaaacataaccttctaagaaaccttctgcttggtgttcagacaattgggaatcaataacacgtccagctggacttaaagcttcgtcataatctggtttacgacgaccaagccattgacggctagtacgtgtaaacacttcttgaagacgatttgatttcgtttcatctggaccaaaaatacggaaattatctggattagcatctaccaaatctgctgcatattttccaaattcaatcatatcttgtgccataatttgacctggaacattaatatcaagagcaaatttcttccaatctgctgtatccattgctttaacaataccagcattggttattggattcatggacatgcgacgatcaccttttggtgaaatagcagcaatctcatcaacgattttaccattttcatcaaataattcttctggacggtatgattgaagccatgacaaaagagaatcaacatgttccatatggtgggcatctactggaattggtacttggtgagcgcggaagccaccttcaattggtgttccttcccaagcttttggaccagtccaacccttaggaatacgtgcaactaagacagggaattttgcttggatagcttcttctgctggtttttgtcgtgcttctgattgaatggttttaatctcttgaatagcttgatctaatttttctgcaaacaaagcatgagcagccgcatgatcctcagagagttcaacaacatctgcaaaaataggtttccaacctaatccttcaaaaaactgagataattcttcatctgtcttacgttcaaagatagttgggttatggattttaccaccatttaaatagaagattggtagaacagcaccatcatttactggattgataaaggtattagatagccaaccagccataagtggtcctgtttcaccttcaccatcaccaataacagtcgcagcaataacatctggattgtctaggatggcacctgtcgcatgagaaagtgcgtaaccaagttcaccgccttcatgaattgaccctggtgtttctggtgcagcatgggatgcaattccacatgggaaagagaagattttacataactgcttaaagccatcctctgtttgctcaatatttgggtttaattcagtatatgaaccatctaaatatgaattagataccataacttgaccaccatgacctggaccttcaatatagaacatgtctaaatcgtatttattaatagcgcgatttaagtgagcatagataaaattttgtccaggtacagtgccccagtgaccaattggatgaacctttaagtcgttttcaaccagctctcgtctcaagagagggttatcctttagatacatttgtgctgcagaaatataattagctgctctccaccatgcatcaagtttttctaaatatgattttgtatcaaattctgacattatttctcctaatcttaattgtgattttagtaacatattttaaaattgaaaaactgcatatcatgcgacatacagtctctcattagccattatagaagtgctttaaattgaatatttgattcttgttcgaagcaatcatcaaaaccacgtgggtgatggtattcaattctatctttatcttgtggataagtgtatttacctccaacttcccaaataaatggatggaagtcatattgaaggcgttctttacgcattttccacaattgtaagatttcgtctgtagaagccatgaagttagaccagatatcgtagtgtacaggaataatgactttggcacggagattttctgccatacgaagaagatcgattgaagtcattttatcctgaataccaactgggttatcaccatagttgttaatagctacgtcaatcttgtagtctttaccatgtttagcaaaataatttgaaaaatgtgagtcagctccatgatagattgttccacctggtgtttcaaaaatatagttaactgctttacgagccatttcttcatcagtcacggctaaaccagcaagttctccatcatgttcttctgcaccatctactggaagtgtcaccaagcaagtacggtcaaatgattcaacagcagtaactttgatatctttaaactcaaatgattcacctggtttaatcacgatgattcgttcttctggaactccccattttttccaaatttcaccacattcatatggcccaacaaatttaacatggtctaagttaggattattaataatggctgccgcagtgttgatatcaatgtggtcactgtggaaatgtgaaacaagatagtaatccaattcattaatagcaaatggatcaataaccattggttgtgcgcgtaagtttggttggagtttacgaacacctgccatattagccatttggtgtccacgaaccatatcttttactttttttgttgatttaccgcggtttgaccataggtccataacaacattagcaccacctggtgttttaatccaaacaccacagtttcctaaccaccacattgcaaagttgccctcagcaacaacttcttcttcaatttcttcgtttagccatgtaccccattctgggaatgttgataaaatccatgattctctagtaatatctttaacgttaggcattttatttcctcctgattaattgtttcttacatctactagtataagttcaaatacttttgaaaaaaagaccaagtgtcacacatttatgtgttcaaaactgggctgtctgttccaaattagactcataattttaattaaaataagcacaaataaaaagtactcccattaaaagtactagctttctcaactttaattatcatgtcatagaggaactcattgcgattaaatatctagcacattgtttaaaagcaccaaaaaagccccagcttctttttctgtcttcagaaaagctgagaggctaccataaaattatattttaacaaactgtactttgaaggggaaggacgtcttggagcaattcttgatgaataagtttctcaatcttagatttcagcacgtagcgttcactatcttccttgacatattgagcaattgttttttcaagttcattggtaaattgattactatttgcacagttaccttttttagaaaagcgaatcaagcgaataatatcatcatctgtcaaaacagggtgaactactaacatcggaaaacgagattctaaagcatcactagtagagacaaccatatctacatgcataagatcactcacactttgatactgttcggttgtaaaaacagcttctatatcactatttgttaagtagcgttgacattgctttaaaagaagtttctgaatcgctattccttcatcagatacaataactaacttaagtttattaggagattgttgactattacgaagttcccctcctaaatgaatcgttagatatgctacatcatcatcggtcaatttgatttgccaagctttctctaaaagctttacagaagacgaggttatggcaaaaagttcttcatatttgtctttaatatgctctgttaaaggattaacagaaaaaataccataacgtttacgatataagagtgccttgcagtgagtaagaagttgtcttagtaagtcctttttatgaacaaagtgaaggtgatatcgttcttccaattctttcaaaaaactggttagagtagctcgcatatcatcataatcctggctctctaaatgattgtcacggtccttgcggaaactaagcataagcatggctactagtcccacttcaatctcatccagtgataactgaaaattttcttccagctcatcagccaactctttagcaatctcatattccttacgttgccaaaccaagctaaaatcactattaagagaggtctgtacttcaggacttaatcgcatcttacgataagccattagtataaaaggcaaaatctgaatcataaactgaccatcttgactgttgattttcttacctagacttcgttgagaaatgaagagataatgatgaaaataatcaagaacctctttagaaaaataagtgctggcaccaaaagcttgagacagtttatgattaaaaaggtctataaaactactacttccattatggtagatatcatctaagagcttatataagtactggataatggacaatgggtgaccatctaaaaaataaccacgacattttgttgattgtaactgtaaattatattctttctctgctaactcacttcttaattcgtttaaatcgtttaagatagtatttcgagaaacatcgtttagttgcatcaacctatcaatcgttacgcggtccttagctactacgatagatactaaagacagctgcaacctctcactacttttcatgacgtaactataatcagtcacttcatctaataaaagacgacaggctgctttttgtttttctgttagcaagattcctacacgtggataactaacaatctgaggcacatcgctaggcagtgcatcgtttatcttctctaagtgataatacactttacgtctagactgattaagtgcgttggcaattgccataactgtttcaggttcctctaatttcaataggtaaaagaggaggtcataactttttttatcgagaataatcaagaatatacctcttttctactcgaattcatacagacttattataacatctttttaaagccttttcattaaaagttttgactattactgatagagattaaacgttgaacatccctttttaatatctccaactctgtggggtattctagagctagatactcacaattagagaaactctttaacaaatcagtcagattaatctctccttcgaagaggctcttcgagaggtggggctttccagctacctgtataaaatttttacagtgaaggtaggtggtatcacaagctaagttatttaccgcttggtataggtcttggttgataaaggcccaattagcagtatcaaaaacaaaacttattggtatttgtaattctttcactagagtcataaaatattggcaattctccactgtagctgctttagggtcttgattattttccacctttataccaatagtttggcttttcaatatctctttaagaggttctaactcttctttacttaagtttctggtttgtccaacatttagcttaatgaaaggagctcctaactgtgatgcttctttaaggcctttattaagataaggattaactttccctcctttgataaggtcttcattagcactatagtaaagattgatatcataaaagtcagcctctgcttttaaagcgggtagctctctatctggatcttgaagcaattcttgacgtatctcaaatcgtgaaaatcctaaatcctttactaacttaatgagctgaacttgtgtaaaacctttgtctaactgttttttgaatacaatactattgataataatatcttcttgtttcataacaactcctttgatatccctacttattcagatgaccgagttccgaccaaataggatccagtgtttctaataatttttggtaagcgtgatatttttttttgtacccctttacttcggataattgaggtttataaatagcttttacacgaaccatatcttggactgcttcctttaacgaaatcttatctaaagcatgacgtgctaaaatagctcctcctaaccctcctaattctgtgccttctactgtttcaataggaaagtttaagatatcagaaaacatttgcatccatgctggtgagttggtagctccgccagagaaacgaattatttttggcacactgcccctactttttattaaatcagtgatatgctgcttatgtgcaaacgcaataccttcatataccgcacgtatcatctgagatttcgtcgatttagttgttagcccaaaaaagcaagcgctagcatcttgtgatgtgttactaccgtaaagaaacggaaagaaaataagtccatgatgtgtagcatcagtatgagtgagaaattcttctaaattatcatagatagaacctccactagatttagcgttatcaatttcttgatgcatgagcatttttaacataaaattaagattccctgcagaagtagggctacttgcctctaagagataacgacgatctggaaaataggaagtcataagaccactatcttgctttgctggttttaaacttggatatgtattaatattccaagttcccgaaataacactaaaagtatctgactctaaaacacctgatccaagagcacaagcatcgatgtcaaagagccctccaacaacgggggtcccttctacaagaccagtctcttttgctgcttgagaactaattcccccaggaactaaatctgcactatctataagttcaggaagtgagttttctatctctctaatgccaaaaaaatctaaaatagctggatcataagttcctgtttggaaatttatccaatgattacctgaagcgtcaccatattcttgctgtacttttcctgtaagcttataccgaataaagtcctttgcagaaaggaccgcccctattgatttataggtttcgggctgataatctttaagccaacgtaaaataactggactttgtgaagggaaaatatgttgccgagtcaactcccaaatattatcaagtttagattcgaaatattgcgccaaatctttggcacgattatctgtagacaaaattccttgttcaagtggctccaacttattatctagcagataaagacctttcccatgtccaatacatgctactgcactaatctgctcagggctgagttttgagatttgaataacctctctaatagcagaagttatagcattccacgttttaacaaggtttacttgacgatgaccagattgagtctcattttttaaagtttcaaaactcgaaacagcgatttggtgtcctaatttgtcaaaaataagcgccttggtatttgtaccgccgtagtcaatactaaggtaataagtcataatttgtctcctcattgttgatttaaaaaggaggtacaagaaactcttgtaccttgaaaactcttctaatagagattgagctctttggttgtatcatctatacctgctctgttagcctttacatgttcttctttaaagtaaacacgctcagcattattgtacataacatcttctagttcctcttgactgaaaatatcaacattctctagccaagtagctaattcttcgtaagtattgaaggtcgctgaccatggagaatcagttccccaaatgatacgcttagccccaagaacttctttagcaatacgtacattttgttctgattttggaaaaggaaaactatctggggcatcaatatcttgaatagctgaaatatcagtatagatattgttgaagtttttccacatattaagttcagcacgcaatcgatttgaatgctcaacatgtggaaaagagaggtgacaaacaacaaaatcgagactcgtataaaggcgagctaaattagcaatagcatcaggttggtgactaatttgatcccaattgccataatcaactgtaactacaaatcctggatagtctaacagataagtcaaaatacgactcacatgtgggtctgtatcaagacggaaaggcgttttttgtccacggtatccatggataccccctccttgactaatttcaaatttaatagctcgaaaaccaaggacttcaacatgacgttttacaatttgcattgcgttatctgcaaatggatcaacagagaatgcgcctgtaaaacgttctggataacgtttaatagctaaatgcgtataataattttgataaccattaagatgaccttgcaaaatgactgctttatctacaccattagcatccatatacttcaaaaaagcttcagctgtaaatgctttgtcaccgtattcgtctgggatgagcttaattaaatcaccatcatcccaaatagcataaccgtttccaagggcattaagacgtcctttaccattaaatcctgcaattgtatcaacaatatgagcatgtccatcaatttttttcatgagtattcctccaacagatttttaatcttcagcaataaagattttttcacaactaccttcatatccgctattcttatcagccatagttttaaggtatgcgtaaatagattcacgatgagtacgaagcaagaacaagaaagcaagatagataacaactgtcacaccaatatagagtgggttcccagatatccaagcaaagaagactagagctgtcaaaggatgagctaggagattaaagctcataatcaaagttacccctgctggtaaagcagttccaaaatgcttaacagcttctgtgtagattggacctagggcactagcagcataaagacctagtgaaaaccatatgattccattcaaaatagctttaagaatatttccttttgacacagctatcatagcttcaatcataaaagggatagcaataaggtcaacgactggtaaagcttcatttccaggtaaaatcaaggaaataacaaccattattggtactaaaatgagacctgcgataatagttgctggttcaccaaaaccaacaccgtcatcaactgcaataaaccaacgttttttatccagtgctccttgctcagcttgactttcttttttcttattgcgttcaactgcttcagcaagaggagcaaaagcactagcaaatacccccgtaatcaaaggaaaaatagtcataaccgctgcaagagcaactgcaaaaccaagtatacctccccaagtatcaatacttgcaaggttacgtaaactacctaatacaccaataatcacaccaagtataaaaccaagtgtcattggctcaccaaatatccctaacttagtctttaatgattctgggttcaactttaccttattgacaccaagtaggttccaaagaggatcaagaataagagctggaataagggtttcaatattatgaatcgagttgatcgttgcatttttaacaccgtaatactccgaccatcgatctgccaatacttctgacatcactaatgaatagagtaagacaaaaaccataaatgcgaaagacaatataaaattacctgttgctgcataggccattgtaccccaaatcatatagccaaagttattccaaagattagatgggacaaatactcgggtaatcccaagcaagaaaagccccaattcaattagcaagccaaaaacaaagaaagagaggccaatctcagaagaaaaggcggtgagagaaccagcctgccaaccaatatctacaattggtaaatggagaccagtagttttaaccatctgctggatatacttagtcaccataggagcaaaagctgatataatccaaccaaagcctgtgagtccaacaccagctcgtaaggcgctaaagaaagctcgccttggattgacctttagaaaaaggctgacaataaaaatcatagcgggtacaacagttgctgcaccaaagacttcaaagaatttatgtaaagcttctagcataagttcacctttattaaattattaagcgcttacatttactcgtaaaaaaatgggaggtcccattttttcaaaagatggctctgcgctcactagccaattatttattgacaatattttgtggcttgccatcaaagaaggcaatgatgttgtcagctgcttcttcagccaaagttctacgtccctcaatagtacctgtcccagcatgtggactcatgataacattatcaaggcttctcaatccttcagatacctgtggttcattctcaaaaacatctaatcccgcacccgcgatttcaccttctttcagtgcttcaataagtgcttcttcagaaacgattgggcctctagcagcgttgattaagtagcttcgatttttcatcttagcaaaaacatctttattgaatttgtggattgttgatggtaatgctggggcgtggatggttatgacatcagctgttttaataagctgatcaaattcgagataggttacaccaagctctttttccttatcttcaggaagtcgataaacatcattgtaaacaacagtcatcccaaatgctttagcaaaatttgcgactgtcaaaccgatgcgtcccattccgtaaatacctaatgttgaaccttgcaaagtcaaaccttgataacgttgttcgctcggatcaatccactctccacttcttacaatactatcataaaatgcaaggcgcttactggcagctaaaattaaagcaaaagtcatttccgctgtcggaactcgtactgcttgaggggaattagagactataattcctttttctttagcatacgcagtatctacatgatcaaaaccaaccgcatttaaagaaataatttgtaagttttcacctgcatcaatcatctctttatcgcctttttgtcccatgagtaaccatccgtcatattcagataaatgctctaacacatagtcacgtgaaaatgggcgatcttctgaataagtaacatcaaatcggtccataagctttcttagaccttctttaggcacaatacccgttactaagatttttttcttgtccatattgtctccttcttaaatttattttactaattgataaagagcaacttcgccacgtccgttattggctgagaaaagataagcttttccatctttttcaaaagctaagacattactagaagctgcttttgcatctactaattctgaaaccaagtgcccatctacaaagtgaaaaagccttaattctgctttttctgatcgccacccgaatacaaaacaagtctgattaagtaaacgaccactccaaatagcatgaccaaatggtgttttttctggataatggaataattctcgaccgaaatcttcagtgaagatgcgtaaacgatctccatgaaaaccttggataatcacatactcatccttgccatcctgattaatatccactttcaccacatcgcttgtctcctcatcgaaaagccgttctaattgccagtcgcctgtagtagaaaattctggataagtgagtttgaataccccttctactgaagtaatcaatgaatatccttcatcctgaatggcatagtatccatgattttttaataaagtttgaggcaattgttgcaatccttccaatgtatggttttgagtattaaaacgagcaacaaaaattcggcctttatcactccaatcctcagtgtgggctttactgttagcaattgtacaacctataaagtaaagttgattttctttacctttaatgagatcaaagcgatgtaaatacggaaaatcaaatgcgttacaaatgtcccaatgatctccttgaaaacttgcataaacaacctgacaatctttggccttaaaccctgggtaaaatttctgggttgccaaaaaatccatggttccgggaattggaataatactcatggtacctcccacatcttcccaaacaacaatttttgctaaatcgctattcaaatcataagcaaagcaggcttggtcaacctctgaagctactaataaaaaatcatagtcttgattttgcaaacgacaaactgaataacaagcttcaagtctgtctgacaataatttattaatcttcattctatcctcctttggtgaagataaaacttgagttaaccgtttaactaatggtgcaaaaaaataaaaacatttgagttaagagagttagagatggttcgttaaaagcttacctattcttaagttaaacggttaactcatttataattctattatactatcattttctataaaagcaagcgtttacatagtgttttttgcttttttataaaaaaatgcttgctctcgcaaacatttttaaaaagattgacgaataacgatttgattttttacttctagtaaccttgcagtagttggttcgtttccttgactaattttttcaattaaacattgggcagccaggcaaccaatgccatatgaatcctgttttatacaggaaacgtttggtgtaagcacctgcatccattctaaatcttcataactcccaagaccataatcctcagggtagctgaccgttgattgatttaattttttcataaaattcaaaagagttggaccgttcatcattaagaaccctggtttttgctctgaatgttcaatgatatcaagaattctctgtgtactaccatcttcagtgataataatcaacttatcaggatttgaactgaccacttctttaaaaccttcgtaacgaagctcacgggttgaaatcccttcaatgggataagtgacaaaatagatgtcatgatacccagcttcttgcattttttcaagaaatatttgagtcgattctttattgtcggatgctacagtatctactttaatatctttagcttgtctatcaaccatgacaagacgatcattactcaaagtttctataaatgaatgattaggatctacagaatctaaaataattcctgaaacgttttgctgatttaaacggtttaaattttccaactcaatgtcaatatcattatccgagttagtaaagttaaccgagtaaccaaattgttgacaagtatcatgtattcccttcatcacagacgaaataaagggattagtaatatcagcaataacgaccccaatagtacgggtattttttgtaactaaactttgagcaatcttacttggttgataaccagtctccttaatagctaaacgtattttttctttcgtttgcagagacattttcttatagttcccattgagataataggaaactgtagcttttgacacacctactaaatttgcaatatcactaatggttaccttctcaaacatctctatttccttattctaattagacttaatttatccgtattatatcatttaataagaaaaatgaaaataagtgttcttattggagaagattataaaaaaagacaaacccattatcaaagtttgtcttgcactagtataattaagagtttgctttatcgtaacactacttcttcttgaaactatcccaatcttttaagaaagtttcaatccctttatcagtaagcgggtgagtaaatagtgatgcaaatgttttatctggaatagtggcaatgtgcgcaccgcatttagcgacgccctccacatgcgccaatccacgaatgctagcagcaataatctcagattggaaaccataaaaatcaataatgtgacgaaggtcacgaatcaaagcataagcatctgttccaatatcttcaagacgacccacaaaaggactaataaatgttgcaccagctttcattgccgaaagaccttgagccacagtaaatattaatgtcacatttgtctttataccttcttttgataattgtgaaactgctgctaaaccttcttcagtcattggaattttaacaacaacatttggtgaccacttagcgatttctctagcttcggtaaccatttcatcacaagttaaacctgtcacttctgcactaactgggccatcaacgatttggcaaatttcgttaataacttctttaaagtcacgcccctcacgtgaaataatagtcggattggtagtaacaccatcaacgattcctaaacgattaagacgacgaatttcagaaacatcggcagtatctaaaaagtatttcatattattctccttaatgttcttgtcctttttgaccataataagcatttggtccatgcttacgtaaatagtgtttatccataatatattttggagctggttcaacacgtggattaatttgttcagtgaaacgattcatcttagcaacttcttcaagaacgactgagtgataaactgcttgtgctggatctttcccccaagtaaatggtccatgattacgtacaacaataccaggaacagccattggatctaaatcccgacgttcaaattcctctataataacgctacctgtttctttttcataagcagtgttaacttcatcttcactaagtgacctagcacatggtactggcccataaaaataatctgcatgtgttgttccataaaatggaatatcgcgacccgcttgtgcccaaccaactgcttctgttgaatgagtatgaacaataccaccgacttctggccatgctttataaagttgaacatgagttggaagatcagatgatggattcaaatccccctccactatatttccctctaagtctgtgacaaccatattttcaggtgtcaattggtcatagtcaactcctgaaggtttgataacaatcaatcctgcttcgcggtcaacttcagaaacgttaccccaagtaaatttaactaaactatgaactggtagtgatttattagcttcacacacacgttcacgcatttcttgcaatgattttgccatattatttcactcctgttttctccattaatgggtaaagaaaatcttgcgcctctttaatggctgcacgtgtttcctctacagtctcacagttctccgaccacatttcaatcaagaatggaccattataatttgttttcttaatgacagcaaacatttcttcccaatcaacacacccttgaccaaatggaacatcacggaattgacctttagacgtttcggtaacagcataagtatctttaatatgaagcgctgcaattgagcgatgtccattataaaattcactccaaagatcattatgccatgctgatacatttccagtatctgggtagacaaagagataaggagaatcaatctctttttccacagccaaatatttctcaatggaattcataaatggatcatccataatctcaatagatagaataacttgtgcttcttcggcccaagtacaagcttgacgaagattcttaataaagcgtgcacgtgtctctggagatttttcttcatagtacacatcatatcctgctaattgaatattacgaataccaatatcttgagcaaagacgatacattttttcatcatatccatcgcacgcgcttctttctcaggattattagatcccattgggaaacgacgatgaccactaaatgtaattgttggaacacgaactcctgtctcaaaaatagctttgaccaactcaagtcgttcttcttttgaccactccaaacgtgccaaacgttcatctgactcatcaatggataattctacaaaatcaaatcccaattctttagcaaattgtaggcgttctaaccagttaaaatgttttggtgttgccttctcgtaaattcctattggacgtgtcatatattacccccaaatacgtttaatttcatccttaaatgcacgtgctgctgcggctggatcatctgcctctgtaataccacgacccgcaataaaagtaaagacatcaacaccttcaaataattgaagagtatcagttgataaaccaccagttacagaaactcggaagcccatatcaatcaattttttaaccttattaaggtctttctctccccatgtttcgccagcaagaagcgcatcacgagattggtgataaatggcttgtgaaatacctgcatccaaccattgttgcgcttgctcataagtccaatcaccatatagttcgatttgaatttctccacgatcgccgcgttcttctttgatagcttttaaggctgcttccattgttggaatagtagcacaacagatacaagtcatccagtctgcaccgcgaacagcattatttttagcaacagtcccaccagcatcagcacattttgtatcagcaacaattattttgtcagggaagagactgcgaaggacctcaactaattcactacctacttgaagaaggcaaacagttccagcttcaataacatcaacttcatgtcctactgatacggcagctttgatagctccttgtaaatctgagtggtcaagtgcaacttgtaaatttggtaaacgttttgtcatgttgtttattctaaggacctgataaaaatactcattttatttgtggcaaagagtttcttatcacagagattttttataggtcctatcctttctattaatatcagtttattgattagctttctaaatctaaaccttctaaatatgggctgttttttgattcctctaccattgcaaggacttcttttgcttcttggcattccgtcaagcgctgaattgaattttccaattcaaaaagggcaataatttgagggatagcaacagaagtatgaatagctgaacttgttgcagcaagtgctaacaatactgagacttctttgccatctggaaaaactactggctctgttaatgtaattaatgaaaatgcatcacgttttacgcctgcttctggacgagcatgaggcatcgccatacccggcataagaatgtagtacggaccaaattcctctgtagattcaataatggcatcgtaatattctgcatcaacagcaccactttcaatcaatggatcaattgataatttgattgcttctttccaatcgcttgcagataatttaagacgaattgagtcattttcgataaaggcttgttttaaattcatgatttctccttaaaagtctaaagatatgggagagaaacttttgtctcactccctttgtctattaacttacaaaatttcttgtagttttgtttttatttcattgtcatccataaggttatcaagacctactaaatgaccttttgtacgtccgtctaattcatggataaggtggtttgaagcaaccacgatatcgtagtttgcagctaaaccttttgcttctccgactgagcaagatgctgactcaaagttgctaacgcctaattgacgaagcgcattttcgactttcattttgataaccattgatgatcccatgccgtttccgcatgctgtaagaactttaaccatttttatttcctccgttataaatttctattattctgcaggcgcatcaccacgatagtatgcttctttatctttagatttcataaattgaagttgtggaatagctaagaagaagagacatacaatcacgtaaccagcgatacctaaatacttgaagatgtaaccaaatgctaaccatgggaattcaaagtcgatatttccatgataaccacctgcaagtcctaaaagacctacagcaacagcaccaagtgccacctgaataatacctgagataaatgatagagctactgctgctttccagccaccacgtttatctgcataaacagcgattgccgcattatcaaagaatactggaacgaatcctgtgataatcaagattggatttttgaagacaacaagtagagcgattgtaattaattgaccaatcaaaccaaaagcaaatcctgaaagaactgcatttgaagaaccaaaaccatatgaagctgcaacgtcaactgctgggaatgatcctggaagaagtttgtttgagataccttggaaggcatttgtcaattctgtaacgaacatgcgtacaccttgcatcaaaatgaaaaggtaaactgagaatgtcaatgatgtttgaaggatgtacatgaagaaagcttgcttagttggtacaaatgcaccaggtccgattaatttaacattagacataatgtctggaccaaggacagctaagattcctccaaagaaaactagcatcaatgttgctgatgcaacaactgtatcatggaaaatatttaagaatgttggtaattttaagttatcaaggttttcttcttttttaccgaagaatggcgcaactttatcaacaaaccaaattgcaaattgttgttggtgtccgatggcaaatccgccaccacctgtaaggcgttgagttgcttcaacggtcatattagaacttaccgcccaatatagaccacaaatgataccaacagcccatgcaccaaaaccattacgaagttgtggaatcaagagcagtacaaatactgaaattgttgcagcttgttgtaccatgatatgaccagtaataaaaagagtacggactttagttactttacgaagagcaaccaagagaatgttaatcccaaaaccaatcaagagtgctgttgttgcaacactgataaagcccattgtttctaacttagcatttgctgatgctaaaccaaagtaagggtcaataacagcagcttctaaattaaattttttagcaagagcaactaagattggacggaatgtattaaccaatcctcctgcacctacgttcaaaatcaaatatccaacggtcgctttgataaaaccagcaaagacatcatgaagtggtttcttcaataaaagatacccaatgagtaccaatagacctacgaagaaggctggattctgcaagatattttgcgagaaccaattaaggggagctaggaagttttccataactaaagacctctctttatttaagtaatgtttttttgtatctttattatattttttgtaagcgttttaaaaaagaccaagaagtacacacttaagtgtgcaaaattgtgctgaacctaatttacaaaaaaatcatgtatcttaggatacatgtttttttatattttttaatgtagactcctaatgatttctacacgcgtcacaagaccatcgtgcatactatcaacacgcaatgcaacgttattaatatagactactgaaccaatagcaacgtccttttcctcatcatttaaatgacgaacaagtaagtctcctaaagtttcattgggttgacaaggtagttgaaccctagctaaaatattagcttttttgactttgttattagcacgtaaaacaatgttgcttgacccatcaaaatgggtgaaaagatatttacgaacagcaaacaaaatagcaactgaagcaatccccataaggtaatctgaaacactaccatgttcaattacaagttgacgagctaaggcaaacaataacacttcaattaaagtatctggggaaggttttgaaaacattttgatcaactcaatcccgactgctattgtcatggcgcgagcaaggaaagtctggaacaacttatcaacattttgatcaacagacaacatgctaaacaaatcatgaaagagtgctaaactaaaaaaaataatagctgttgccagaataactgacaaagcaatctctaaataataagccacctctacaataacatcttggaaaaatttacgcatacaatctcctcttttataaactaataacattataacatttcgtcgttaaagttactaattcaatgaaacaatagtgaccaccccttcattaaccttttaatcagtactaacgaatgtttgattacacattatgatataataagcttattggtaaataagtgggaggaaatgaaatattaattaataaacggttaagaacaatctccttactacattatctgttagcgctactacttcttatagacattatctttacgattgattttataattcacacgtcaacaatttccaaaaatagtctatcatatataagttatggtcaaggatttggttggtctatgattcttattaatttgatagctctacctatttgtttcctagtagaattgtcagctggtctactattaaaattagaaatgcataagcaacatggctactatcctctggaacgcttattgatgactggtaatattctaacagttgtatcgctagtattattacatactttgattcacaatatcaattcacttctttttttatcaattacagtagttttattgatttctgggaagtccttaagtcttattagtatctatctattaaaaagaaaaagtaaacatcaaaaagtctgactgtacagtcagacttttaatattaaatatttgaccaaacagactcaagaatgtttgtttgttcacgaccaggccctactgagaaagtagaaatacgaacaccaaccaattcgccaacacggcgaacgtaattacgtgcattttctggaagatcatctaagctacggcaagctgtaatatcttcagaccagcccggtaattcttcatagattggtttacaacgttttagctgttcaaggcttgctggataatagtcaatacgtttcccatcaaggtcataagccacacaaattttcaccgtatcaagccctgaaagaacatcaattgaattcagagagagattagtaatacctgatactcgacggctgtgacgcataacaacagaatcaaaccatccaacgcgacgaggacgaccagtcgttgtaccatactctttaccaatctcacgaatacggtcaccaacctcatcaaaaagttctgttgggaatggtccatcaccgacacggctagtgtaagctttacatacacctactactttattaattttacttggtccaactcccgaaccaattgtgacaccacctgctactggattggaagatgttacaaatgggtatgttccttgatcaatgtcgagcataactccttgtgctccttcaaaaagaacacgtttaccggcatcaagagcatcatttaagataacggatgtatcagtcacatattgcttaatttgttgaccatattcataatattcttcgaaaatatcatcaaattcaagaggtgtactgtcatacattttttcaaataaacgatttttctcagctaaattaattttcaaacgctcagcaaaaacttctctatcaagaaggtcagcaatacggataccgacacgcgcagccttgtccatgtaagctggcccaattcctttgatggttgttccaattttattatcacctttagcatcttcttgtagttggtcaagcttgatgtggtatggcaagataacatgcgcacggtctgaaatacgaaggttatccgttgttacaccttctccgtgaagataagctaactctttaactaatgatttcggattaacgacaacaccattaccaatgacagaaattttttctttgaagaaaattcctgaaggaattaaatgaagtttaaattttttgttatcaataacgatagtatgcccagcgttatcaccaccttgataacgtgcaattacttctgcgtcagcagataaaaaatctgtaattttacctttaccttcgtcaccccattgggtacctactacaacaactgaagtcatatttatttaacactgagtgagcctttttgggactccccaatcctttctggaaaaacatggcaggaatttcacctgcgagtttgtctgacaccttattatagcaaaaaatgtttttttttgccaaattcctcaaatattatcggaaaaaaagaaaaaaataattattagaagtgtaaaaaaacggtaaaaaactaacattatagttgataaagaaatcttgaaatttactgataccagcattcttaacaataaaaaattcaacgatctttttattagagtcgttgaattttaaattatcaagaacagttatcacaagtcagatatcatatctatattaatgatatttactattagcttttcatgaagtaactagttatctctagcctgtagctcttcttttgtaactaatttataatctttaaaaacaatgcctccaaaatagcctgctagtaaagataggataatacaacctagagcggttattagtacttttatcattgggttataggcaaacatgacagcaaatcctgcaattggtgtcgctgttccaggagtatcattaactaatttcatcaaggcaattaaaataccacaagctgcaccaccaacaaaattagtgacatagattggaatagggttagctgaagtcacgtcagcttgagttagaggctcaacagcaaaagctatattatctttacgacttccaagttttaatttatggaaaagtacaccattcataaatgacgaaccaaagacagacaaggctcctatagccataggcattccggttaatcctagcatagctgtcaatgccatagaagaaagtggtgctgtcgccactactacaattgtcccgccaagtataatccccattaaaatagggttgctatgagcacctgatgttaagatatctccaatggtgagcaaagtgctattaataagcggcgtcaacagtttggccacaagacgtgttaatggtgcaccaataataataattgaaataagatctaaaccaccaggaatatttctttccatccacttaacaagaaatcccactaaatatcctgcaaggaaaccaggaataatacctgttccagaaacagataaaccaattaaaactgcgtatcctggggttacaccaatagcaatagcaaccaatatagctgcagctacaccagaaagtgaaccattagcaccacccacttcacttaaaaattgaaatcccaaaactttaccaaagaaagaatcttgaaaagcttctacaaggaaggatgcacaagccgcagatgccaatgctcccattgcttttgttccgtagggtgctttataattaaataaagtgaaaatcgctaatacaagtattaaaagactggtcccaataatgatattcataaatatactcccgctaaaaatagttaagttttttattctcagtgtctgtgtactactgcttcaatttcaataaaggcgcctttaggtaatactgaaacttaattgtactacgaactggataaggtgcaacaaagaagtccgacataattattaggcttatctcatggattactccttagttgctaatataatcacattttacctaaaagcataaccatagtcaataataattttttattttattaacttttttttattacgataattttttattacattaatcttttaaaatagtctgatattgtcttttaaccataaatatattactataatagtaagattagcatagaggaactacgatatggataaagaaaaattagactattggaaaacgataataacgtttctccataatgttttaggtgataattacgaaattgttttgcatgtagtagatgaaaatgatatctatattggtgagttggttaatagtcacattagtggacgaaccataagttcacctctaacgactttcgcccttgatttaatcaagaataaagtttataaggaaaaagattttgttactaactataaggcgattgtcagccctctcaataaagaagttcgtggatctactttcttcatcaagaatgctcaaaatgaacttgaagggatgttatgtatcaaccttgatatttctgcataccaaaatattgctttggatattctagacttagttaatttaaatgttaacaaaatactacctaagtcccctcaaaaaatttctctccctcaacaggaggaacctgtagaagttctatcaggcaatattcaggatattattagtgagattgttgatcctagtcttttaaatcagaatattcatttaagtcaagaagttaaggtagaaattgtttctaaacttcacgaaaaaggtgtattccaattaaaaggtgccgtttcaaaggtcgctgaagttctcaacatctccgaaccaagcgtctatcgttatcttaaaaaaattgaaactcattaactctaaaactctttttaacttatagattaataagattggactcaaaagttcaatcttttattttttatgacaccggtataagattattttagttttctgtgccgtaaaacttagtttttattatttttttgataaactagtatcatctgttactaggaggaatgttgtcgtgattatcgatcgactgttacaaagaagccactctcatctaccgattctacaagctacatttggcttagagagagaaagccttcgtattcaccaacccactcaaagggttgctcaaacaccccatcccaaaacattagggagtcgtaactatcatccttatatccaaacggattatagtgaacctcaattagaactcattacacctattgcaaaggatagccaagaagccattcgatttttgaaagctataagtgatgttgctggacgctctatcaaccacgatgaatacttatggccgctttctatgccacccaaagtgagggaagaagacatacagattgcccaattagaggatgcttttgaatatgattatcgcaaatatttggagaagacttatggaaaactaatacaatccatctctggaattcactataatctcggtttaggtcaagagttattaacttctctctttgaattgagtcaagcagataatgctattgattttcagaaccagctttacatgaaattgtctcaaaattttttacgttaccgttggttactaacttatctatacggagcgagcccagtagctgaagaagactttttagatcagaaactgaataaccctgtccggtcacttagaaatagtcacttaggttatgtgaatcataaagatattcgtatttcttatactagcttgaaggattatgtcaacgatctagaaaatgctgtaaaaagtgggcaattgattgctgagaaagaattttattcacctgttcgtctccgtggtagtaaggcctgtcgtaattatttagaaaaaggaattacatatttagagtttcgcacttttgatctcaacccatttagcccaatcggtataacgcaggaaactgttgatactgttcaccttttcttattggcgcttttgtggatagattctagtagtcatattgaccaagatatcaaggaagccaatagattaaatgaccttatagcacttagtcatccattagaaaaattacctaatcaagcaccagtttctgacttagtggatgctatgcaatctgttatccaacattttaacttatcaccttactatcaagacctattggaatctgtaaaaaggcaaattcagtcacctgaattaacggtagctggtcaacttttagaaatgattgaaggactttccttagaaacatttggacaaagacaaggacaaatttatcacgattatgcttgggaagctccctacgccttaaagggatatgaaacgatggaactttctacccaattgctactatttgacgttatccaaaaaggagtcaacttcgaagtgctggatgaacaagatcaattcctaaaattatggcacaatagtcatattgagtacgttaaaaatggtaatatgacctcaaaagataactatattgtaccgctcgctatggctaacaaagttgttacaaaaaaaatcctagatgaaaagcatttcccaactccttttggagatgaatttactgaccgtaaagaggcacttaactatttttcacaaatccaagataaaccaatcgtcgttaagccaaaatctacaaactttggtttaggcatttctatttttaaaacatcagctaacttagcttcttatgaaaaagcaattgacatcgcttttaccgaagatagtgctattcttgtggaagaatatattgagggtaccgaataccgtttcttcgtccttgagggggactgtattgctgtattgcttagggtagcagctaatgtcgttggagatggtattcatactattagtcagctagttaaacttaaaaaccaaaaccctctcagaggctatgatcatcgctctcctctagaggttattgagctcggagaagtagaacagttaatgttggaacaacaaggatacactgttaacagtatccctccagaaggaacaaaaatagaacttcgccgtaattctaatatttccactggcggtgactctatagatgtaacaaatacaatggatcctacatataaacaactagcagctgagatggcagaggctatgggggcttgggtttgtggagttgatttaattattcctaatgccactcaagcatactcaaaagataagaaaaatgctacttgcattgaactaaactttaacccattgatgtatatgcacacctactgtcaagaggggcctggtcaatctattacacctcgaattttggctaaactgttcccagaattataactaaaaagagttccttaggctaagcttaaggaatttttggttaaaataaagttatcccttgtcatcactagttcatttaagataaaatattaacaactacagaaagttaggttaaatattattatggttaaaaaacgctattccaaaaattctcataatctaataacattacttggtattgttgttcttgcttccctgatttcagacttttggagtgaggtgattgctactctgttaattattggtggtggttattgtgcctattacgtttatgataaaaagcgtcttaaacgttttacatcaaaccaacgtattgaagctttaaaatccgatattaaagagactgaccaagacattagacacttggaaattttaaaaaaagacaatcgttctaaggaatatatcaaattagcacatcaaatattacctcaattggacctaattcgtaatgaagcaaaccaactacaaaaagccattgagcctaatatctataaacgtatcaccaaaaaagcaaatacatttagtaatgagattaacgaacaactaataaagctacatgcctctccagaactagaacctatttctgatcaggaagatgaaatgatacgcattgctccggaattaaaaccgttctatcacaatattcaagatgaccactttgctatcttaaaaaagattgaagaggcagataacaaagctgaattagcagcaattcatcaagccaatatgaaacgttttacagatgttctggctggctacatcagaatcaaacaatctcctaaaaattttaacaatgctaaggaacgcctagaacaagcattacaagcaattaaaaaatttaatttagatttagatgaaacgctgcgccaattgaatgaaagtgatatgaaagattttgacgttagcctaagaatgatgcaaggcgaaaggaacagtaaatgagcgatacctttaattttgatattgaccaaattgcagacaatgctatcactaaaacagataaaacaacagaaattatttccaaccagacaacaagccaaactgggcaaattgccttttttgaaaaactaacaccagcacaaaagtctgctatctctgaaaaaacaccagctttggtagatacttttgtcggcgatcaaaatgcgctccttgattttggacaatccgcagtagaaggcgttaataccactgttaatcatatcttgtctgagcagaaaaaaattcaaattcctcaagttgatgatttactaaaaaatgctaatcgcgaactaaatggatttattgccaaatataaagatgctactccggcagaattagagaaaaaaccaaacttgattcaaaaattattcaaacaaagcaagacctcgctacaggaattttattttgactcacaaaacatcgagcaaaaaatggatatgatggcagcgaatgttgtcaaacaagaagatactttggcaagaaatatcgtctctgctgaaatgctcattgaagataatactaaatctattgaaaatttggttggagttattgcttttattgaatcgagtcaagccgaggctgctaatcgtgcaagccacttacaacaagaaattctagcattagatagccaaacgtccgagtatcaaattaaaagtaaccaattagctcgaatgactgaagttatcaataccctcgaacagcaacatcctgaatatgtcagccgtctctacgttgcatgggcaacaacaccacagatgcgaaacttggtcaaagtatcgtcagatatgcgtcagaaacttggcatgttacgtcgaaataccattccaacaatgaaactctcaatcgctcagttaggcatgatgcaacaatctgtcaaatccggtgtcactgctgatgctattgtcaacgctaataatgcagcattgcagatgctggctgaaactagtaaagaagcgattccgatgttagagaagaccgcacaaagccccactgtttctattaaatctgtcactgcattagctgaaagcttagtggctcaaaataatggtattatcgctgccatagacaaaggacgtaaggaacgtgcccaattggaatctgctgttattaaatcggctgaaacaatcaatgattctgtcaaaattcgtgataaaaaaatagttgaagccttactcaacgaaggtaaatctacccaagaaaaagttgatgagtcttaacttactatcatatccactaaataaaaacgatactgtaaaacacagtatcgtttttatatcattaatttataccgttttcatctatattttcctgactatctccaatgcaaaataagccttttatgctataatatgacttatggataaaattataaaatcaatttcaacttccggttctttccgggcttatgtccttgattgtacagaaactgtaagaacagctcaagaaaaacatcagacactttcaagttctactgtagctcttgggagaacattaattgcaaatcaaattttagcagcaaatcaaaaaggaaatagtaaagtaactgtcaaggttattggagatagctcttttggtcatattatttctgtagctgatactaaaggaaatgttaaaggttacatccaaaatacgggtgttgatatcaagaaaacagctactggagaggtcttagttggacctttcatgggtaatggacactttgtcgttattaccgattacgcaactgggcaaccttacacttcaacaactccactaattacaggagaaattggagaagattttgcttattatttaaccgaaagtgagcaaacaccttctgccgtcggtttaaatgtcctcttagatgacgaggataaggttaaagttgcaggtggattcatgcttcaggtgctcccaggtgcttctgacgaagaaatttctcgctatgaaaaacgcattcaggagatgccttctatttcaagtctgctagagtctgaaaatcatatagaatctctcctttcagctatttacggagaagacgactacaagcgcttatcggaagactctttagccttctactgtgactgttcaaaagaacgttttgaagccgctctattgactttaggaactaaagaattgcaagccatgaaggatgaagataaaggtgttgaaattacttgtcaattttgcaaccagacttactatttcacagaagaagatttggagaagataattaatgactcaattaaatagttcatttatgattgggaaggttgaaattcctcatcgtaccgtactagcaccgatggcaggtattaccaattctgcttttcgtactatcgctaaagaatttggtgctggtctcgttgttatggaaatgatttctgagaaagggttactttataacaacgaaaagaccttacatatgctccatatcgatgaaaatgaacatcctatgtcaattcaactatttggtggcgatgcagaaggcttaaaacgtgcagctgactttatccaaagtaatacgaaagcagatatcgtagacatcaatatgggatgtccagttaacaaagttgttaaaaacgaagctggagctaaatggttacgtgaccctgaaaaaatttatcatattgttaaagaggtaacgtctgtacttgacattccattaacagtaaaaatgcgtacaggatggtctgactcatctaatgctatagaaaatgcactcgctgccgaatctgctggtgtatctgcacttgctatgcacggtcgaacgcgtgaacaaatgtatactggcacgtgtgaccatgaaacacttggcaaggtcgctaaagctgttactagtattccttttattgctaatggtgacattcgtactgttcacgatgccaaatttatgattgaagagattggagctgacgctataatggttggacgtggtgctcgtagcaatccttacatctttacacaaattaatcatttctttgaaacaggcgaaatccttcctgacctaccatttgagaagatgttagatgttgccgaggatcatctcactcgactagttaatttaaaaggtgaaactattgccgttcgtgaatttcgagggttagcacctcattatctgcgtggaaaatcaggcgcagcaaaaattagaggagctgtttcacgtgcagaaacactagcagaagttcaagaactttttgcaggtttacgctaaatcaaaaacagtcctttgactgttttttcctatctctgtacaaatttagcataaatcattgtgtaatgaaaactcaaaagtataacaaattattttagcataacagaattaaggagaattatgttgattgttttagctggaaccattggagcaggtaaaagctcccttgcagctgctctaggacaacacctagggacagatgttttctatgaggcggttgataataacccagttttagatctttactatcaagatccccaaaaatatgcttttttactacaaatattctttttaaataaacgattccaatctataaaagaagcctataaggctaacaacaatgttttggatcgttctatttttgaagatgaactattcctcactctaaattataagaatggaaatgtgactaaaacagagctagatatctataaagaacttcttgcaaatatgttggaagaattagaaggtatgcctaagaagagacctgatttgctagtctacattgatgtttcatttgataaaatgttagaacgtattgacaaacgaggacgcagctttgagcaagttgattctaacccagagttatacgactactacaaacaagtccattctgaatatccagaatggtatgaaaattacgacgtttcacctaaaattcggatcgatggtaacaaacttgatttcgtcaaaaatccagaggatcttcaacacgtccttgacactattgattccgaattgcaaaaacttgatttactataattaggtgatatctatgattataagacctgtcctaccctcagatgctaaagaattacttgctatctatgctccctacgttgctgacactacaataacgtttgaatacgatattcctagtatatcggaattcactaatcgtatcaaaaatatcagcaaatctttcccatatttagttgctgaagaaaatgggaaaatattaggttatgcatatgcttcaacttactacgctagagctgcctatgactggacttgcgagctttctatttaccttgataaagatgcacgtagcaaaaaaattggtagccaactatatgatacattggagaaagaattagttaaccaagggtatgttaatctactcgcttgtatcagtttaccaaatgatataagcattgcattccacaaaaaaagaggatttaatcaagtcgcacatttcccaaaaatcggatttaaatttgaacaatggcatgacattgtgtggttacaaaagcgattgaaatcttaaggtaatctttagatttattttaagttagcaaaagattaggatattataatatatttatcctaaaatttttcaacgactttcagtcgtacctatatctacaagtgcaattgttagatatagatccttttacttttcataaatctataagaaaatgtccaaaatattttggacgttttctttttatattaaaattccagtacccatcggtactggaatgttttatgattttgcaatatcaaatttcaatttgcctttggatacgccaatcttaattacttgcccctctttcacttgatttgccaatagtagttctgataaatgatcctctacttgcgtttgaatagttctacgcagtggacgagcacccatttctatatcatagccatcctctgccaagtgtttcaaggctgaaggctggaatttcagatccatacctttatctttaagcgctaaaattaaaggtttaaccataattttcacaacttcacgcatattatcttgactgagactatggaatacaactttctcatcaatacgattgataaactctggtcgataagcttttttaagctcctccataatacgtttttgcatagcagtataatcatggctgatatccttagctccaaaaccaactgttttatcgtcacgtaatgcagttgctcctaaattagaagtcataatgattatagtatttgaaaaatcaacttttcgtcctcgactatctgttaaaacgccatcatcaagcacttgtaataatacattaaaaatatctggatgagctttttcaacttcatcaaaaagtaaaactgaatatggtttattgcgtactttttcagtcaactctcctccttcatcataaccaacataacctggaggtgccccattcaggtgagaagctgcgaatttttccatatattccgacatatcaaaacgaattagggctgattcatcatcaaacaacacttctgccaaggcttttgctaactctgtcttaccaacaccagttggtcccaagaacataaaggaaccaataggacgcttaccagtacgaatgccagattgattgcgacggatagcacgactaatggcagtaactgcatcatcttgaccgataacacgtttatgcaattctttttctaaattgaggtattttttactatcagcttgtgtcaatttttcaacaggaataccagatagacgactgagagttgccataatatgatcttctgttacggcaataggcttacgctttttacccttataacttgcttttagagctttagaagcagatttcatatcatcatctaaaatagcttggtcaacttctgttaaaagcgaaggagcatttttcttaatcatcatttgcacagtggcagaagcttcatcaagtaagtctatagctgagtctggtaaattcttacttgtcaaataacgatgagccacttttacagcagtcataactgcttcatctgaaatagtaacattatgaaaggcttcatacgctggcttcaatccaagtagaatttcatatgcgtcttcaagatttggttcttctactaaaacttttgcaaagcgacgagataaagcagcatctttttcaatatgcttttgatattcctcttgagttgttgctccaacagtgcgtaaagtgcctcgggccaaagctggttttaaaatattagcagcatcaagtgtgctatcaataccagagccagaacccataatagtatgcagttcatcaatgaaaagaataatatgaccgtcttcttcaatatctgcaatgatttgattcatacgttcctcaaaatcaccacgaaaacgagttccagcaacaacgctcatcatatctaactctagaacacgcatatctctaagctcataaggaatatttccattagcaatacgttgtgctagaccgtacgccaaagctgttttaccgacacccgcatctccaactaagacaggattattctttgttttacgacttaagacttggaccatacgtgaaatttctttatcacgcccaataacaggttcaatttccccatcaaccgccatctgtgataaatcacgtgtgaaatcagctaaatcaccagcagtactcggtggtttcatcatatcagaaaaagaagcacccgactttgcttttttaggattacgtaattcataaattgctttgatatcatcttttgtaaaaccggcatgacgttctagagccttacgtaaatcaaccatacgaactgattcaccatcgtcttgacctctaaagccaactaactctaagatacgtgtggctaataaatctttattaaccaacatagcaagcaagacatgttcagtacccacatcttcagctcctactacgatactaatattttctgctaactttaagatctttttcaaagctggtgattgctctaaaaattgataattggtaatctcttctttcggtgctctacctaaagctaaaattgttgctgcttcgtactcttcaattgcaacttcagactcatattcagcaaatgtcaaaccagctactgaatcatgaactaaaaccattgctaaaagaagatgccagctttctaaatagtgactttcatagcgtgctgcttgaaattgcgccaatctgaatacttcttgtaattttatggaataatgactcataaatggaatccttttctatctaatcgttgtaataatttacggagcatacgagctctaataacagaggcttgctctcctaagacgtcatcacctgatgtcgccagaatcaaatttccttcacgttctgtaattatctcttcatcgaataataattgaatcaaatcatcaaaaacttgttcactgatacgctcgccaatcgttgataacatatttccaaataattggtgttgatcagaaaaatgaaccttagcaatgcggatgtaacctccaccacctcgtttactctcaaccacataaccacggctttcagtaaaccgtgtcttaatgacataattaatctgactaggaacaacttgaaaagtatcagctaaattggaacgctttatttcagcaattcctgattgttctaataatgattttatatattcttcaatattatcggaagtattttttatggccacaaattcactccttcctctttgactataactgactattattatatcaaatttttaaaagatacggaaatgaaatctatctaaggacagtaaaactagaatgaccgcggattttagttgtcattactagaaagataagataaaatggaataataccatagaaaggttttatttaatgaattacattattacatttttgatttcaatgattcccttagtggaactacgaggagctgtgccatttgcaatcgctaatggaatacctttgtgggaagcgctagctatcggtgttgttggaaacatgctacctgtacctatcatcttcttctttgctcgcaaagttctagaatggggagcagataaaccttatactggtaagtttttcacatggtgccttaaaaaaggacatagcggtggtcaaaaacttgaaaaagtagctggagaaaaaggattgtttattgccttgctattgtttgtaggcattcccttacccggaacaggagcctggactggcacgcttgcagctagcctcctagattgggaatttaaacatagtgttattgctgttatgctaggtgttatactagctggatgcatcatgggaacattatccattatcggcttcaacctattctagaaaagttaaggtgagatgactgtctctcctttttaatatttgccaatccaccaattcgatagcaaaataagacacttgacttaagccaagtgtcttattttaaaatatatttactgacaacattttgctgtcaaattataatataaagcgagtgttaattatttttcaagtgctgctgccattgtagctgcaacttctgcttcaaagtcgttagaagctttctcaataccttctccaacttcaaaacgtacgaaagcaactgctttagcatttactgactcaagataagcttcaactgttttgctatcatccatgatgtaaacttgagcaaggagtgtgtactcttggtcaactttagtgttgtcaagcatgaaacgatccattttacctggaacgattttatcccagattttttctggtttaccttctgcagctaattctgctttgatgtcttcttctgcttgggcaataacttcatcagtcaattgagcttttgatccatatttaaggaatggaagagctggtttgttaaccatagcacgactctcgttgtcttgctcaattttgtggttcaactgtgctaattcatcatgaacaaattgtgcatcaagttcagtatatgaaagaacagttggcttcatagctgcaacgtgcattgatacttgtttagcaagtgcatcgtcgccaccttcaacaacagtaattactccgatacgtccaccattatgttggtatgcaccaaaatgttgctcatcagtcttttcaactaaagcgaagcgacggaatgaaattttttcaccaattgtagcagttgcagttacaaatgcttgttctaaagtttcacctgaaggcattgttaaagcaagtgcttcttcattgtttgaaggacgtccttctgcaataactttagcagtttcattaactaatgttacaaattggtcgtttttagcaacaaagtcagtctcagcgttaacttcaataactgctgcaacgttaccatcaacataaacacctgttaaaccttcagcagcaacacggtctgcttttttagctgctttagccatacctttttcgcgaagtaattcaatcgctttatcaaggtcaccatcagtttctactaatgcttttttagcgtccataacgcctgcacctgatttttcacgcaattcttttacaagtttagctgtgatttctgccattttcgttctcctcttaatttcaaataatgattaaaaaaacgagacagagcggtttgcatctgccccgttttaggatttacaataaattaaatattagtcgttgtttgatccttcaactacttcaacgatttcttcaattgaatctgcttgtgcttcttgagcgaagtcaacgtcagcatcttcaccttgacgaccttcaataactgcatcagctaatttagaagtaattaatttaacggcgcgaatagcgtcatcgtttgctgggatgataacatcgatatcatctggatcagcgttagtgtcaaccatagctacaactggaataccaagttttttagcttctttaacagcgatttgctctttatgtgggtcaacaacatacattacatctgggatgcgtggcatatcttcgataccacccaagaatttttcaagacgtgcacgttgtttgtttaacaatgcaacttctttcttaggaagaagttcaaaagttccttcttcttccatacgtttgatttctttcaaacgagcaatacgtttttggatagttccccagttagtaagagttccacctaaccaacggtggttaatgaagtattgaccagcacgtttagcttcttcagcaacagcttcagctgcttgtttcttagtaccaacaaacaagataactgcatcgtttgctgcagcatcacgaacaaattcgtaagcttggtcagctaattttacagtttgttgaaggtcgataacgtggataccattacgttctgtgaagatgtacttagccatcttagggttccagcgacgagtttggtgaccaaagtgaacaccagcctcaagaagttgtttcattgaaattactgccatgagtaagttctcctttaaaaatgttttttcctctctcagacttcgacttgcagcctaacctttcggcaacaagaccacaattgatctaagatgagtatttgtcactttaagcaactataatagtttatcaaaaaaagttagatttgacaagctataaaatcttctactctattagaaaaatcatacttttcttagaaaaatgtaaacgtttttattggagatttaaaagtatttcgtttataattaggctattaaaaaataaaggaggacattattatgtcattagtcggaaaagaaattattgaattttcagctcaagcttatcacgatggaaaattcatcactgttacaaatgaagacgttaaaggaaaatgggcagttttttgtttctacccagcagacttttcatttgtttgcccaactgaacttggtgaccttcaagagcaatacgaaacacttaaatctcttgatgtagaagtttattctgtctctactgatactcattttgttcataaagcatggcatgatgactcagatgtcgttggtactatcacatatcctatgattggtgacccttcacaccttatttcacaaggttttgatgtccttggacaagatggtctagcacaacgtggtacatttatcattgatccagacggtgtcatccaaatgatggaaattaatgctgatggcatcggacgtgatgcaagtactctcattgataaagtccgtgctgctcaatacatccgccaacatacaggtgaagtttgtccagctaaatggaaagaaggagctgaaactttaactcctagtttagaccttgtaggtaaaatttaataaccaggaggtaatccatggtcttagataaagaaatcaaggctcaattagcgcaatatttagatttgctagaatctgatattgtattacaagctgatttaggagataacgataattctcaaaaagtaaaggattttctagatgaaattgtcgctatgtctgatcgcatcagccttgaatcaacacatttaaaacgtcaacctagttttggaattgcaaaaaaagggcatgaaagtcgcgttattttttcaggcttgccaatggggcatgaattcacatctttcattttagctttgttgcaagtctctggtcgcgcaccaaaagttgatgaagatattatcaaacgaattaaggggattgagaaaactatcaatctagaaacttatgtttcattaacttgccataattgtccagatgtcgttcaagcctttaatataatggctgttttgaatccgaatatcactcatactatgattgaaggaggcatgtatcaagacgaagtcaaatcaaaaggtatcatgtctgttcctactgtttataaggaccaagaagaatttacttctggccgtgctacaattgaacagcttttagaacaactagatggacctcttgatgctgaagcatttgctgacaaaggtgtctatgatgttctagttattggtggtggtcctgcaggtaacagtgctgcaatttatgccgcccgtaaagggttaaaaacaggtattttagcagaaacttttggtggacaagttatcgaaacagttggtattgagaacatgattggtacactgtacacagaaggccctaaattaatggctcaaattgaagagcataccaaatcttacgatattgatattatcaagagtcaattagcaactggcattgagaaaaaagaattagttgaggtaacactggctaacggagctattttacaagctaaaactgctatcctagctctgggtgctaagtggcgaaatatcaacgttcctggcgaggaagaattccgcaataaaggtgttacttactgtccacattgtgatggccctcttttcgaaggaaaagatgttgctgttataggtggtggtaattcaggtatggaagctgctttagatctagccggtgtcactaaacatgttacagtcctagaattcttacctgagctcaaagcagaccaagtactgcaagaacgagcagctaaaactgacaatttaactattcttaagaatgttgctactaaagatatcgttggtgaagatcatgtcactggtttaaactataccgatcgtgatacaaacgaagaaaaacacattgatttagaaggtgtttttgtacaaattggtcttgtaccaagtacatcttggctcaaggatagcggcattgaactcaatgaacgtcaagaaattgtcgttgataaatttggctcaacaaatatccctggtatttttgctgcaggtgactgtacagatgctgcctacaagcaaatcattatttccatggggtctggtgccacagctgccattggcgcatttgattatttaatcagacaataatctaaaagagattgatacaatgggtatcaatctctttttttgggtaatatgaggaagtttaagggctaaaattggctattttacgaaagaggcttgacgaatcttttttttttcgatagaatattatctgttatggcggtatagccaagtggtaaggcacggctctgcaaaagcttgatcgtcggttcaaatccgtctaccgcctttcagtacctgaattaacaggaattaaccgaatgaaaagcctgattttataggcttttttgattttccatcaggttaaatcaggctaactttaaaaataatttggggcgaatttggggcggacggtttttcataggtcaatttttgaaaagtattactatctattttcataattttttatacagaaaaaagcggccatcttgaccgctctttcttatacttgcaattcctcacggattgctttttgcaacagctggctaaagttgaccttgttttcttttccaacttccacaagccagcttggcagtgtgacagtcttgttgacaatcttagagcgttcacgctcacggacaagctcagtatcaactgaaatagcctgaatcacatcttcgtcacttgctaaattgcttgcaagagccttgaatgatgatgctttaggaaactctttgccctcgtcttcaaacataattgtatagatttcaaggacttcacgagcgttaaaaatggcctcgttcaagctatcagcttcactaaatgctccatgaaaatcagggaaagaaatgttatagccaccgttttctttatccacttcaaacaatgctaaataagtgtatttcataatattagattaagccaatgatcagagtatccccttttaggggtacggggaggagcgtcctcactccccatacaagactttgagaatgttgttcagtgtgcctggtctgtaatctttttcctttggcttaggtatcgtcactgtccgtccgtctggatgtttccaaacttcgtgtgaccctttgccaaagttagttttactaaaaccttgcttcttagcaattttcttaagctctcgctctgtcattggcttatctcctttccttatctttaattgtattatacacttgttttaaacacttgtcaatagaaaacacttgtttttaacaaatatttttaaaatttttaacaaaaaaagtccattataaccgatattttgagggaagtccgttataacggaaaaacagcccccggcaattgctgagggcttattttgtcttatcgtatctaattctaaactggctttttagtcagttcataagtgataccgttgatggtaacttcaataccttcaatagtaatgtcaatcttgtctttgctaccgtcaccaatgtcggtagctttatcaaacttgtccagtgaaccattttctgcctcaatagccttgaggcggcttgaagctccgacaatatagctatcaaagccgcttgcagcataatcatagacagcaccgccaactttaaacattcccttgatagcctcactgaaggttttagcaccagacaccttgtaagagccaccagcccttagaagataaaaccagtctgtcagaaagtcatccacgcttgcatagtgcatatagtgaccgccctcatttgaaggacgtgcggaaccttgtgtgacagtgacaccgcttggacggttgccttgaccagtccaggtcataccgccccagttattatctgccttcccaactgctgaagttccccaaagaccttcatagtgtaggatagtcagtgcataacttggaagaatatcatgctttttacagttgcccagaatcttgtccagcaccgcttttttcaagatagtcccattgaaagagaggtcgccctcttctttggtggctgtggcttgtccagttagctctgtttggcttgttttggtttccgtgggcttgtttacctcttgagccttaaacggctcagagggctgttttttgagcaattccgtcactcgtttctgaactgcatcatattgactaccaagcgactttttacgagcttcaccgttgccatgtttgccagcgattacctcttgaacaagttggtcaacagtcttttgattagtcgtagttttgccattgatgactgacataacagcctcatattgattgccaagcactgccttgcgtgcttcgccattaccgtagttaccagcaagggtttccttgaccaaggtatcaaggctttttccttgggtagaagctccgcttttcaaacggtaaacgtagcaatacatccagccactagcagccgctgtctgattgtagttgttcactgtgatgccattatttgcccagttacagtgaatgatattttcagggtcaataaacatgactacatgaccaccagctccgcttgagtgccctcgcatgccccaaattgctatatcaccacggacagcattccaatccacgttttcagcaataagctcataaccgtttttaatcagccaatcgtgcatgtactcagtgttgaccgcccaacctgctgagcttgcaccagctgacctgagagcataatagacagagctggaacagtcatagctgttagggccgtcacggtagtccatggaatagctgaccttgccttgacgtgcagacatccaggcaatggctatttcagtgttgatttccataggttactccttccaggcatcgtgcatttgtttgacagctgattcaacaaacaaagtgagatcatcgtctgacatgtggatattgtatttttgcaactcagctaaaatctgagccttagcagaagttagcttgtcagctcctttgaagccagtttcagtggccacttgctccacagcattaacagcgttcttggccaagatttctgtaatcaagacggccttttcaccgccttttttaatcaaataaaccttgacagcttgcactgcaattcctgccaaaatggtcaaaattcccatagctgagctgatgataatatctgtaatttgtgtcatgtttagtcctcctcaattggtaactgtttgaatttctcaaacaaggcttcaatttccccatttccgccaagcagttgataactctcaaagagaatgctcaactccctgaaatgttcaatagttgtgtagccttgagaaatttcctttgtcaaatcgtgaaaaagacggtaacgctggattttaagcgtaccgtcttttgtgatttctgaaattttctttgtttccgtggttgtatgatcaatcgtcttaaccttgtcaatcaagccagacaaatcttccttgatatcctcatactgatgttttatcagctggtctttccgattggctgaagtggtgataatagtgctgaacagaccgcccagcaccgtcaccatcgccacaaccacagtgctatctattaaccatggtggcattcactatctcctatcctgtttattttagatgagcttacttatcctccaagtgaggctcagtccagtcaggatttccgttctcatcaaaggtcatgatgtagtattcaagattaaagaaatcagctatgttgattgtgggtgttgtcccgccccattggttaaatgcccagacagtttctacgtccttgaattgacggcggccattgacgatgacaggacgtttctgcatgtcacggtacatgtagaagtcattgacagcattcttgcaacggatgaactcaccattttccttcatgtacttgagtgctgtcgccaagtcaaagggttctgtgattgtttcaaggtcaagtaaattattttctgttgtagtcacggttattctccttcaatgatttctggttgagtttgttcatcaagcaagccttctagttcggaaactcttgcttgaagttcagcattttgctgagtcagttgctgtttctcctgaacaacttcagtcagctggatagccagcaagttcttagtggttgactcattggccaactgggctgtcaattcattgaccgtcaagcgtagcgcttgattgagttgttgttcttggttcatgattgttcctttctagttagaaccctgaagggtagtaagtgtaagagtcagcatttgggccttttgagaagttctcattgaatgagttcaaaatatctctgagagaagaataggatccatttccttttaaaatccagacatcaccaacctcaattcggctattgcgttcagcagccctattgtgtggtgtgattttcaagcctgaatcaagtgtccgaacatcccaaccatctgaattgtcaaaggcagagcttgctaatcggatttcatcaccaactaagtcaagtgagtcaatgtttgagccgttccatgcacggactccaacaaatccaccatcattggttgattctgtaccgtagcggttagaaccaatgaccgtaacaccagcatttcctttaccagatactgtaccagttgcgaacttaacaaactgagtaggatagccactcaaaacccgtttcagtgcagcttggtcagtgtagtaaagtatctgaccactgttcatctggatttccatggcattattcaaagctttaataacaccgcccgaaatctgactggcagatattgtcacggattgaacctgagtgatgaaggctgacttggcaaatagttgcttcaagtaggcatcgttggccatcaacttgttaaagaaagcttggtcgactttaagtttttctgccgttacagcttcagctgctaaaagcactcctgtgattgctccagccttaacatgtcccgtttcgacagcgcctgttaccaacttacgactagttacagaaccatcaaccaacatgttcccgctaacttttatcagtgagctaaacagagctatagcatcaggagtgaccttaaagtaagagccaatagctcttgccacatcattactcgtcttgcctgctctcaggacaatcccttcagaagtcatagtaatatcagtttgcttaagagttttatgatcaagacttgttacactagctttaatctcattagctgtctgttcaagcttagtatctgagtaggctttcaggtcatctggagatggactccagtccgcaggaattgtccccttagtcacacgaagtgttgtcactctaaacttaagttggctatccgtaaatctaattttaagggagtttgccctgaaattggcattgtttgccacaaaagatgcggtataggtaccacgatttgatatcgttctctgtacctcaccaacccgttcgattttgcctgcatgtccgtatagctccagttcataagaaccaaaagccgtccgactatccgcaaaatagttaaatgcaatagttacagtatctcccatttcaatcccttttacggctaaggtagtaccgaagctataaaggtcatagacggtagtccctgaaacgtttagatagacatctctttcagtccccaaagcatagttctgtgtccctgatgacagactttcaaagcgtcttatcaaacctcttgcattttcctcataggttgacttatccacataagagccattaacctctgttcgtaaggctgatagctgcttagcggtttcagacttgcttgcttcaaagtaacgactagctcgatttggttcactatctttataggtctcaagactaactaaacgattgctaaaggattccgacgtctgcctaatgctagactcagcacttgtcagttgacctgccaaggtttccgtacttgttctaaggttggctaagttttcatcaacggtctgcttgtattcggcgaagctagcttttaaggtttcatcgcgattattccagtctgtagcaacggtaccacgttccagcttaactttcgagagcgtcaaggggttagcatttgtcccccgcatcacaagccaggcttggtttctagggtcaggcataacaccacctaaatcaaagctctgagagataaagcctttccctggagataagtcaaagttaggcatgacaataattgtaatcttactagtgtccccggtgtgcatctttttataaagtctaacttctaaacgactagttgattctgcttcatagctaaaactcaaggtcgcttgactagttcgttcgagtagttggggattaatatcataggtcttaccatagaagttagccattagttctttaggttctccgccgtcaatgacataattatagccaccaacagagaatgactccagtttcgtgctaagtcctgtcagtttatcctcaacccgctttgtcgcaagttgttggacgctatcagcttcctttagccttgtctctgcgtctctaaggtcgtttagggctttttgcttaatgatatccatattgtgactaagatttgttagagagatttttacagcttctgtgcttgtgacttgtctatttaattcagctctaagctctatttcttttctggtcaagtctgcttgtgcctgactggctaaattcttagcttctgtcgcaaggggaagaagctgattatccatgcgattagatagttccgatttaaagctttctactttggcttttgcgatttcgatatcatcattaatttttgtttttgttttaccaaactctgcatcaaaggcagcgttagcatttttcacagccctttgaacagcaacgtcctgagctgtggcacttgctacaagtatagcatcagcaacattagacaagccacttgacaccccagaaccaccaactcctggcttatcatcaaaagttatggagatatactcttccgttaaagcgttaaactcgtaggcaatggccttcttgtagaggtcagcactgtgctttctactcttgaggttaaccgtgtcgcccagatttacaacttgaccgtcaagctcataggcttcaatctcaatggcatcagaaaccttatcaatgccctcatttgtaaacttagcctcagcccactttctaaggtcttcaacggtttcagcgttgttgttctcatactctttctcattgatgtagggataagagtttattagtggactgtcaacagacactctgagcgtcacttcatcttcagctccatcaggtttgaaggttgaccgtgcatgaatccttgtgacaacaccctgagagttcttggttcgttgataggatttgaggttcttgtgtgttgtgatgacaacaccacgatcagccccacggctacgtttgatagataaggcaaagttatcacggacaagctcaccttcccacgttccaacaatactgtgtttaccgtccataaggacagagtagagcgtttccgtttcagtcgtgttaaaggttcggctgtccataatatcgctggtaaaggagaaatcacctagcccagtcttagcattttgaaccatctgagacagtgccatagcacagccttgaccaaccacactcacaggagtgatagaccgcttcatgatgtcatcagagacatgataggcagtgatgtccatgctgtcgtcattctcaataggcttcttgatacggaacagctgagcgcccagcacaggcacaggcgacttaatcagcatatcctctttgataagctgatagatacctgaatccgtgataggatagcgaacagtcaggtagaaatcaccgttggtttcttctttgacaatggcagagctggcttcatgtagtggaatgccattccatttgaccgttcttacatttgcatcaagtaaaaagagcaactatgcccacccccaaactgtttcaaatttcaaagatgttatgccagcacctaaaacaacaccgacattctgccccttagcagtatcaactgtgataaaatcaccagcccacttaatgagttttccactagccgtcttaaagctaggattgtcaggatcattggtcatcacgagcgattctgagagcttttcaagcttaatcacttggttacctatcgtaaacgatgtctcagaagcgctctgaccaaccactgtaatcttcggaaaagcaagagctgacccttgaaccctcaaaaccccattaccagtcaatgtctggatgtcagtggtcttgaaaaacttggtagggtggcagatgaaggtaacatcgaccacccaggcaccaaattcgtcttttccaatctcaaagctatcaaccttataacaccaaagcctaatagttggttcctgttcattttccaaccaaaacttttcacggttcaaaagagcagaaaagcgataaatttcttcatcgcttggctcaattaaagtgatatgataaggcttctcaattagtccacggtgtctattcgattgcacaactgcaccactaataccatcatgctctaatagagctgttttggagctggagacaatgacatttggtctagtttcaaccaatacatcacacttaaaagatgatgttttcacaccgtcaatggtaagttcattgatttttgtcatgccattcctcctctcaaattagttttacgttgcaattcttcagcaatacgatttccaaccacgttggctagtctgttaaggtcagcttcttccctgatagtgacgccagagaagttaacgttaatattgttcgatgtattcatcgtgttagcaatactttgaccaattgcccccagggttgacttattcaatggcaagatggcttcagcgccagcctcaccgccaaccattgcacggtttccattcatgccaaatagggttggtttggtcatgataccgcccttggcataccagtcaatgccgatacttggtaagccaccttttagccaatccagagggttagcagaaccactcacacggaagtgaggtagtggaatatgaggccatttaatctggaagttaaacagattcttgatggcattgaccccgttggacactgcatttttcgccccatctattgcattggaaatagtggattttatggaattccaaatattgcttgctgttgaaagtatcccattaaaaattcctgaaatcgtgctactcaaattattaaacaaatttgacccagttgagaccagtccagaccacaaattggaaagagtggaagtgaaacttgaccacagagactgagcacctgtaatcaaacttgagaaaatattggacaaggaactagtaaagctagaccacaaagactgtccagttgagactactgaagaccaaaggccagaaagccaggcagtgaaatttgaccacgctgtggtggcagtcgtgactatgttagtccacaattcagaaagccaggcagcacaagaatcccacgttgactgaagccattcagttatggctccccagttcatgattgcttggatgataagtgttatgacggcaatagcccctactattgccgccactacaattccgacaggcgcacctattgcccctatggcgatgaccagcggtgcaattgcaccaagcaacatcatcacagcagttgtaactaggccaagaatcacgatagtctgttgatcagtttcgtttaggctagtaaaccaattgacagaagattcaagcatacccatcaaaggttctaaagctgggatgacagtctcaagcaatttaccgccaagttctgccattccctcttttgcttggttagaatactgagtcaacttatctattgggtcaagcgtctcatcaaatgtggtggagacagtaccagaggaacttttagctgcttcagctaagtcatcaaagctaaaagcaccacgctgaatagcatcgaccattctaggagcagccttactaccaaagatttctgaggcaatacttaaagcctctgtctcactagtagaattttgaatagcactaacagtctcattcaatccatctgtcagagtcttaccgtctttagcatagatgacagcagctttcgatagagaggatagagcagcagatgaatccacaccgcttttctcaaacttaccgatcagtgcagcaccttcttcaaaagaaagtcccaaacctttaatctgaggagcaccgtcaatggctttttgaacaatcgtgtcaactgactgtcctgtatcttgagcggctttggtcacattgtctaagaccattcccaagtcttcagctgtcaaaccgtaagcttcaatagcttgttttgcagaaatggcagagcttgaaatgtctgtttcgttaatctcagcatacttgataagtaattcagatgctgatttcagcttttccccagtcaaaccgaactgagtattcaattccccaacggcatcaccagcattctgaaagctggtaggcataccagtagcaatgtctttagcaatttcctgaagctctgctaaggcatcaccagtcagaccagttttggttgtgacggtgtccagagcctcatctatctcagaccaagcatctactgtcattttcccagcgtcaaccattttctggccaatctgaccagccttatctgcaacatccatcatgacatcagctcttaaatagctggttgcctctttgatgtctccagttgcagaacggcttgactcaccaagaatgtccattgcacggtcaatctttagaacttcaacttcagcttgaccgatttcattttgaagttgacgccattcttctgtacctattttctcatcgccaagggcagcttgttttttctttaattcttggactttatccccagccaattccgactgtttgccaagtagtttcattttttgctctgctagttcgacattgtcagggtctagctcaagcttttgattgacaatatcaagctctttagcaacattatcaagttctttgttaagattcagaatagactttgggtctcctacatcttcaatgtgtttctttgttgactccattgccttatcaacaatcttcatctgtgattcaaccttagcaatttcaagttgaagcttattccactgtgctgacccaacttcagattctcccagtgccttctgttgctttttgagttcagcaatttttatagcaccaacacgagcctgttcttgcaagttaaccaacttacgattcaacaagtcaacattgtctggatccatcttcaattgtctgttgatgttattgaagtcttttttcaaactagataaggcagtgttgataccttttacagacctatcaaattcaacagtattagcaccaaatttgacgtataagccttcaaacgtttcagtcatagatttcctcctttctttttaatctgacatcacgctaagtaaatcagcgttggataaggttttcttttcttcctgattgatgctcatttggtgaagcgttcccatcaaatagttaaagtgttgggattctgcccaaaaaacatccatccgattttcaaagataaccttataaaccttttcggaagttacaacttctgaagaggcttttttttatcttgcggcacctttgctctgcttcggttaaattcatagaagaggtctgagaagaaaccaatatcaatcaaatcaccaaaccaaggagctaatgaagctgtttcagcggtaagctcattttgtactaaacgtccattttcaacctcaccataaaggcaaggaatgacttcagtcaagaagttcatgaaatcaggttccataagtagaggcatcatcttgattttctcttcatcagttaaatcagataggttacagtttacaccagttgcaagagcaagttgtgtatatgctgtaagtgctttttggttgtcatcaaagaagttacgaccagttcgctgttcatacatcttgatagctggtaaagagtaaagaaagcgcactgtttcagtgtgctctctttcttcaccgtaactatcaaacgctgtgaatgatagttcttttttaatcattaagagcctccgctaacagttgtggtaggtgtagtggttgttccaagcgcttcattgatgaaatcaatcagcttgcctggtgacttgtcagcaaacaacttgtcaaacttcccacggacggttcctttgctgtcatcacgccatacaatttctgatacaggtttcttttcagaatccacaatgaagttatttggagaggcagtacaagggatttcaatttcttttggtgtcgctgatgtttcatcagttgatgtgctgcctttaggtgcagatgccttaacgttcgtccaaatgtggaactcttcaatctcagctccaaactcatctgtaacagtttcagcataaccccaaatgaagttagtattgacaccagtatcaatcaaagctggtggtgtagagttcgtaagctttttacctaagtgatcaatcataaactgtttaggaatctgataggttgtaatagacccttctgtggattttttaccttgcaaacgaacatgttccacattgtctgcatagtaggcatttgattcctgagaagtttcaaaggatgtgcttcgtagccctgtaaagggataaggtttctgcaagtctaaggcaccagcatcagttttagcaattttggcataaaaaccattcgcattaccgtgagtgacttcccttgtatcgtattgataagtcatgtaagactcctttcttatttaggtgtgattttaatggatttcatatcattaaggaatttctccttattcttgaggtaggctggtctgatatgctctctaggggcaacaaagccaccgtttttagtggcatgaccattctctaataggtgggatagagatttttctttgccattattatgaacaacagcggcgtcatctatgatgtcgtgtgtccaacctttttcgtaaacaccgtttcgtctagggcttccagttctaatgtcattttctgtactttgggcagccttcttaatgttctctaaaacttgattcttgatatccacctttagcggtgtcatcttcacgctaccaccgcccatttgtaaacacctcaagtctgtaagttgtcagtagatagtcagtgtcaggttgttttagattcaattgatttggctcacacataaaattagacagcatcaaattttcaatgttgtctagtttcttcttgtggtagtgactaacttgcaaagtcacttttctcatgtgcactctatcatcagcagtaatgctactgcctggtgttaaccgataatacaagatgacattgtcaggagaagatttctcctcacgttccatgtagaagaccttagccttcaaagggtttgtttcaaggatagattgaatatcttgtctagtgaaaaatttcttggccattatttcagttctccaagttcgatgatagtgtaatgaccatcatctgattctgtcccaatgttaaccttgtactctttgccattatatttgacatagtcaagagtgtcagtcacatagttggaacgaacactaaacctagcagtcagaacttgaccgtctgccatagctttatcaagccttcgctgatagattttctctttctcagctttgactttcttttctacggtctttttctcccagacacctttttcaacctcaacacgctcatcatagcaaagaatgatagctactcttgaagatttcatgtcttcacttcatagattgccttgagttgatacaaaagatttgtcatctctccgtcaatccattccatagtagcagcactgcctgtcatcaaagatttgtcaaaacgttgaacgcatctcagatgtaaccagtcaagcactgtctccctatcttcttccttaatgtctgtccatccctctaactccgtttctttatcgatacggataacaggaatagcatttctttgtaaatatgaaatcccactgttgatatatcgtaaaagttggacgtcaaagatatcctcttcaacgtcaacttctaccatttctttgattgttttaaggattgtcattcagactcccctttctatatttaacctgctgggtttgtaaacttaaccgctgatttgtactgagccaaacgaccacccataacactagcaagctcaatatgacggcggttgactgttacatcataatcatcaaagcggtcagcggcagcctcatcaccaatcatcttataagcttggtcagcaaatgcaatgattgggttagttgcaccgtccatccagtcatagatgtaaacttgaaaaccagcaataacatttccgttggttgcaattggagcaaatggttgaggatcgatgtagcgaccttctgcatctttgaccaatttcaatttacgagcaatggcttttgaagtgacaagaattggagtagtatttggaaccatcttatcaataccagcaaccagcgtttcaagaacagcattgtcaaatacaccagcaacattgatttcttgtgtttcaaagagattcgcttcagtttcttcagcaattgatttgatttcagtgattttgtcttcagcactgttagattttccatcaccaatgacaacagcacgttcaatagttcggatgaagccttgagcaagttctttcatcacatagttgaagtaagcgcctgttgtatctttcttcaagtcagaatattcaaaggcatatttgatataaactgtcgcagagttgatagtgaaatccaagaatgtgaagtcttcatctttcttagtcttaccagctttgtgtcctttagcttgagatacttgagtttgaagagcaacacgcaccgcataacgtggatcttttgaaacgtggttcaagatcccattatagttagtaaaggcatcttgaatagcgataagaacaggttctggaagaatcttagtgaggttagtcactcctttttcaacaaggttagcttcccacgctttacgggcactgtttgcgctaccttcgttgtccatcagaatacggacaaagtcaagagcagcggctttggttttcaaataatccataggtgtattacctttctgtttttctttaatgattttagcagctttgctgagttcttcttcagtttcttcaatgtcagaatccagcccagcaattgtttccttaatagctgttgcttgagaaaccaaactttctgcatcagtttttaactgttccaagtcatcgtcttcaatggttgaagatttcatctttgcttcaatagtggcttttttaagctttacctcagccagttcatcagttgctttttgacgagcttccaaaagctcaatgagtgattttttcatcatgtctcctttaaatttttgcaagtttactcatgatttcttgcctcatgttcgcctgagcgattcgcttatcaaccgccgacatatcaaattccttaatattgtcaacagttgcttgagggttagctggcacggtcacaacagaaatttcaaagatttcaacttccttgaaaatccatccgccataaggttgcttagcgtcaataggctcataatctttaataaagaacccaatactcaggctatccaatgcccccattttcatgaggtcataagttttcttagcctctggatcactaagattaaacgttgaacgtgttcgcaagcctttttcatccacagacaattcatgcttaccaataacacagttacggtcatgattaagacacatagggacaacagccttagatttcagagtgttatcaaaacaccccttggccatcacatcgccttctctgtctgtattgtcataggttgaagcgtaagcctcaaaatgaaagtcagctgattcatcctcaaccgacttcacaacaaaggtttttagtttttccattgcttacctcctttcgtgaaagatatgccaaccacccaccctttagattctactcagattcttctgcaccgatacgaacagcattcaggttggtttcaaatacttcaccgccctcatagccaggtaaaccaagataggtttcacggaactcatttgagttcatcaatccagcatatttggacttgaagccaccttcaaccaaatccttaaatgaaatcatgtcagccatatcaaagaagaccagtaacttattgccctgagtccgtgctgtcttcgtgaagtattttctgttaatctcctcagaatagacacgctgatataacttcatgacgctagaatagtaggctctatattgttcctcagtatagtcacaggtaaataatttctcattgataccatgagcattataaagctgtgatttcaagaactctaattcttccttagaagcagtagaatagtctttgctaagttcctggaattcttcgccttgctcaagataagcaatgccaccgttcttggccaagtcaagcatactatcaacacggtccctggcttgttgcttcaaatgttcatcagctgccttagttggtagctttaagaaacctctcaagctagaattgccatcgctaagcttttctgtcaaagcattcaagttaatgtcaataagctcagtaatctgattgagttgagccgtgacattcaacttaggattttcaaatacccacacatcagtaagaggaagctcaacagcaacatcatcaagcataagctccacgctctctgctgtccaagtcactgtcttcttagcaagccatatttcaaccagtcggccattcttccaacgtggtacaacaaccgccacaccgtcacgcagcatagccctagttacatttgaccaaaagacaacaggcacttctagtggatttggtgaaactgttagcacctcagccaaatcactatgctcataccaaaccatcgaatcgacaccgcctgggttacgagtaatcttgacatgcttaaaccttaactgagctgtgtcagttgaaatcttattgtagatgttatccaaatagatggagttcctacgccagtaggagatacttctttgaagataggttcttgtagatttccgattgtttggacggaaaatcctagcaaaaacctccttcaaatttttcaaatagttgttcattcttcacctcaatcaaagtagtagctcaagtcttccttgaaattttcataacagataaaggcatctagctgactagcaaagacatcaatcttttcttttgccttttccttgtttggaaaaatattgttattggcatcaattttgacacggacgttggcatgattccatgtcgccacaggatcatcaaagatgattttgcccatcttagccttctccttgtaaaccttgagcggatttgataacgatttgaccgtctggggaatatcgtgacaaatatccccgtagtagtcgttaaacaagcgaataagttcccttgcattgtagcggtcataaccgactgccacaggcaaaattctgttgtcactcataaactgccgtaactcttcaaatatataggcttggtcattgtagtccaattcatgcacatgcagcatgccacttaattcccactcagtgtacttatcacgcagttcctttggcaatgtctcaatggtatgccgtggcatgaatttcttgtttagatagtgccgttcttccccacgcacaaccataaaagagatagagcagatgtcattgacatctgacaagtcaatcccaatcacacaacgggcgttccgttcatcatctccgacaaacaaactctcatcaaacttatctgaccaacctttacactcttcattgctgaagtaagcaagatagttgttgacaggaagattgaaagtcttagccatcagctcagcttgttgtgctggatcattcttgctcatctcaatatcacgagcgatggtttctttctctgtcgtgataccaagtaatggcatagctttctgccacatatcagggtcatgaatctctgacacatcgtccaactgataaatccaaggcatgacagaatcattgataatcttgtcatcaaggatatctacccagatgttgtaatacttatcaaagagcttgtcacgcttcgttccatttgtggaaatgtaccaggttatccaattcttacgcttacggctggaaccatcattcacaaccttgatgaagtcatcatcataagtgtgcacctcatcaaagatattgtagtgagcattagtaccgtcaaggctttcatagtcagaagtcttgatagacataagactgttagttgtttcatacaagataccttgcttggttgaccgtaggatgtcagcctcacgcatatagtgcagcaagctttcttcattcgacaacatcgcccttgaggcattgaacaaatagccagcctgttcacgactgtaagcaagaagctgaatatcagcaccccactcaccgtcaatgatttgaccaacctcagcaatagcagaaccaagagtagtcttacctgtgccacgaggcacaataataggcacctcatgaatgagacgcctttcttcataatctgtgtattcttccaaggtatcaggattggtcttagtaacctcaaccgtgtgataaaagccccacgttgtttctaaccaaaccttttgtggtaatgctaagcgtaacttaccagcaaggcctttagtattgctgcactcttcctcaatgaactcaatccgtttgtcagcttcctcctgtttgaagaggtattgctctttgtatcgctcaacacgtctaattgatttcattgtgagcttacaaatacgaatcttaccagtatagatgagctgagcatacttatcaaaatatctcatctcaaccataacgtgctaacttctcctgaatcatttctttgagcctgtcaccctgtggactttgcttttcaatcgttgacatgatctgcatgttaagcttttgatacttttccattccatcaagtaggtacttatcaggtagctcaccgtcattgatgaccttattgatttcaagctggaagttttcaatcactttttgattgtgattgtattgagttttgagatttttcaacccaactgaatcattatcactgatttcaagcattttttcttttggaatcagcttgaaagtcttacgagatagctcaacacgttcctgccttgtgtacttttgccgttgattggcaagcttttccaactctttgaactgacttttggtgatatttgacctagtttcttcaaatatgcccagcttttttcgataccttgtaagggtagcacgacttattcctagcttttctaaaacttcattgattttcaaaatcatgctcctttcttgtatcaattttcgtcaattttgggggagaggtacacaagaggattgacaccgttattattttggcgctgtcaaaattcaaaatggggggagtccacaaaaattcaaaaataaaaaaatcaaaaataaatttatattccgattatctaaatttaaatttattttactttgaaaagtttttgtgttgtgacattcaagacaaagtaactgacagttctcttcgttgagagtgatagattcatcttgataattagtttcgtcaatctctatgatgtggtcaacaatactcttaccgtgaatcaaacgtccgcacatgtcacaacgcatacgcttagcttttctgattttatttctcagagttctccaaggtttcgagttgtagaatttaatctgccaagctctgaaccagtcagagtgtttagggtttctatagcccactacattgaccccaatgcaaaactatctcttgcaacctctcttgaaatgtctctaaactttaaatctgcttcactcactattcttttgtcatagttgattaacggatttagaatattatttacaaaacttggctttattacgattttatttacagtctcgttaggcttaatatctaaagtcacctcatatccatttgcaatatgttctaagtcgttcttcgtgagatagatttctaaagtgctaccagcttcaagcctaattccatcaaatgcattttcatctttcatggcatcgtcacccccaacaaaaaaaagaacatgcctaagcttgctctctggatttttctcatgttacaaatatatcagattgtttttgtcaataatacccatttttttgacaagattatttttctatggctgaaattatgtaaaataaccatgctgaactatctatatcttatattttatccaattttgtttcacactagaaaactaattaggacaaggctttaagctcacttcaaaatatagactagaaacttcctcgttatggatagttgaaaaaatcaaaaaaatattagaggctaaaattactcatcttagtatcaagctcatcttgccttacacaaatgtagattagtgtaactgctgggcttgaatgattgaatagtgacatcaagtcagcaacgttcttgtacttcttgtagtaatgatagccaaaggtttttcgcattgtatgagttccaacattgtcaatgccgaggtcttcagcagctcttttaagaaaccagtaaaccgtcttataactgagcgccttgttctttccgacacgactctgaaatagatactcatgaagttccttgtctttgacaaattccctcaattcgtttttgagtggccttgtcatcttaatacttttatacttaccagtcttttgttccctaactttgatgtgccagccttggacatctttgacctttagcttgagaatatctccaacacggaaacctgtattgatgcccaaaagaaatagcatgtaatacttttcattccaagatgatagatagtccttcatggcttgtatatcgtctttgtctcgtagcggttcaacaatattcatcgctttgctcctttctcaaaaaaataaagcaccaaggatttctcggtgcttagcgacactatcaatctatcagattgtttctgtcaattctatatgtttttttgacaagttacatgaacaataattttgcaagtgtatcaaggatgacttcacgtcttctataaatctgcttgctatgtctgtaaagataacctgtctcgccattttccatgatgtgccaaacttgaatccaatcatatccagtatgttctccccacctcagatggaaaattttcttatcatcgggttcaagtacctctagtaattctgatatcgcattttggaactcttccagtttcagaatcattgggtcactggcataagcaacagctagattttcagaagtattagttgaagttccactgcgactagctcctgaatcatcgattcctggcattgtcaggtttttgactgcatagattctttccagttcatgacggcgctgcccaataagtttatcaatttttagatacttagcctcaagctcaaactcaaggaaatcacgtcttgtcttacttgctgttttctttgtcaaattgttctcctttggaatgctcttcttgattctttccacttgatgattctgccattattatcattgttccaatatggcggtaatctacagccttccttttccacatagataatcttttcaacaacggtttcaagtggttgtggttgctggccttcatcaatccaaccaagcaaccaggctgggttgatattgtaagccttagcgatattttcaacctgaccaatagatggtgtaccgcctttttcataatgtagcagcgtgttcatagaaatgccagtggcttcatgcacatctctgcgactgaggccaagtttgtttcttagttcttcaagccttaacttcatcttcccctccatcttctgtgtggtcttcgattttctgattttgcacgagcaatagcagagcgacacatgtcatcccagacatagtcagcattttccaactgcaaatcaaggcatctaaccttcagacggtcattctcaacttctagccgttcaatgtctttgtatgctctgttatataattcatcttcaagaaatctaatacgctcagccattgcctcttgaatgacgatgtaggtgggtttcttatattcgttcataagcacctcctaaaacggtagatcatcatctgaaatatccataggctgactatttccaaatgatggtggcaattggtcatccatgcttgcctggttcgttgaattatcacgcttttcaagaatctggaagctgtcagcaacaacctcagtcacatagatacgctgaccttgctgattttcgtagcttcttgtctggattcgtccagtaataccaatcagcattccttttttcgtccaattggccaagttttcagcttgttgtcgccacatcacacagttgatgaaatcagcttcacgatcaccagcagcattcttgaaatttcgattgactgctaggttaaaagtagcgtttgcgatgtttgacggcgtgtaacgtagctcaacatctcttgtcaagcggccaataagtacaacattattgatcatcaacctcaccaacctttctgaaaatgtacttgtcagagaactcttttctgtatctctttttggtaaccctcatagcctcatttttattagtcgttggcacgtttgggttagcactatgaagatagacaggcataacctttccaccaacaaaagcatcaaattctttaaattcaaggattcctattgattttttcatttctctttctccatttcttcaatcaaccagtcaaggttctttcttgcttttttgaggtcttcaaggccgtttttctttcggtaccgtagttggtactttagggcatttcctagataaaatcctttgagcatttcaggggtcataaagttcctgagaacatcaattgactctaaaccgtatttcccttgataatggctaggatagtttacattgtcatgcaagattctgaatccagttatcttacctagctcactttctatctttgtgtagccttgttcaatgagtttcttcatttcctcatcttcatcatttagaatattgagccgttttgtcataaaatcacattttgtcattagtttccacgtcctttcaaatagtcaggaatgtcatcaccaacagtaatttcattgtattgttcctcagtaaccaagaacttgccataagcgccagctgtaactgtgtgacggccttcaatgatttctttatcagtgattttgccaaacatttcagcgccagcattgtcagccacatagataatcaccctgtcagcttcctgatggcctttctggtagccaatatcataaaacagatagttgaatccaaaaacaaatacagtgatgatgatggcactagcaaaagccttgagattgttgaagaattcttcccaattcaggtttttcattacaaatcctcctctttaacccaaattccattgattaacttgccttttctgtccttgatttcttcataggcaatagccaagcaatcatcagccgttgtcagattgtggattgcaatggaatgaatattagagtgaagcaagctaagttctggacggataagcggtgtttttgtttcgttgtggaagatatgcttgtagagtttctgagccatctcccccaaacttgaagcaagtagcaacagctccatatcttgtggacttgcttcaatctgagcaccgttcttgatttgttgttcaatgccaatcaggacaacttgcatgtccccaagtgaatcacggatgatttcactcttaccctttgcaataccagagtaaagctccccagtttcctcaatcagcttctgaaactgcttgacaggatttgcctcgtgtaagttacggtcaataaaccactgttcaaccttctcttcaagtgtcattgttttagtcattttgataaacctttcttaatattgtttttagattttcgttgattctatcagcctctttttcatcgataagaaaattgtctgcactttcattgatttctgagatggcaaactgtatagcatcacgatagccctgcttatagtcaatattattgctcattttgtttttcctccgtttttttttaattaaagtaatcaagtagtagcaagttttagaaccataatcaattctgatttccttgctccgtattttcattgttgcaactacccttggtctatgtatgccagagttctcaatgatatggtcaataattgcttgggcagccaactccttagattcaaactggccaattggaacagctttgtaaccatatagcatgaatgtagcttcataggtcatagcaatctccttgcaattgcagcaatgacgtttactgttacgctattaccagcttgtttatataattgactgttgctattgacctgactcgccttgtcaaaagcccagtcagggaagccttgtagcctccaacactcacgaggtgtaagctttctgattctaaatccgttagagataccaaaagtacccgtagtagtattaccgttatgaccgctagctgttaaagtgccaacaatatctttctttcttctgttgtacaagtcataaacaaccacaccttgttcttctccagtcaagagagtattggcaatacctttaccaactcgtccacgtcttgtctcagaatttgggtgagataagtttactgaatcgccagcctctgcctctgaatagccttttttagtggcttcttttatctttaaaagattgttttcttgccaactgttgcatgtgacagttggagaaatttcatattctcctccctgattatagcctctgcctcgctgaattatttttggctctaaccctccaccttgcatagttctgatagtcggtgctaggccatctggatcgtagactctatttggcatttcaaatttcccaggtaatctgcctacaacatttacagcgattttaactccttctcccttatttgttgttagagttggagataaaccttccgaatcatacacttccccattcattccattaccagatggattaacatttcctatttttctggtgtggataggataattttctgtgatgcttgattcgaaaggaaaaattggtctggtaccttctcctctaagatgtccgataataaacactcgttccctattctgggggactccaaaattcttgctgttaaagatttgccattccacgttgtaccccaattcatccaaggttctgatgatggtctcgaatgtagcccccccttcgtggttgaggagtcctttaacgttctcaaggaatagatacttaggtctgagaatagatgcgaacctagcaatttcaaagaacaaagttcctcgtgtatcttcaaaacctcgtctatttccagcaattgagaaagcctggcacggaaatccgccacagataacgtccacacttccgattcctcgaataaactcatctgaaactcttgtgatgtcatgtagttcaatttctccttcagtatcatgtattactttgtagctagctctagcaaatttatttatttcacagaatcctatgcactcatgcccagcttgctccattccaaggcgaaaaccaccaatgccagcaaagaggtctaaaaatttcatcaatacctcctatcttccatatccttcggataagcaaagctatttccagtcacaccctcaagaatccgactagacaaagcaccgttgccataattgtcagcatacaaggccttaatctccttactactcaggttagtgttgatgattgtgttgctccgattgtccaaaatctcatagagaatctgatgtgtccactcattgttctggctgtcgcctttgcgactctccttgcccaaatcgtccagaaagaggtagtccaccctagttagcagctcaatcatgtcagcctgtctgtacccattgtcaaccttgaagctttcttttattttggtaaaaaggctcaccagtgagataaaaagaactgattttggtgattcgtaggctttgaattgttcgttcatgaacttggccaagccgtaagtcagatgacttttgccaacaccagaagggccagtaataatggcattgcctgttctatcctgtcggtagaactgttccatacgcttggcataattgatagcatgctggtcaatttcatccttgatttcatagttctcaagactcttagccctcagcttatctgataccaagctatctctttcaaagacagcatatgtatcagcaagcttgctgttgattttgctctgactgttcaacttattttcaaagatgttgatagcggccttggtacactctggacactgcttgagttcttcaagccgtcccttaatcggtactttagtcagccagagctggcaaccgtgaacctcgcaggtttcttccaagacttgcctagtttcaaaattcttaaaaggattcatctaaaagcccaaccttccgtcaattgtttccgtcttgattcgtggtgcttgattcaaatagccttcaaacttagaaccaaagagcgtttcaggtctgagatacttttcatacttagtgcctgaccaatccttgaccgtggtatcaatcacatgtttgaaatcatctaacctgaatccttctgaccatctagccttgataagagttttgtttttctgaatgttaggtctgtaatttctattagctttttcattcaagtaagaaataatttccttgtatggaatatcttcttcctcattgtctgaaactgtaggataggtagttaagctatccttatctaagctacccttacttaacctaacctgtgtctccattttggatacattttgtatacaatttccaataggtttaagactagctgtttttgacttgtcatactctagctgagccttttctgactggtataaggttgattgaaagcggtcagactggatatagttgtgaatccgccaatgacggataacgactacaccactatcaaagggaatcaagaacccttttgcaatcagtaatttcatatcatcatcactagcgccaatagttctctgaatcgtctttgccttatctataaagccctcatcatcagctcccatgttcaaatggaaatagagagcttgggatgatagtggcatttccaaaaaacggtcagtctcagtgatttttctactaaacattctgcgttgtgccatcatcaacctcctttgttagatactcataagctctcttataagcgtctaagtaaagttcaaagacatcattgacgtatcggccagcccttgatagaaattcatagacctcatattcttccatatcttcgctaaaacgttcaaaagcctctggaagaatataagtaaatcctttatcttcgtcaaaattgtcaaataattgatcaagtaggaattcatcatcaaaatctaaatcatcataatcagcaccatcaaagaattcattgagaatttctcttttagccttgtcagtatcatagtaatgaactggcctacttgaacatagtaacttttcaagaaaataccccagatgaccagtatagtgattgtagaatgtgtcccattcacccatattgtagaaatttcgtgcaactaattccccaaagtctcctgtgatagcaagggatgaattttttctatcgaaaatgtaacgtaagttatactcatagcccttttctggattgtaatagtcaacaatggtgactgtatcagattcgttttttacagcaatatggttgctgaaatagtggtcaaattttttcatttcattcctcctcaacgctagaaaacttggtatattccttgtggaaatacagcttgactgtgccaaggtttccgtgtctgttctttctgatgatcagctcagtgatgtcgttttctggctgaccttcttttttgtcttggtaataagcatcacgatagaggaaggcgacaatatcagcgtcttgctcaatgctgcctgattcccttaagtcggacatgataggccttttgtcgtttctttgctcaaccccacggctaagctgtgatagtgcaatgactggcacttttaattccttggcaataatctttaactgcctagaaatctcagatacctcttgctgtcggttgtcagaccgtgacccttgaatgagttgaagatagtcaatgactatcaatccaagtccgtcagtctcttgagatagcctcctagctcttgctctgatgtcagtaatcttgactccagctgtgtcatctataaagattggagcttcagcaagctgaccctgtgcatagataagacgttgccactcattaaccgtcaaatttcctgttctaatatgatggttgatgattgttccttcagctgacaacatccgctcaacaaggctttcagcccccatttcaagcgagaagacggccacagccttattggacttagttgccacattctgagctatgttaagagctagggctgtcttccccatcgctggccgtgccgctaagacaattagctggtcttcatgcaagcctgttatcagcttgtcaaagtcataaaatcctgtttcaataccagtgatttgactggtattgtttgagcgttcctcaatctttgaatgattttccaaaaggacatcatggataggtctgaaactactcttgttactggcttgactaacttcgataagtgatcgctcagcttttgcgataatctcatcaatatccatgtcctcatcataggcattgccaattgagtcagacaagttgtcaatgatagaccgtagctgtgcttttttagcaacaatcttggcataatgctcagcgtgtgagctggttggcactgcattaacaatctcagcgatgtagctgataccgccaaccatgccaagttcatccgtactttccagcgttgacttgattgtgacaatatcgatggcctcgccacgatcagcaaggctcaccatggccttaaatagaatcttgtgagctggcctgtaaaagtcatttggtttcagatactcagccacctcaatcattttttcaggtttgataaaaattgaaccaagaaccgactgctcagcctggatatcgtgaggcaatacttttaattcatccatagctttcctcagtcaacaaagacttctttctttgtttcagggtcaatgtcaacacgtcttccagtcttgtagtcaatgaagcctcgttgtgggatatattgagcaatgacagtcccagctgtctgtttgttcttgagagcttttctgagcttgatatttgagataagagactcaatcagggttactgaaataagtgtgcctactgcgataatttgtaaattgttcatgatatagttccttttgttctttcttagataacagttctttgccaattcttgtgataccattcaatgacttcatcacgagggtatttctcacgagcatttggaatcctcggaaaatccttatgacagttaaagcgttcatcaaatgtcccagtatctttagtacctaagagcattaaagcgcattgagacttgttgagttctaaaggaaatctatacttttcgtctgtcacaacgtgcattactttcatcgttctgtccattagaccagcttcgaactggtcaagcatttgaatcattagatcattcattatgcgtacctccatttatatccgtgagtctgtttttggtgccccattgctgttgctgttattctttgtgacgagatacctgttttcattgatgcagattttattgagtcaaacgtgtttatgaattccccttcaagtgtaaattgttctacaggtttacaacgacctaaagatgatttcgttgttctattcccatgattagcattttccttatctgtcgcccattctaaattatctactctattattaagtttattttcatcaatatgatttatcgttcgcttattgattggatttggtataaatgcttcagctactagtctatgaactcttatcgacttccttaatccattgactgaaagtgtcactattgcatagcctgaagataagctctgttttaagatgcgtccttttgtttttcttgttctctgttttgcattgactgttctaccaatagaccgaacacgaccaagattggaaacttgataatatcctttaacaattggtatatctttccaaacttcgttcattgtgatataatcctcttgtatctttatatatgagcctgattgccgtcaggcttttttgcgttttacagttcataagcgttcatctccaaaattttcattttggtatttgtgcttggttcccatgtcatccagtaagataatgctgcttcagcaaatttctttggcaacatgtcatagcgattgatattgaaatggtctttaaaatcaacctcagcttgtctaaagaccgactgtgcgaagactttatcagcataggctggactgtccattccacctagacaagagacaacacgagcttttctcttcttcagtaaggcttgagcaaagctaggatgaattggttgctcatttttcagataatcaacatcttgagccaatgccaactggtgctctttcagtttcttctgtccagtaaatagagcgatgaaagcctcatctgatagattttcaggcacataagctccctgttgccgaatctgtggcaatacctcgctagtgacccaacgtttgaattctttgacctgtggcaatttactggataagataagtgagtaaagaccagattcattgatgataatagtttcttgcatgcgacctaaattgtctgtgatgccctgttttagggcgtcatcctcatcaacatggagtgcaatcgcatttcgtgattttgaatagcctaaaatatcagccacgtctttcccaacaaaccaaggctcgttgttaatggttacagtacggacttcctgcccgtgaaaaacaaaaatttcgttcattcttaatcctccaacctcgtccagctctcatctatgtgtaatacatcagataccttatttttgagtttgtcgctccctttgccatatttcagcaattctgagatagttgccttagcaacaccacaagaacgagctagatgtgtttgtgtcatctgttcttcattcagcttatctttcactagctgaatccattttttctgttgttgactcatatttttcctttctagtttggtataattgacttgaaatcttttatgaaaggaggtcaagccatgaatttgaatcaaattcgtatcatagaggcatgccataaatttctaattggcatcacaaatttcgaagaagagttacaagatgacgttctcgtctatcgttacaaaggtaaccttgtcagctttgaaacctatcaagaatatgaacaacggtcatttgtagactataatctaaaatatggctatcttgatgacactagaacttacctagatgacagagctgatttgatagcagctttccctagcgaagagcacttgagagccttgcaaagagttaacgatgctgaacaagctcgtgtgcaaatctttaagctactatctcaggtcaatcttgactctctctccgaaaaaaattccaacatcaaaaaagataattttggatatgatttcttcaattttgcaactaaagaagaataccctgtttatcttttttcagatgatgaatcatttgagctagttgctatcagttgatacaacttcgccttcaaaatcaaatgacttcagttcgtgagctagttcttctagctcgcgggcttttttattgaactctttactaagttcaataaatttatccatgttagtaactttaactgtcactgtcattgaaccgattcccattcatctaccctcctttttaaattattaactaaaaagttagctaatctcttgactttttttaaatctagttttagaataagagcatagagaaaagacctactaaaagtaaggtttgacctaaagaaagcagacgccaatcagttttattaggctttattttttagttgtcttgttcgctaactctttagcttacgaatattattttaaacctagttttaatttttgtcaagaattttatatctagttttaaaatatttttttcgtatgccttagaaaggatacgatatgtctgttttaattgataggatacgtgaactcagtaataaaaagggaatgtctcttaatgacttagaagatacacttggctacagtcgtaattctctgtatagcttgaatgaaaattctaagatgggtaaaccaaaggaaattgcacagtattttaatgtctcactagattacctactaggtctaacagataatccacgaattgccagcgatgagacagctatcattgacggtcaagttgtggatctgagagaagcagctgcccataccatgctgtttgatggtaagccacttgatgaagatgatatagattttattacagcagtcctgtctgcacacttcaaaaataaacaaaaggattgattgcctatgaaactagaccaactctgtaaagagtttggagtggaattgtgcctgttcgatgccagcgactggcatagttcgggattttacaatccaataaccaaggtcttaggggttgatgtgaatctgtctgagcaagaacaaaaacaagtcgccctacatgagttacagcataaaaatcactttccatatcagtatcagctttttagagagagatgtgaactcgacgcaaataggaatatgatccaccatcttttgaaggaagaattggaaatcgctgaggaccacactcaattcaattacctggtctttatggaaaagtacaaattaaagaccatagctgatgaggctatgatcaaggaagagtatttgaatttagttggataaaatacgtgctcccctgaatcacgaataaaagcagggtgggaagatagttgttatggcattatttggtggcaaagacaaagaacctgaagtagaaatttttacagctgagccaaacgagcgagtttttgagtttaagaaatcaaagacgatagtaagaatagatgactactttatcagaattgcaagaaaaagcaacatgtcaaatatgcttctacatggacttgatggcgaaaaatcaattttgttatcagcaataactgcatatcaattaaaagagccaggggcaacggttggatatttacaattggtatatcctggatcagcagatactaaaggtggtgtctttgatgctgttaaggatgagaatacagtcacttttgtcaaagaagataaacaagccatcttagaattgaagatagcaatagaaaccgcattaaaaaataaggttcagaaataaataaaaagccctacgctcaactttggacggtccgagcgtaaggcgaatcgtataagaaaagttgccaatctggcaagtcttttcttgtactcattttatcagaaatgaggtaaaaaaacaaatggcatcatatcgaaaaagagagaacgggctgtgggaataccgcatttcctacaaaaccatagatggaaaatataaacggaaagagaaaggtggttttaagaccaagaagcttgctcaggcggcagcaatcgaaattgaaaagaaattgacccaaaacatcttgacaaatgacgaagtaactctatatgactttgtcaagacctggtcagaagtctataagcgtccgtatgtaaaagataagacttgggaaacctattcaaaaaactttaagcacatcaagaactatttccaagagttgaaggtcaaagatattacaccgctttactaccaaaaaaagttgaatgagtttggcgagaaatatgcccaagaaactcttgagaaatttcactatcaaataaaaggggctatgaaagttgctgtaagggaacaggttgttacctttaattttgcagaaggtgcaaaagtgaaatctcaggtagagcccaaaaatgaagaggaagattttttagaggagcgcgaatataaggctctcttggcccttacaagagagaacatccaatatgtatcctatttcactctttaccttcttgcagtcacaggactgcgtttttctgaggctatggggctaacctggagcgatatagacttcaaaaatggcattttggatataaacaagagttttgattactcgaatactcaagattttgcagatctgaagaatgagtcatcaaaaagaaaagttccaattgattcaaatacaatagatattcttcgagaatataagaaaaatcattggcaagctaatatcaagaatagagtgtgctttggtgtatctaattcagcttgcaataaactgattaagaaaattgtgggtaggaaagtcagaaatcactcattacggcacacatacgcttcgtttttgattttgaacggggttgacattgtgacaatttctaagctccttggacatgaaagtccagatattactctgaaagtttatacacatcagatggaagcactggctgagagaaattttgagaaaatcaaaaatatttttttagtcgcataatttggggcgaatttggggcgaaacaaccaaaaaccttgataaaccaaggttttcaaatccgtctaccgccttaaatataaaagattttatccaaagataacaaaaaatcaacgattgttcgttgatttttttgttatcagaattatttttttaaatccaataattgataaggtatagaagattgactatctcttaatgaatagctttctaattcattgacattatcccttaaaatttgagactctttagaactaattaaaccgtccctttcaaattcagagattgttctgcgttccaagtaatatcctcttagggtttcatttaaaatatctggcgttatgcgtgcaatgacacgttctacaaataaacctgatttaattaattctgcgtctcgaatgcgttcattttgtaagaaatctatcaaagttgcattataataaccttccatatcttctagcgtttctaaaatgaggtcattatttgataagtacaaatctgttaagtgctgacgattgacttctgctaacaaccgtttcctgtttttgaaatgttttttccgatttcgtattccttgtccaaatgttaaaaactcatgaacaataccacgaataacacgcataagaatcgttaaactataagtgatatttgacacaaagctacgattaacttggcgttctaagtattttaaataacgttggtaaatacgatattctttgatagaaatattgccataacgataagcagcttcaagtccatcgctttctatactaagcatcatcagttgcaattcagctaagtccttcttaatgtcactagattcttgttctaaaatgagatgacgaatacggctattataattatctataactgcataaaatgaagcttgattttcagaactcttaccatcttcttctaagacagataatacttttgttaaaatcgatagacgtattaaataatcatctttcacctgtaagggaggcgctaactttggtaatactaaaagtcccgttaaaaaactcattagcgttactgcaccaacagtgaaaagaatcaaactataccccaactctcctatgactgagtgcttgggtaataagagtattgttgctatggaaacacttcctttaactcctgaaaaagtcaacagttgaatctctctccaatactttttaaatgatttatggtatttgaaagatctccaagcataaaagcaagaaactgctagaaagcgaactagaaaaagtgtgcaagtaactaaaacaacaatactaataagatcaaaattactataagcgttacttgttaaaagaggaccaatgatacgtgtcagttctcttccaaatattaagaaaactaaaccatttaaaataaaatttaaggtttcccaaataacagaggtaacgcgatctacttgagcatcaaagagagtcacttttttcaaacgatttgcttgcattactcctgccactaccaccgcaataatagctgaaaatcccaacaaatcagcaacgaaataagcaacaaaaggtaaggttaattccaaaagtagagcccctgtaacatcagcagcatcaaatttctctaggacagtgagacataacctcattagaaaagcaaaaagcaagccaattaaaaaaccacccattatggccaatgctaacttgagactagcttttgctaaggagaaataacctgttacaagggctgttaaagcaaactggaaggaaactagaccactagcgtcatttaaaagaccttccaatttgaggatattttctgcccgtttaggaaattgaaacctcttagcaatcgatataaaggcaacggcatctgttgggcctaaggctgctccaagcgcaaagcatgccgcaagtggtaaactaactggcaaaaggtgccctgctacataaccaacgacaatagctgttaaaaataccgttggtaagattaagtaaagaataatagcccgatactttataaaactaccaatatcactttcttgaccttccctaaagttcaaaggagcaataacaaaggcaaggaataactcaggatcgatatggacttgtgacttatgaaaaactaagccagagagaatcccaaagaccaactggataaatggtaatggtaatttaggaaatatcctattgataacattagataaaatcaaaaacaggagaaagctgactattagaatagtttcttccatattattcctccttcataacatctatcaattctttcttcaatttctcaattttatcatcgatttttttagtatcttctctctccaatcgacagcgacatctttctttttcaagtattattaatttcttctttttcttctttactttacttaagtgaacatttgaaaattcttgatttttagaagaaaggtatttatcttttagtcgattcaattgttcttccaaagataattgagacatcatgacctcctatttaatgaccaaattattaataataagtattttttctttcatcggctatctctagtataacacgcatttcttaaattgatagattttaagaatatcgttgctcattatctccatatgtggtagactaacaacaatttaaataggaggttaaccaatgaaaaaattaacaaaaggcagccacattcgtgttcttagtccctcttcttccattgagcgtctgggtggttttgaggctaacctattagccaaagaagtactagaaaagctgggatttcaagtgtcattctctaagcactatctagaaaatgatatcctctattctgcttcgattactagccgtgtagaagatttacatgaagcatttgccgacccttctgttgatgccatattagcaaccattggcggattcaattccaacgagcttttaccatatttagattatgatttaatctctaagaatcccaaaataatttgtggttactcagattcaacggccttccttaatgctatttttgccaaagcaaaaatccaaacttacatgggccctgcttattcttctttcaaaatgaaggaaggtcaaccttaccaaacacaagcttggcttactgccatgacagaaaaccactatgaactttggcctagtgaagaatggtctagtgatccctggtatgatcccagcaaaccacgccaatttttcccaacagaatggaaaatttataatcacggaaaagcttccggtacgattatcggaggtaatctctctacgtttggcctacttcgaggtactccttatgcaccgaaaattgaacgctatgtcctcttgattgaagaggctgaggaaagtaatttttatgaatttgaccgcaaccttgctgcaattttacaagcttatcctcatccacaagctattcttatggggcgctttcctaaagaatgcggcatgactccacaagtctttgaatatatcctttcaaaacatgctattttcaaggaaattcctgttatttatgatatggattttgcgcacacccaacctcttttgacagtgactattggagctgagctaagcgttgacactactacattatctctatctataaaagaataaaaaaatactcctgctactcatctgagtaacgggagtttatcatttagagttaccaaataataacacgtttttcaactggacgccacatgttatcaccatctttaacatcaaactctttatggaattcttcaaaattcgttactgtaatattagttcgccattgtgctggggcgtgaacatctacactagctaacatttgcatatactcatcacgtgccttcatacgccaaattgtcgcaaagttaataaagaaatccctcgctgaaaaatctgactcacgctgcgcagcttctaaagcacaagcaactccacctaaatctgcaacattttctgatactgttagtttaccattgacttttgcgccataagattccagtccatcaaactgctcaactactttatctgtaagttttttgaaagcttcaaaatcttcatcagtccaccaattattcaaacttccatgttcatcaaatgaagctccattagtgtcaaaagcgtgtgatatttcatgtgcaatcactgcaccaattcccccataatttgctgatgaactttgctctaaagcataaaatggttcttgtaaaatggctgctgggaagacaatttggttttgttgtggatcataatacgcattgaccatgtgggcaggcatatgccattcacttctatcaactggtttattccatttactccaaccataggctattgaaattttgtctaaattagtagcattttcgacaagcgatagtttaggatcaatgatttttttagtataagtctctggtagtttctcagggtatccaatatgtggtgtgataacattaagtttcataatagctttttctcgcgttgactgtgcaagccaatccgccttttctaagcgtgacttatagacatcaatcatcgttgcaatcttatgctcaacatcagctttagcttctggagagaatttttctcctgcataccacaaacctagagcttgattgtaaggtcctgaagcaaggtagtaagctgcttttttcttatccattgcttgtggtgtgcctgataaagctcgactgtaaactcccgatttgatacgaatatcatcagttaagtaagcattataggcattcgcagctgataaaataagatctgcctttaataattcccaattagattctgagtaatagtcagatgcaaattctgtccagaaacgttcttcaggaacaataactttatctggtttttgtcctaatatcttttggaaaatagcatctaatggaagttcaggtgctaattttgtgaaatcttcccagttataaggatggtaaagtttaacatattccgaactctcttcgcgagataagacatattgtgccaattttgcatccaatgctaaaaccttatccaagatatctttaatttcctgttctgaaaggccaaacaaaggcagtaggtcttcttgacttttacgccaaaaagcaaggagttcctttcctttttcattatcttcactataataagttgtatctggtaaaataatcccaggcgcttcagcccaaagtacattcaattgagcattcataaagtcaggagccacaccaaatggaaattcatttggtttaccctctagttcatattctgcaacttttgatgcaaactcagagaaagattgtaggcctttatattcttcaattaatggtaatactggtgatactcctacctcttcacgtttttgataatcagctgtcattttatgaaaagcaataaaatgatttaaaatcgtatcacttggtttattttcatcagccagccacttatctgtcgttgacagcattaatgcttcaatgtcatcagcaagatcagaaaaaccacctgtccttggtttgtcatcaggaataacagctgtcttagcccactccccattaaccgcttggtaaaaatcatcttgatattttatcattattttctccttaatatctcatatgtaatctcttacagtctaacagaaaattcagagtttgactattaaaaatactctcatattggtgctttctctaaatatcattttgttatttttgctatactataaaccaacaaggaggttgttatgattgaaaaatattataattgggcaacgcttggaaccggcgttattgccaacgaattagcccaagcactagaagcacgtggacaaaaattatattctgtagctaatagaacttacgacaaaggacttgaatttgctaccaaatatggtatccaaaaagtttatgatcacatagatcaagtatttgaagaccctgaagtggatatcatttatatctctactccccacaatactcacatctcatttttacgaaaggctttagcaaatggtaagcacgttctttgcgaaaaatctattactttaaacagcactgaacttaaagaagccatagatttagccgaaactaaccatgttgtcttagctgaagccatgactatttttcatatgccaatttatcgccaattaaaaacattagttgatagtggaaaattaggaccgttaaaaatgattcaaatgaatttcggaagttataaagaatatgatatgactaaccgttttttcagtcgtgacctagcaggcggtgctttgctggacattggtgtttatgcactttcttgtattcgctggtttatgtcagaagcacctcacaacattacctctcaagttacatttgcaccaacaggagttgatgaacaagttggtatcctactaaccaatcctgcaaatgagatggcgactgtcagccttagtttacatgcaaaacaacctaaacgagcaactatcgcttacgataaaggctacattgaactttttgaatatccgcgaggacaaaaggcagttattacttatactgaggatgggcatcaagatattctcgaagctggcaaaactgaaaatgccctccaatatgaggtagctgatatggaagaagccgtttcaggaaaaactaaccacatgtacttaaactataccaaagacgttatggatatcatgacacagctacgtcaagaatggggatttacctacccagaagaagaaaaatgaagagagcttgacaatgattgtcaagccctttttagttaatatacactacattttcttaaaaaataggcgtttaaagaaataaatcataccaactgctaaacttaaaatagcataaacatagaaaactgcatttatttgtcctagtaaatgatcaaaacaagacagaagaatagccgcactagctccaccaatattacaaaatactaaaactaatgtcgttgcagaaccaaccaacgaatattcaacacggtctgctactaggctaaacacagcagtgaccatcaggctgtaaaggaaacctgatgccatcgcactaattgttagtaccattagattagaaggcaatccaactccaagcaatgttaaagaaaataagacgaggcagattggaattaattgtttatgaaacatagctatcaactgaccaaaactcatacctgctattattcccataagcatcatcgcactaagaacaagactagcttgagctggcgtacccaaaccaaattctactactagcagaggtatcctaagattaatcccagtatttatagttatgacaaatcctgctaaaatagctaaggcgacaatataagttaaatcagctttagggattttttgacctttagttttaatcttgtcatttgtatctttcaccactttcttaggcgcaaaaacaagatatagaactaagattggtaaagctaaaaaataaatcataaatgatttggaccaaccaaaagtcaacaacagcccaactaaagctgtcaaaccagcatttcctaaaacttcaaaggacccccttaatcctaagagttttcttctttctttgccttgataatattcactaatcacactaatggccctagtattaataaaaccaataccactccccaataaaagacgcgatacaaatactaaaaggtagttctgactgacaaccggcaatcctccccctaatgctgttagcaatagcccaaagataatcatatgtttctcagaaagttttttacttaaccaaggtgtgataagcaagatgaagataatagccatcgaaggaattgaaaacaataattcaacttggggtgatggtaagcccttatctctataataagatatcatttgtggtagggctggtgatgtcgaaaaagttgatagcaagataagtgataaagagagtaaacttagcttctccataaagattttcaagtgacaatacctctttctgatgtctttttttagataaataaagtataatcaatattaaactagaaatatatgacatatgtcctaaaactatctcaaatagggagtcaatacatggatatagaaaactactgccaagactactgtttggagactatctttccaaaacattatttcaaggatttacaagtaatcaccctaactgccggccaatccgtctgtaaacagggagaacaattagaatacttgcactacatcgtcaagggacgttttaaaattgtacgtcgactctttaacggcaaagaacatattttagatattaaaacaaaaccaacactgattggtgatattgaacttttgactaatagacaaattgtatcatctgttattgccttagaggatcttacagtcattcaattatcacttaaaggacggaaagagaaactgttaacagacgcaactttcctcctaaaacttagtcaagagctagctcaggcttttcatgatcaaaacatcaaagcgtctactaatctagggtataccgtcaaagagttacttgcaagtcatattttagcaattgaagaacaaggttactttcaacttgagttaagtagtttagctgattcgtttggcgtcagttatcgtcatttattaagagttatccacgatatggtcaaagaaggccttatccaaaaagaaaaaccaaaatactttatcaaaaatcgtttcgcactagaatcattaaatattcagccatgaagcgtagctttatcatttaattattttatgctaaactaaatcagagaatacagttaggagaaaatatgtctgctattgataaattagtaaaagctagtcatttaattgacatgaatgacattatccgtgaaggcaatccaacccttcgcaaagtggctgaagaagtcacattcccactttctgagaaagaagaaattctcggagaaaaaatgatgcaatttttaaaacactctcaagatccaattatggctgagaagctaggcttacgtggtggtgttggtttagccgcaccacaattagacatctcaaaacgcatcattgccgtccttgttccaaacgttgaggatgctcaaggaaatccacctaaagaagcttatagcctccaagaagtaatgtacaaccctaaagttgtatcgcattctgttcaagatgctgctttatctgacggggagggatgcctatcagtagatcgtgaagtacctggctatgtcgtccgccacgcgcgtgtaactattgaatatttcgacaaaactggtgaaaaacatcgactcaaattaaaaggttacaactctattgttgttcaacatgaaattgaccacattgatggtattatgttttacgaccgtatcaatgagaaaaatcctttcgctgtcaaagaaggcttacttattttagaataaggacaaataacctagagataattttctctaggttttattttttaatagcaaataaaataagaaatcttttttaaaaagtcgactctttccaaaacatctggcaatctacaatctgttggttatcgacggagtcatctccttcaatacgattaatcaaaatctgtgctacttgttcaccttcttcataagccggctggacaattgttgacactttaggagatgaaaagtctgtccattcaatattgtcaaacccaactaaaccaactcgtggcatatcaaaattgagattcttcatggcagtaaaaaccattggtaaagcccaacaatttggtgcaaatactaatgtctcctccttatctggaactaccgcttttagaaagtcttctatatcactttttgaatgatcatcatcttcaatcaccaaagtgtcataaccgaaaccattgtcctttaaagcatccatgaatcccgaagctctctcaatacgtgtactaagcaagctcgtatcagcagtaatcataataaactttttataccctcgatttagacactcctgtgtcatatcataaacagcatcatagttattagccttaacccaactcgtcttatgttcataaagttgactatcaaaaaataccattggtttctttttttcttttaaaatacgagaatactttcgaaaatttgatgtaggctgaataatgaaaccatcaacacctaaatttaacatattttcaatataatcttcttcacttttggcatcgtaattactattacccacaataatttgatagcctttttgtttggtgatgtgctcaattccttttacaatttgatttgaaaatgtgtttgttatatctccaattaagacacctagtagttttgtttttttagaatttagacttcttgctatcgtacttggtctataacctgtttcatcaatcacctcttgaatacgttgcctcgtctcatccgacattttttcaaatttttgattcaagaaaaaagaaaccgttgttttggaagtttttgataattgagcgatgtcattaatggtcatttttttagacataacaaacctcctttctaattttactaattttatttttttatggttaatatagtactagtatagcataataatagccctcttaattttttaaacgactcattttgccattatttttatcatatacaatgacttttcctttgcattttatcccttgcatcaaatagagtttatccccaaagataatatcatccataagcactccaattaaataatgaaagtcttgagacctaatatcaaatgcaatgctattacttagttccttatgactgttcgtttgcactaaaggaacatatttcacctgacagttccgatcaactatcaaggtataatccatcacctcatcaacaaattttattttcttaactaatttatgactttctgtcaattgattataccgcttagaaataaggcaatcttctagattaaaggtcgtaggacttactaatttcaagtcattaacaaacccattttcataaatgacctgatcatctaaaatatattgatttgttaagacatgctctcctggacaactcaccttatcaataactaaggtaatggcctgcggtaaagttaacaaccatcgcttatggtaatagatatcagaagctctttggacatgtagttgtccttcgactaaatggtacctatcctttgaagtcaactgacaatagtcacattttggataagaattgtatgtccaagagtccttgatcatttctaagggttgcccatcaagggtacatgttgaatgactagtcgaacgtttaaaatcataccttagttgttcttctttgtaagtatatcttcctgcatcaatgaaaataggtttctttttatcatagagacaaacactattattatcactatgagtatgagcgctaccaaatggaccgttcttaaaaaatatataacgcctatcatcacgtaaacacacatgaccagaatctggaaaaagataagcagactctcctattgtcgcacgcggtatttcttcaaaaagataaattgatggcttcccaaacaaaagtaaagtttctaaattaacattatcaaaagaaaatgattttgttttagaagatttcaacacaagtgttgccaaagttagaatatcacgagtatcggtcacatcactgtcccctatagctagttgacaataatccggaccagtcatagcaattagataggtaaccattttttcaatagtttcttctaatggtagataatatttaggcgcaaggataactagttccattaaggacttcaagacttctacatgatacataattgattgttcatactggctcccgtcatctaaaatttgaagcttgatttgaagtaataattcttcttcagcaaaactctgaatttcaggtagatttaattcatcttcataatagtataaacacgccaatattgctgttgtttgtaaaattccccagttacttagactatctttttcacgataatagtccctcatataagttatctgctcccgtaaactagttaatagtttaatttttttagtttctgttattaatccaaaataatctaaaaaaatcaaaactttgagccatgacatgcaacgtatcccagtgtcaatagtacgacttaccgccccttctggctttagtgtaaattgacaatcaatccaatggtacataaaatatttcatttgtctaaggtaagacttatcgccttcaacaatgtagaccaccaggaatttaaaaagataagtttgacgatttagcatatacaaccattctggatcatctgttactggcttatcccactccaaaggatcaagacaatatgctttagaacaaggttccatatcccaattatcattaaatacaaaagtgttcctcatcatcaaattaacagaggctttcatttcttgataggcattagattggtatgttttaatatacttttgacaaaattccctatcaaaatccttgaatttattatataagcgatctttcatttttttacaaaacgtcctcgtccgatataaaaaggactatgtcattgatatgtcataatccttatttatcaaaattttattaagctaaaatacctaaccagctaccaaggataccaataataactgtaaggataactaacttataagttgtccattttttatttttaataaggtaaaacataaggaaagtgtagagtgctggaagtagagctggtgcaattttatcaagcataccttggacagtaacaatcttttgcgttgtactagttactttttctggagcaaaagtgtaagggattgtaagcttaacttgtgttgcagctaaacttgagatgaccgttacaccaacgatattagctgcccgtgagataactgacatttgttcactcaatttatcaataaaactggtcccaagacgataaccatacatgccagtaactaatttaattcccgttaaaatagtattcatagccacaaagaacagaatcggtcccatcaccaaaccatctgtcgctaaagaggctgcaatcgttgagaacaagggtgctaagcaaaattgtgataaagaatcaccgatacctgcaagaggccccataagcgccatcttaataccgcgaatttcttcttctggccgctcattatcaagcattgctaaatgtaagctagttacaaaaggtaagaaatgagggtttgtattgtaaaactccacattttcttctagagctcccgctaaagcttttttgtcatctccataatattttttgagagctggatatatgacattagcataaccaagaccttgatagttactgtaattaaagccattttgtaaataaaaggcacgtaaagctgttttagtgtaatcactttttgctaattttttagatccagtcatcttggttgtctccttctgtcttagtttctttagtaggtgcagctggttttctgaaaatatcaagcaaagcaaatattgttgcaattatagctaccccgatagttggaaccccaagcacactgttagtagccactgatgttaaaactccgtctccatttgctgttggagttagaactggcaaaccaaaataaacagctagaacatatccaagtaggatataaggaatgagttcttttttagccattacagagagaatcatcgcaaaaccaattgcaggaagcattttcccagctaaggttagaccattaagcaaaacagggggaatgagagcaaataaatctgtcaaagtttgcgttgaaagagcacccagtactcctaaaccaaatcccaatccagcgaatgcccaaattgtaccatttgctgcaattttaaatcctcggaaattacctgcttgcaaagcttttttagctgtttcaggcgcccctgcaaaagcagtataagttgctgtttgaagaaattgaataccaactgcaattggggttgataatgcaagagcagcttccggtgtgatttttcctttagttccagctgttgtaatagccatcaaagttccaaaaatcccaggaccgattgggtttggaggaactgtccctcccgctcccacaccaaatcccatgtaagccagttcagatattgctccaactgccaaagctgtttgaatatctcctaaaataacaccaacgcctagagagagaacgatacaacgatttgtatagaggccaagcaacatgccactaaaacagaaagccgtccacagtccaattaagacagcctgaagaatactaatatccatatttttctcctttatatgatagtaagtttgtccaactaaatataatctaaaatattaacttccacagcaccatcgttacctgttggagttgttttagtattaaatgcaatgtgatattcttggtttaattttctaattatctctttatccttcatccctaagaagatagagcgacttacctgctctttaccttctccattatgaatatttccaatattaatctctttaattgggacgccccctgctacaagtctatagacatctttcaaatctttaacaattataaaaatcgtctgtgctgggttggccttgtgaataatatcaataactttttgaatatcaaaaaatcgcaatgctattgattctggcaccaccgtcttcattaacgtttgttgaagatgatctttggagacatcatcatttgccacaataacagtattacaacttaaaaatttcacccaaagttgtccttgtccatgaataagacgctcatcaacacgtgtcattacaatatttggtcctgctgccatttctgacctcctcgttttctattatttattgtttattttgttagtaaaatactcttaccaataaagttcccagtctttatagaatcttattaaggcttctaagtaataataatctccccaaatattaccttcatctactcctttacctgaatgccacgaatacacaccgtgcaatagaagaggacgtcctgctataagttcattattactatactgttcaatcagactacgaagcattgtatgcatagcatatttgtatgtctctttatcaggatctacttctggtaaatatttaagcatctcatgaattccacacacagccgttgctgttgcggatgtatctctaggctggcccgagccatccgtaaaaataaggtcccaataggataccttgtcttcaggtaaacgatttagaaaatagtttgtcatacctttaaaaaggataatctgctgataatctttcattttccggtaactaagcggaataccgtagatgccccatgcttgccctcttgcccaagatgactcatcactataaccctgtcgtgtgacaccttttaacggttctccagtttctgggtcgaaataaaaagtatgaaaagcagaagaatcatcacgcaccacattgttagctgaagcgtagaagtgattcaccgcaacttgtctatacttttcatcacctgtctgttcataagcaaaaaataagagttggatattaagtaagcaatcgataattaagcgatagtgttccttatacccgagttctccccaagcctgaataaatccacctttttcttgatagcgctccatcaatttatctgcagcttttatagtggcttctaaagctttaacatcaccattgatacgatattctgctgtacaagatggtgtgtaaagaaatcctaagtcgtggtgatctaatgctatacgattattaatacgatttagaaatgacaatacatttttgtgggctatgttttttaactttttatcctgattatactcataagctaaccacaagcaccctgtccaaaaaccatttgtccattctgtgttatccataactttataaatattattgaatgttgcaggcgttggatactcttcaccaaagtaatcaatattaatataaagttgcttcaaggctttttcaatcgcttcctcaacttcaatcttagttaataatctactgtttaaaaaacgctttggattttcaattgactcaaccttgaccggttttattttcatcattattaaatgcctccctcaaaagttgcttctgcagtttgtgtagcaaggcaagtagaaaaatcaacaattccttcatgagatgatgttataactttatcaacaagatcatctacatgttcaaacatcgttctagataaaacagcttccattaacattgaaaggttcaagcccgataaaacttttatctttttatctgtatattctactgataaggcggaagaaacattgaaaggagtcccacctagcaaatcagtcaatactaaaatttctttgaaatcgataacctctctttgcaaagcaactctaacatcattagaagacatgcctgcaataaagttaataccaacaacatattcctgatgcccagcaataagttctaaagagcttaaaataccatctggaaagttgccgtgtgctacaataataatttttatcatattttctcctcttgagtttaccggtttacttttataatcagattatagcgctttcatttttaggtgtcaacatcttttttatattttttgagcagtttacttgattttttataatgatgtcttttttatctttaagaattataacctagataaatctttgttatatatgttgccaagttttatagaagaagaactctatagttgacaaaaccggtttactttgttactattcatgtaaacaggtttacttcctgaatttttttacggaggtcatattatgactgaacaattcttaaaagacaacttttcactagaaggtaaagtcgccttaataacaggcgcttcttacggcattggtttttcaatagcaactgcttttgctagagctggagcaactattgtcttcaatgatattaagcaagaactcgttgacaaaggcatctccgcctataaaaaacttggcattaaggcccatggctatgtttgtgatgttacagatgaagatggaatcaacgaaatggtggacaaaatttctcaagatgttggggtaattgatattctagttaacaacgcaggtattataaaacgcacccctatgctagagatgagcgctgcagattttcgacaagttattgatattgatttgaatgctccctttatcgtatcaaaagcggtattacctggaatgatccaaaaaggacatggtaaaatcatcaatatttgctccatgatgagtgagcttggacgcgaaacagttgctgcctatgctgctgccaaagggggacttaaaatgttaaccaagaacatcgcttctgaatacggttctgctaacatccaatgtaacggtatcgggcccggctatattgccacaccacaaacagctccccttcgtgaacgtcaagatgatggttcacgtcatccattcgaccaatttatcatcgctaaaacacctgccgctcgctggggtgaggcagaagatttaggtgcaccagctatcttccttgctagtgatgcatcaaactttatcaatggtcacatactctatgtagatggcggtattttagcttacatcggtaaacaacctcaataataaaggagtaatataaatgaaaattgcattaatcaacgaaaatagccaagcaagtaaaaatactattatctacaaagaattgaaagcggtttctgatgaaaaaggatttgaagttttcaactacggaatgtatggcaaagaagaagaaagccagctaacttatgtacaaaatggtttactgactgctattttacttaatagcggtgctgcagattttgttattacaggctgtgggacaggaattggagcgatgcttgcttgtaatagttttcctggcgtagtctgtggattcgctgctgatcctgtcgacgcttacttattctctcaagtaaacggaggaaatgctctttcccttccttttgctaaaggatttggttggggagctgaattgaatctgaggtatttatttgaacgtcttttcgaagatgaaaaaggagggggataccctaaagagagggctgtacctgagcaacgcaatgcacgtatccttagcgaaataaaacagattacttacagagatttactctctgttttaaaagaaattgatcaagatttcttaaaggaaactatttctggggagcatttccaagaatatttcttcgctaattgccaaaatcaaaatatagcagactacttgaaatctgtcttagactaaagcgtctgttttagaaaggacttttatgtctaagattctttttttcggtgaacctctcattcgcatcactccaaaagaaaatgactattttgcagatagtatctcaactaaactattctatggtggctctgaagttaataccgcaagagctctacaaggctttgggcaagatactaaactcctctcagccttacccaataatcccataggtaatagttttcttcaatttttaaaagcacagggtattgatactcattctattcagtgggttggagaacgtgttgggttatattttttagaagattcctttgcttgcagaaaaggtgaggtggtctacgaccgcgatcatagtagtttacatgactttaggataaatcaaattgatttcgatcaattatttgaaggagtttctctctttcattttagtggtattacactatcattggatgagtctatccaagagataacactgcttcttttaaaagaagctaaaaaaagagagataacaatctccttagatctcaattttcgcagtaaactaatttctcctaaaaatgccaaaatccttttttctcagttcgctacctttgcggatatttgttttggtattgaacctcttatggttgactcacaggacactaccttcttcaatcgcgatgaagctacaatagaggacgtcaaagaacgaatgatttcgcttataaatcactttgactttcaagtcattttccatactaaacgtctacaggatgaatggggacgaaaccactaccaagcttacatagcaaatcgtaaacaagagtttgtcacttcaaaagaaatcaccacagctgtaaaccagagaattggaagcggagatgcttttgtggcgggagcgctatatcaactacttcagcactcagacagcaagacagtcattgatttcgctgtcgctagtgcatctttaaaatgtgctttggaaggggacaatatgtttgagaccgttaccgcagttaacaaagtactaaatcaatcgaaagacattattcgttagaagggagaattatgataaaatcaaagattttgttgcaattaatgcaaggaaaaatagttgctgtcattcgtggaaatagccaagaagaagcttttcaagctgctcaagcatgcataaaaggtggtatttctgctatcgaaatcgcctatactaatagcaaagctagccaagtcattgaacaactagtcacacaatatactaaccaagaacaagttgtcgttggggcaggaactgttctagactcagaaactgcccgaatggctattttagcaggagcaaagtttattgtatctcccgcatttaatctacagactgctaaactatgtaatcgttatgctattccttatttaccaggttgcatgaccttatcagaggtaacaacagcacttgaagccggttgcgaaataattaaaatattcccaggaggtactctaggaacatctttcatctcatcactaaaggcacctttacctcaagtacaaattatggtgactggtggggtaaatctcacaaatgccaaagactggtttctatctggagtaacagccattggtattggtggagagttcaataaactagcagctttgggggaatttgataaaatcacagaaatggctaaacaatacaaaatacagctaaatctgaattaacacaataaaaagacaaggcacccccacacctcaatcatgagacagaagaaaagaacttttataaagccatttttctgtagtaccgtttatcttaatcagactcattatctcgattttcttatcagaccgagataatttttagctaatcttcctgtagacataaccgttctacttccgacaactgatccatgtcttcaccaaagatatactacttgcccgcagattgatataagtagtgaagctcatcattctcatatcatttcagcaaataatagatttgatatcatttttatatccaaaaacttagcaatgacctatcaggcttacccgcttttcctatctcaacacagactaacttagctcctatcaaatacattttttaaacataattaaaaacatttctgattatagtttattagatttcaacagaagtattttttctgcgtctcagcttttgagtgtaccgttattttgaagttttgatagttgagtgatatcattaatagtcgttttttagacacgctaaacctcctttctaatttgactgattttattttttataacgactcgttttactgttacatctctttataatcacctatttaaatagacgcatttaaaatcaaaattaacccaagatttttattgaaaaacattttttaatatgttattatttatttattaataaattaggagatttttaaaaaatgaagaaaaaagattaaaattaacttgtgtcttatcatttgctgtagcttcaacattattcaacctatctgatttaaatatatcatatgctaatcaaaataatattcaagaaactaatctagttgaaaaaaacagtgaagataagtttattcaagagttaaataggtataaaacagagataccaaatttcaaaggttttaatgtttggattttaggtgataaaggctattacaaaaaccttatcaatttagaagaaattaaaaatatccaagctacattaaaaaaagaaagaaatgaagaatatgtctttgtcaaattaaatgggaaaatcgcacatgatacaaccgtattcttgatgaataaaaaacataaattacttaaaaatatagaggaatttaagacgataacccaaaaaaggctaactgagagaggaaagttcccatatgataccgttcattctacgtttgaaattaaggatgaaaactttatcatggaaagattgaaatcatcagggttatctatgggtaaaccagttgattatatgggcgtaaatggtatccctatttacactaaaacattatctatagttaataagtttgcctttgaaaataattcaaaagattcttcatattcttcaaacattaatattagtgaagataaaataaaagaaaatgaccaaaaaattctagatttaatagttaaatctggagctaataatcaaaacttaacagatgaagaaaaagtaattgctttcactaaatatataggtgaaataactaattatgacaatgaagcttacagagctagaaatgtcgacacagaatattacagagcttcagatttattttctgtaacagaaagaaaacttgctatgtgcgttggctatagtgtaacagccgctagggcatttaatattatggggatacctagttatgtcgtttctggtaaaagtcctcaaggaatatctcatgcagctgtgagagcgtattataatagaagttggcatatcatagatatcacagccagtacatattggaaaaatggtaattacaaaacaacgtattccgattttattaaagaatactgtatagatggttatgacgtttatgatcccgcaaaaacaaataatagatttaaagttaagtatatggaatcaaatgaagcgtttgaaaattggatacataataatggaagcaaatctatgttatttattaatgaatctgcagctctaaaagataaaaaaccaaaagatgattttgtaccagtaacagaaaaagaaaaaaacgagctgatagataagtataaaaaattattgtcacagattcctgaaaacacacaaaatccaggagaaaaaaacataagagattatttgaaaaatgaatatgaagaaatattaaagaaagataatttatttgagcatgaacatgcagaatttaaagaaagtctaaatttaaatgaatcattctacctacaattaaagaaagaagaaatgaaaccgagtgataatctcaaaaaagaagaaaaaccaagagaaaattcagtaaaagagagggagactccagctgaaaacaatgattttgtttcagtaacagaaaaaaacaacttgattgataaatataaagaattattatcaaaaatcccagagaatacacaaaatcctggggaaaagaatatacgaaattatctagagaaagaatatgaagaactactacaaaaagataaattattcaagcatgagtacacagagtttacaaaaagtctaaatttgaatgaaacattctattcacaattaaaagaaggagaaatgaaactaagtgaaaatcccgaaaaaggagaaacgaacacgaattaacctttcaaatatctacatcaaataacagaagtctctgtatcaagcgaattgtagcttttttgaatatactaaaaacactcctacctctattttactagaagtaggagtgttttttcattttagttcatagatgcagtgtcattgctatccttgcctttttttgtacagtattatccgatgactttaaagcggtcatcatcattcatgaattctttttctcctgtttcagcttcgattgaaccaaaatttagttgtccacgaagtttccaactagctggaacaccataaacagcttgtactgatgcatcaataactggattgtaatgttgtaaattaccaccaagtccaagttctgcagaaagggctgtccaagtatttactgaggcaatacctgttgattgctcagaccaaactggaaagttatccgcataaagaacgaattgttcttgaagagatttgacaacatcttgatcttcaaagaagagtactgttccctttgaagctccaaaactagctaatttttccttagttccagcaatagctgtctctggagcaccttgtactttcattgtttctaccaaatcattagcaaccaattcatcccagaacttagtaacttcatcattcaataaaatgacaacacgggaagtttgactattaaaagcagatggggattggcgaactgcctctttaataatctctactattttctcatcagaaacttctgtattgcgaccaagagcgtaaatagagcgacggttttttaattcttccaaaaatgacatattttttctccttgttcttcaatctcagatatcttactacatttgttctagtgacatatgaattagattaaagttatttattactatgtagtaattatattaccactatatcataaagtcaaagaatgtgactcacaaggttttaaatttttttaaaaggttaatcaagtcttcttgctctgtttctgttaagactgaaaaagcatcttctacacgtttaatatgctctggtagagctttttttatcacttcttctccttcagttgttaaactcaccaaaaaggctctcttatcattcggacaagaatggcgtaatacccatccctttttttccatatttttaataacaacagtcatattacctgatgtagcaagcatattttcaatcaattctccaattttcattgtgcctttagcatagagaacatccaaaactgcaaactgagttggtgttaattcaaattctttaaatgattctgagacttttccgtctattgttctaaatgcttttcgcatgacaaccatagatttaaccgctgaatttttaaagtttcccatttcatctcccaaacgtattttttcttattttatcactaattagttatttcaagcaagaatatcatctttgccctatcaaaagcagctggcaaataataaggttgagtagttactcaaccttattacttagaagaaatcatcaaaaagactcaactgattgtcttctggtaaatttcccaaaatacccatctcatcaaatttttcaactaaggtacttgagactcctcctcgtttacgaagctctgtttttgataaaaattcaccatcttcacgtgcccgaactatctgttttgcaacgttttctcccaagccttccatagcaacaaatggagggattagcgtatcctcttcaataataaagtcagtcgcatggctacgataaagatctaatttcccaaatttaaagccacgctcaagcatttcattaaccaactctaatgtcgtaaaaagatcattttcgacattcgtcgcctcattacgctgacgcttctcagtgatatccttcatgcgcgccttaacggcatcaagtccagcactcattgtgcgtaattcaaaagctttggcgcgaatagaaaaataagcacaataataaaatattggataatgtactttaaagtacgccacacgtaatgccattaaaacataggctgctgcatgggctttagggaacatatacttgatttttccacacgattcaatataccaatccgggacattattatcacgcattgcttggatataaccattacgctcatcttctgaaattttcaaccataaccccttacgcacgcgctccatgattgtaaaggccatctttggttgtaggccagcgtgcattaaataaaccatgatgtcatcacgacaaccaataacagttgataaggtagcaataccttccttgattaagtcttgagcattacctaaccaaacatccgtaccatgtgatagccctgacagttgcaacaattctgcaaatgtggttggatgggtttcgttcaccataccacgaacaaagttcgtaccaaactctggaataccaagcattcctgtaggagttccaatttgctcttctgtcactcctaaaacttccgtaccagaaaataacttcataacgtctggatcatctggaaggatatttgatggatcaattcctgataaatcctgaagtttacgaatcatagtaggatcatcatgtcctagaatatctaacttcaagacattctcatcaatatcatggaaattgaagtgagttgtctgccaagcagctgtcatatcatctgctggatattgaaccggagtaaaatcataaacatccatatagttaggaataacaacaataccaccggggtgttgacctgtagaacgtttaactcccgcagcaccagtcgctaaccgttcgacctctgcatcgttataaaatttattgtaatctcgttcgtaacctttgacaaaaccaaaggcagttttttcagctacggtacctaccgttcctgcacgaaaagcatattcttctccaaagatatcacgaacgtctaagtgagcagaaggttgatcatctccagagaaattcagatcaatatcaggaaccttatctccatcaaatcctaagaaagtttcaaacggaatatcctgtccatctttcttgtacaaagtaccacatttaggacaatttttatttggtaaatcatagcctgaaccacaagaaccatctgtgataaattcagaatgctgacaatttgggcaaacataatgaggtggcattggattaacttcagtaattcctatcatggtcgctacaaaactcgacccaacagacccacgtgatcctactagataaccacgttcattagaacgttgcaccaacatttgcgaagcaagatagataacggcaaatccattaccaagtatagatgctaactctttttcgatacgtaaatcaataatatcaggaagaggattaccatatatttcgaatgctttagcataagttaattcagcaactcgttcttcagcacgatcaacaaacggagtatagagatccccttttacaacttcaacgtcttcaaatcgatctgcaaaagtattcgtattggttacaacgatctcataggctaaatctttaccaagaaaggcaaattcatctaacatctcatttgttgtgcggaaatgtgcttttggcaaaggcgctggctgagcatcctccccacgacctatagtcctattaatcatggcaccttgtccaagactacgaacaataatctcacggtaaatctcatcttcaggctcaatataatgaacatttcccgtagctaaaacaggcttatctaaacgccgaccgacctctattaggtctctaataatttgttgaatccccacctcatctttaattaaatcacgtactaccaaggggcgataaatagcaggtggcatgacttcaataaaatcataatatttagctagggtcactgctgcatcaattccatttgataacaaggcatcaaaaacttctccatcagaacaggcagtacctagcaagagaccttctctgtgagcatctaaaactgacctaggaattcttgccaccccttcaaaatatttaacatttgaaaggctaactaacttaaatatatttttaagtccaacctgattttggacataaatggttgcatgctttatgcgtgcctttttgtaagagtcttcagctaccaatttagtattgagctccatcaaattagtcacatcacgattttcccgcgcctcttttaagaaaataaagagtaagcgacccgttgcttcagcatcgtagttggccatatgatgatgttccaaagcaacttggaaacgtttggttagaggccccaaaccatgacgcttatattcaggataaagatttcttgcaaattctaaggtatcaatgaccggctgtgtgatcaaaggcagattatgacgttcataattcgcattcataaaaccaacgtcaaaggttgcattatgcgcaactaaaaccgtaccttgacaaaaattctgaaattcctgaaggacttgtaaaataggttttgaacctctgacatgattatccgtaatacctgtcaattcagttgtaaaggcagaaagaggatgacctgggtcaataaactcatcaaattgctcaataatattacccttgaacatttttgatgctgcaatctgaattaggtcattattagctgcagaaagacctgtagtttccacatcaaatacaacataagttgcttcgtgcaaattcatatcaacttcgttgtaggaaataggcactttatcttcaacaatatttgcctctaatccaaaaattgcttttatacctgctttttttgctctgtggtagccatgcggaaaactttgaacattggcatggtcagtaattgcaatagctgggtgtccccacttagctgcagtatcaatgaggctctcgacagttggtaaagcatccatcgttgacatattggtatgagcatgaaattccacacgtttttgatctgctggcattaagtctttacgttcatgatgcacaatctctttgatatcttgaacattcattgtcaaagatttagtaaagttattgttctcaatattccctctgactcgcaaccacgaacctttagaaatcatatcgtacttcttcaattcttcatcatctttagcccacttttgcatagcaaaacttgaggtataatcagtcatcttaaaattaatgatatgacgtccagtgcgggttgtttttcgttcaacactaaaaaccattccttcaaaaacgatacgattttcttctgttgtcacctcaatcatgggtgtaatctctgctttttcaaagccagcttgacgttgtttgatacgctctttgaaatcataattttgagttggggtcacttcttctgatggaggcgctgaatcttctagtgatttttgtgcttccaaggcttgcatagcttcttggttagctttttcaagcaattgctcgcgattagtttcaaatgatgattttaagtcttgcgtcatttgttcatcagaaaccatatcaatagcaagtttaccaaatccaaacaatgaaaactgttgttccaaacgcggcaaatgattctgacgaaaatgattattattgacaaattgaggtgctgaaataatcatctgactgccattgtaatgaacttttaattgtgaaaaagaactcttaaaacttgcactattacacaagggttcacaaaaagcttgttgataataatcctgtagcagatcatcagaaaaatcaatagtttctgctcttatatcaaaagtagcctttatatctgctttttcaaaactattcactaaacgagtttgtaattcacgatacacctcaattggcaataattctggaaatgaaaaatgaaattcccataagcgtgatagagaatgaacctttacctcgataatatcagcagacgaaaaaacacttgaattcttaatttcaagcggcatttcaatctgatccataagtttcttgaacaattctgacatagttttctcctgaatatcttacttccattttatcacatatctgtaaatatttcgagataacaaaaggaggctgttaaaaaaggaatttattagccttcttaacaacactctcttaactgaaactatttatcataagcatctagactgtaggtttcaataatttggtttaatttactagcataagcagtatctgtcgcataaagacctgttagagctgcagtagcatccttataagaagaggtatttgatttccaaacagatgcatacttttgactagatactaactcagcataatcatatagtgaagcagaataatttggataggcgcgaaaaggagcttggatttgagtcatattgcctttcccatcatcttctaaagtaggcatttggacagatttacctttatattctcctttgatgccaaagaggttataattaggagccttagacaaatctgattgtccactggatgattccaaaatagcttgtgctaataagactgacgcatacaaatcataggtcttagaaatttcaatagctgttggagaaatcgtttgaataaaagtcgtcgtttgatccgatgcactagtgactgtcggttcgacattatcatttttataattataaaaccaaaccccacccaaaccaaaaaccaatagtgttgttgttaacctcaataccaatttatctttttttcgacttttcatgatggctcctttctaaaatatcatttcattataacaaaaggcagttgctttttaccaataagaaccatactaaatttcactccatataaaaaagttagcacatcagactaacttttttatcggcttatttttttgttagaatctctaaagtttcaattaagttatcagcgtgaacctcaatcgtatcaccacttgctttaattttcacttcaacgataccttcagaagctttcttcccaacagttactcgaattggaagtccaattaagtcactgtctgagaatttagaaccaacacgttcattacgatcgtctgtcaggacttcataacctttaagcatcaaatcagcttcaattttctcagtaaggtcttgtgactcttgatctttgacattgacagtaatcaaatgtacatcaaatggggctaattcttctgggaaattaatcccccaagcaaagcgataagctccttttggtgtcttattcacaaaaagtcgggcatgttgttcaatgacagctgagagaatacgactaacaccaataccataacaccccataacaataggatttgagcggccattttcatcaaggatgttcgctcccatactatctgaataacgggtacctagtttaaagatatgtccaatttcaataccacgagcaaatttcagagtacctttaccgtctggagaaatctccccttcttttacttcacgaatatcaacgtattcagctgtgaaatcacgttctggattaactccagtaaaatgataaccatcttggttagcaccagacacagcattagcaaggtcttgaactttacgatcagcaataattttaacagagtcaggtaggttaactggcccaagagaaccaaaacctgcaccaaaaatctcttttgcttgctcttcacttgcaggctctaagaaatcagccgctaaataattttttaacttcacatcattgacttgatcgttaccaactagtaaagcaaccacgggctgttcatcagcaataaacaatagtgtcttgatagtttgattttcatcaattgataaaaatccagctacctcatcaattgatttgcagttaggagtttctacttttgttacttcttcaaaggtagcagccttagtagatggtttgtactcattcgttgccatctcaaggttagcagcatagcttgattcagtagagtatgcaatagtgtcctcaccagaaactagccaagccgagagttctaccttaatttcttctaaaacatcctctggaatatcatcaatagaaggaatagttttatcaaggactaaccaacgatttaaatctgtacgattgggagttactgccataaattcttggctatctttacctcccatagcacctccgtcacctataatgcctttaaagtcaagtccagcacgtgtgaagatggcttcatatgctttacggtaatcttcgtaagtgacatcaaggtcttcataatctttgtggaagctgtatccatctttcatgataaattcacgtgttcgaagaagtccattacgaggacgcttctcatcacgatatttagactgaatttgataaaggtttagtggtaattgcttataagattttactgcatcacgaacaagagttgtgaaagtctcttcatgagttggtcctaagataaaatccgattgatcacgattctttaatttataaaggtcttcaccatatgtttcgtagcgcccagattcacgccataaatctgctgtaagaagagctggagctaacatttcaactgcaccaatcttctcaaattcttgacgcataattgttttaaatttttcaatagtacggttagctagaggcaaataagcatagattccagccgaaacttggcggacatatcctgcacgaaccataagagcatggctgataacctgagcatcacttggcatttcgcgaagtgttggaataagcattttactttgtttcattacaataagatacgactaatcaaagttgattctttttcaattgagaattgcaattgaaaaattcgtatttcctttcacgttttattatcttttagaagaaagctcgcatgatatcgttccaggtcacagcaatcattaatactaacataactgctaccccagcgagcgtaatataagtttctgtttcttgtttaagtggtttgcgacgaatggcttctaaaatattcatcactatcttacccccgtcaagggctggtatagggatgagattcataatacctaagttgatagagattaatcccattaagttgagaactgtgacgaaaccatttttagcagcttggctactagcctgatagagagctactggacctcccaatttattaatactaaaatgagcaataagtttctttaattcatttaaaattctaaagaaactttcccatgctagttttaatccacctaaaagtttgtctttaaagcttgtctttaaagctggcataatgccgatgatgtaggatttatcaactttctgtggcttaacgttgatcgttttcaccacctctttgctcttaatcttaagggcaagtttttgttttttttctaaatgcctagttgacttttctactgctgctgtcaactgttcccagttagaaactttgtgcgaccctatttgtaaaatacgatcattattttttaaacctgcactagcggcaggaccattttctgatacacggacctgattggttgataagtcttgaacacctccttgaataaaagcaagtgcaataaagactacaagacctaaaataaaattattcatcggacctgcaaaattggtaattaagcgcccccatacagaagcattctgatactgcatatctaagggagcaatacgaatttcagtaccatcctcctcaatgatagtagcatcgtgatcaacactataggtttttgtctcacttaagaccaatcctgtgatagttagtttatcttctaaatcataagctgttacattgattggtaaagaagtattgtctaattgttttcctgataaattaatacgagttacaatgccttctttatttaaagtaaggctagccggcgtccctgtcttaatttcagtcttatcatcaccccaaccagccatacggacataaccacctagcggtaatatacgaatagtataggttgttccttctttatcaatgtgagaaaagatttttggacccataccaatagcaaattcacgaacaagaattcctgatttctttgcaaaatagaaatgcccaaattcgtgaacaactacaatgacaccaaaaataataataaaggttaaaattcctagcattcaattcctctctaaatacaatatattattttagaataagccaaagaagtgcatgattgggaaaacaaaaatcatactatcaaagcgatccaaaatccccccatgacccggaatcaatttacccgaatctttaacaccaaaatgacgtttaatactactttcaactaaatctccaaattgaccaaaaatgctaaagatagccactaaaactaacatgactaggaagctatgaggcgcatagacggtcttatcaaaaagcataaaaaagaaagctaccacaatggctgaagcaatccctcctagactcccttcaattgttttatttggagacactgagggtagtagtttgcgttgtccaaattgacgaccaatcatataagcaccgatatcagtcgcccagacaataaataaagctaacaacaccttatctattccagccatacgagcactgactagattttgaaagccaatacccacataaaaactagacgcaattggaaaggcagcatcttcaaaactgtaagaattactgttcaaaacagtacctgccaaaatcataaaaataacaataccgtatgctgataaactagcgtcaactggtaaaaaggacaaataactatctaaaggaactgttaaaacaaaggctcctatcatagctaatgcaccttcaaaggaaaatatttctaaacgacgcatacgaagtaattcagaaacaccaatcatagctaaaagtccaactaaaaattggaaaggcaaaccacccattactaaaaaagggataaatatggcaagcgcgacagctccccaaataacacgttctttcattttctctcttctttctatacactaccaaatcgacgatggcgttgattataatccacaatggccttatgtagttcgtcttttttaaaatctggccataaaacgggagtaaagtaaaattcactataagctgattgccaaggtaaaaagttactcaagcgtaactctccactagttcggataatcaaatcagggtctctataaagatagggtaagctatttgtcattaaatgatttgctactaaatcctctgtaatatcgtcaggattcaacttagcttccaaaacatcctgagcaatttccttaatggcattagtgatttctgaacgtccgccataatttagcgcaaaattcaagacgagccccgaattatgttttgtcctcaaacaagcgcgttgcattgcatcgtatgttgccttaggtaatttatgagtatctccgatgacctgtacacgtacattatttttatctaactctggtacatatttatcaaaaaatttaaccggaaggttcataataaacttaacttcatcatctggacgtgaccaattttctgtagaaaaggcatagacagttagtactttaacacctaatcctgaagctgctattgtaacttcttgaagagcatccatccccgccttatgtcccataacgcgtggttttaaacgtttttttgcccaacgtccgttaccatccatgataataccaatatgtgctggtattttctccaaaggcatttctacttgtttttttcttttaaatataaacataatgttccttaatttagcaatcgtttttcttatcagcccttttaaaagagctggaaatatcccatactataacattttaccacatttcaacttatttttgagtattaaaatgccatttgtgacagcaaactaaaaagaccagaacaatcatctggtcctacatatcttattcagtttcgatggctgtttctttattttcgtcttcattgacttcaataatcttaacatcttcaactggttctgttggtgttgctgccttagagacaacagatttgatagctgccaactcaaacgtcaaatagacaccatcaacatctaaaaccattcgttgtgcttcagtattaacttcatcaactactccaaaaagaccaccaattgtgacaatttcatcacctttttgaacagcattcaattgtttttgacgttcttgtgcttgtttcttttgctgacgttgcatgaagaacatcataccaaccataacaacaagcataataataggtaagctcatttgattctcctttccgtgttctacgtaatcattactatagcagatttatgctatatctgcaaggagatactgtctcttagccaataaattcacggatttcttcttttgtcatttttgaatcgcacttcaccttgatagttccgtttttaacaaccatcaaacctggcactgtaggaatgtcatatttatttcgaaattctttatttgcagtccaatgatcaaaatcttcactatctaaatggaataattcaaattcatcttcatcagctacttctacaattttaggaacaaagaggtgacaaaatggacaagaaatacgaccaatgaacagtacaaaatcttgatttgaatcaattttatcttcaatttcggcagccgttatcaaagtcatggttgccaaaagttcttcaaaagaatacatagttaaccaactttctaaatcttatatttaaagaataacctatgatggcaaaacttgcaaggcaagagtaacaacgatcctatcaaaatcattaactcacttctcgcttcaaactatcctcaaaaatgctcactcatatttaaatgactcatcaaaaaaactgagcatagctcagtttttattttacaccttatttttgtacagcattactgacgcttttagcaactacatcggccacatcattttgaaaagcatttggaatgatgtgagttgtgcttaattcttcctccggtattaaactagctatgcctctcgctgccgcaatttgcatttcaacagttatcgtttttgctctagcatctaatgctcctctgaaaatacccggaaatgctaaaacattattaatttgatttggaaaatcactacgaccagttccaactatgtaagctccggcttttaaggcttgatctggataaatttctggaataggattcgccattgcaaatacaataggtttatcagccatcttggaaatccattctgcatgtaatgcttccggagcagaaacacctataaaaacatcggcattctccaaagcatcttctaaggatccagattggaattctctattagtcaattttgcaatcgctttgtgatgaggggctaatgactcccgatctttatcgttaataatgccaaatcgatcaactaccgttacatgttttgctcctgctgatagaagcttccttgttatagataagcccgctgaacctccaccattaacaactactctgatgtcttcaatgtcttttttaactagcttcaaactgttaaacaaagccgctaatactacgattgctgtaccatgttggtcatcatggaaaactggtatatcacattcttcaattaggcgttgttcaatttcgaaacaacgtggtgctgaaatatcctctaaattaatccctccaaaagtcggcgaaatagcttttactatagaaataatttcctctgtatcatttgttttcaacacaattggcacagcatctacatttgcaaaacgtttaaagagtgctgctttaccttccatgactggcattgctgcctcaggaccaatatctcctaatccaagaacagctgaaccatcactcactacggctactgtattttttttagtcgtcaactcatatgcaagctccacatcctctgcaatagctgatgatactgacgccacccctggggtataggcaatactaagatccctcttatcttccaccttaacttttgaaattacttctaattttccaccattttctctagcttggttgatagctaattgacctaaattttcactcattttgataactccttttgataaatattagaataacatgcgtaaaatggctgtcattgtgataacagtaatagctcctcctaaacgcgtagcaacttgagcaaatggcatcaagttcattcggtctgctgtacttaaaatggcaacatctcctgttcctcccataccactttgacaagctgaaataatacctgcttcaacaggattcatattaaggaatcgcgatacaaagaatccaacagaaataactgtaaatacaacactaataacaactatgaaatattgtatgctaagcgttgccacaacatcttttaacgggatataaagcaatcctagacctgccattagaggaaatgtaaaattaccagaaataaatttataaagttgcttagctccattttgtgtttctctaggaataacattaatatatttcaaaatagctgctgcaacaatcattaatacgggaccaggaaatccagttaattgctgcaacaaatgtccaaaaataaagagactacatgctgttaaaacacctccacccattttcttaacgtcaattgggccagaatgatcagcaataatatctgacatgtcctctcctttatttaaccttactaattgcccttgaccagacaagtgtggtttcttttctcccaaacgattcaatagtgcagtacataaaatggcaaagaaattaccaataatagtggctgggatgagttgagcaactagttgttcactagctacaccggtaattgaactatagcctaacgataatggtaaaataccttcaccaataccaccagctaaaacgggtgttacgatataaaacaaagtgtgtcgccactctaagcctaaaataacaccgacaaatgtccctaccatcatcgcacaaaccattcctaataacatggggaaaatcattcttagcaatccctgaatcaacattttccgattcatccctaaaatactaccggacactaaacaagcaatataaaaataaagaaagttagcttgcttcatcaacatatttgttgattctaaaacatttttattaatgaggttgaaaaacaccaaaatagatggtactaataaagataaaatagctgggccaccgaagtttttaaaaccaggaatgctagctccgatagtccctaagaaccaccccattgttaagataactgcaaatcctcctagcatattgactggcaatttttgtaaaaagcctgctagaagaatcaataatgctaaacaaacatatactggtaggggaactgaccctatcttaatatgaaatagtttagcctttaagtcttgcttttgacctctagaatcctcattattcactaccttcacgtctgccatgaaagcacctccttttacttcttatgtacagtttactttgggacttagtgataaggaagtttatttaagtaattgaattatttcaacttatttaattaatttaagctggattctagtttttaggctatgttatactaaactcggagggtgctgatgaaaaaaaaactatctctttgggcatttctatcattgattttagtcactatgaccatttgtatattttctattttttattatgtcactatacatcagtcctatcgtatggtaagggtacaggaagaaaaaatcttaaaaaatactggttatgctttatcgagaaatccacaagttatacaaacactcaaagataatcactatgatcaaagtctccaaaaacaaatgttattccttagcaaaaaatcaaatttagactatattgtccttataaatttaaaagggatccgttttacccaccctgactccactaagattggtaaaccatttcaagggggtgatgaacaagctgtttttaagggaaaagctattatgtctactgcagaaggttctttaggaaaatctttacgatacttaattccagtatatgatcaccaaaaacaggttggggcaattgcagttggcttaaaattaacgacacttggagacttatctcaaagtagcataaaagagtttagtaagcctctcttgattagtattttgattagcttagtcgtcacaagtataatttcttatggcttaaaaaaacaacttcacaacctccatccaagtgatatttttcaacatttagaagagcgcaatgcaacactggaccaaattcaagccgctgtatttgttattgaccagaggcatatcatcaaaagaaataatcctgcagctagtttattattcaaaaaagaggggcaacgagacctattttcaggtaaattattagaatctttaattcctcaactcaagcaggatcatttttcaaaaaaaactgaacaagtattacattttcaaggacaagactatttactatctatctcgccaattacggttaaaacacaaaatagaggctatgttgtcttcttaaggaatgttactgaaacacttttcactttggatcaattagcacacactacagcttatgcttctgcgctacaggcccaaacacatcaatttatgaatcaacttcatgttatttatggacttgcagacattgaatactacgacgagttgaaaatttatttaaaagaattattggagccacaaaatgaatttttagcacgcttatcaatgttagttagagagcctcgactggctagtttcattattggcgaaagagaaaaattcgcagaaaaacacatcaatctatccacagaaattttagtagaaatccctaccaagtcaactgttgaggatgttaataactatctcttgctccacagatatattaatacgaagatactcacgctattaaattcaacgactttagtttctttacgtttaaattatcaaaataacctcattgaaacagattatcaatgggagaatgagaagtggttactcaatgactaccatcagtatttcaacgacgcttattttcaacagttacttgtagattcaagagctacttataagatctctttaaaacaaaataaggttattataagaacaaatattatctactcagaagggccttagtatggacgtattaattatcgaagatgatcctatggtggaatttatccaccgcaattaccttgaaaaactcaattattttcaaaacatctattcaactgctagtcaaacacaagctattgcttatcttaatgacattaaaatccaacttgttcttttagatattcatattaaagaaggcaatggtctagaattattaaagttattacgcaatcaacaccaaaataccgaagtcattgttatttcagcagccaacgaggcgcacactgtcaaagaagcatttcatttaggtattgtagattacctgataaaaccatttacatttgaacgctttgagtctagtattgaaaaattcctaaatcattatcatacatttgaagctgataaaatctatcaagacaacatcgatcactttcaaaaaatagattctggatggctagagggagaggttaaacttgatgagaaagggctctctgaaattacctatcagcatattcttgatgccattcaagagttagagcagcctttcactatccaagagttagcaaaatgcagtcaattttctcatgtctctgttaggaaatatattgcctatatggaagaaaaaggccttctgacaagtcagcaaatttatactaaggtcggtcgtccttacaaagtttataagcttataaaaaaaaacttaggcctgtagacctaagtttttttaatcttcgtagccatttggatgactagaatgccatgcccatgccgatgaaataattttatcaatattatcaaatttaggctcccacccaaggatttgacgagctttctctgaggaagcaataagcgtatctggatctcctggacgacgagctgccttttgagcaggaatttctttcccagtaatacgacgagctgcctctaacatctgaaggttagaaaaacctgtcgaagatccgagattaaacacgtttgattcattcccttggcgaaggtaatcaactgctaatatatgagcatctgccaaatcaaatggatgcacataatctcgaacattagttccatctggagtattgtaatcatctccaaaaatcattattttgtcacgtactccttgagcaacttgaagaatgattggtaacaaatgtgtttctggtttatgatcttccccaattgagccatccggtttatctccagcaacgttgaagtaacgtagagcgacaaacttaataccgtaggcttgatcagcccatttcataattgtttccatcataagcttactttcgccataaggattaataggattttgaggagctgtttctaaaataggaacttgttctggaataccatatgttgcagctgttgatgaaaagacaatatttttgatatcacattcattcattacttctaaaagttttatcattccagcagtgttattatcaaaatattttaaaggattttccattgactcagcaactagtgaaaatgccgcaaaatggataacagcatctacatcaggattttccctaaaaacttgacgcataaacgttttatcggataaatctccttcataaaaaatcgcatctgaatgcaccgcttgacgatgacctgttaccaagttatcaacaacaataactttctcttttccttgtgtgattaactgatcaaccatatgcgagccaatgtagccggcgccacctaaaatcagaactgccatatttttctcctatttcaatactcttttaacatcatttgttacctcattatactgagaataagctttttttgcaaatatctaccgaaattagaatagctctatgcagaaggcatcccacggcttgagagtgttacttgatagtacttcttgaacctctgtatttgaaataatagtttctttaacagcttctggaaattcaaaagattggttttgatcggataagttcgcaactattaaataacgttctttatctgtttgacgaacataagcaaataccttatctgctgtttccaaaagtttaaaatcagcatcaactaaccagtcgtgttctttacgtaaagcaactaatttttgataagtataaaaaatactttccgtatcatttaacgctgcctccacattaatttcctgataattgggattgactgctagccatggggtacctttagtaaaaccagcttgatgttcttgactccactgcattggagtacgagcattatcacgaccgactttacgaatactatctaaaattgttgcttcagataccccattatccatggcttctttagcatagttaagggattcaatatcatctacatctgctaaacactcaaatggataattagtcataccaatttcttcaccttgatagatataaggcgttccacgcatcaaatgtagtaggattgctagagccttggcagattgttttctgttatcactatcatttccccagatcgagagcactcgaggaaggtcatgattattccagaataaagaattccaaccttggccaagctccaattgtgtttgccattttgtaaaaatatctttcaatgctggaacatctaatccgtcactgtaatcccacttaggagcgtcaggtttatgttgaagacctacatgttcaaattgaaagaccatagataattcttcattatcgggatttgagtattgttttgcaatgtctggcgttgctccccaagtttcacccaccgtcaataagtcatgctttccaaaactagctctgttcatttctttaagataatcatgaagttttggtccattaccagtaatgcccttatctggaattttcccaattaaatcaatgacatccatacggaaaccaccaatacccttatcaatccagaaattcatcatatcataaattttatgacgtaaagcttcattctcccagttgagatctggctgacgtttgctaaaaaggtgcaaataatattgacctgatactttatcatattcccaagctgagccactaaaaatagaagtcaaatcgttaggttcatctcgccaaatataaaaatcacgttcaggactattagggttttctcgcgcttctacgaaccaagcatgttcatcagaggtatgattcactaccaaatccatgatgattttaatcccgcgttgatttgcctcttgtaacagttggtccatatcattcatatcaccaaaaatatctgcaatggcttgataatctgaaatatcataaccattgtcatccattggactttgataaacaggtgataaccagatagcagtaatccctaatttttcaaggtagtctagtttgctagtaatccctttaatgtcccccacaccatcaccatctgaatccataaatgaacgtgggtaaatttgataaatcgtagctttatgccaccagtgtttcttcattattcttctcctatcaataattcattcatcttttattttaacgtttttcctcttttagtgcaagcgtttgcgtaaaaacattataaaaaggctggaacccaacctttttatgaatatcgcttataccttaacgaatagcttgttcagtatctgcatcaaagaaatgccccttagcaacattaaacgttaggttaactttttctcctggattatggaagtcacgcgcttcaacacgagaagcaaattctgtttgacctaacttaacataaagcatagtttcgctaccgagtaattcagaaactaaaacttctgcttcaacattggcatttggataagtatcttggacaagaagattgcttgaaatgtcttctggacgaataccaaaaatcaattcttttcctttatagcctcgtgattctaaaagtttttcttgaccttcagggatagcgattcgaagaccatcttcactaataatcataccattttcaactttaactttgaagaagttcatagatgggctaccaatgaatcccgcaacaaatttattggcaggaagattatagagttcttgtggtgaaccaacttgctcaattttaccaattgtaccatcaccatcagggttcttagtagctgacataatgacaatacggtctgccaaagtcatcgcttctgtttggtcgtgggtaacataaatagttgttgaaccaatacgttgatgaatttttgcaatttcagcacgcattgaaacacgtaatttagcatctaagttagataaaggctcatccattaagaacactttggcatcacgcacaatagcacgtcccatagcaacacgttggcgttgtccacctgacaaatccgcaggtttgcgctctaagaattcagtaaggccaatattagctgctgcttcacgaacgcgcttatcaatttcttgttttgagaatttacgcaatttgagcccaaaagccatattatcgtaaacagtcatatgtggataaagagcatagttttggaaaaccatagcaatatcacgatctttaggtgatttgtcattgacaacttcgccatcaatcttgagctcaccttcactaatatcttcaagacctgcgatcatacgaagtgttgttgatttcccacaacctgatggtccaacaaaaacaataaattctttgtctttaatatccaagtcaaagtcttcaacagaataatgcgatgcacttggatattttttgtaaatatgatttaaatttaattctaccattagattgacctcttttattattgtgattttattatagcaaagaaagggttttcatataatggtaaccttgcctaaatttcttgtgcaaactaactaaattttaggtatccatcgaaatcaaataggcataggctaaatcatctaatatttttaaattaagtcccgaagattgggtaaatttatctaatttatattgcaatgaattccgatgaatgaaaagtgccttagccgttttagcaagatttccttgctcttgccacagggcttttattatagccgaagtatcactcgtatcaaggatatgttgtaaacattttgctttaatagaaggcatgggcgattgatttgccaaagcccataaagccatctttggaaatcgacagtaatgttgttcggccttgtgactaagaaaaagcgtaaaaagtttatattcttcttcatataattctttccagtccactgcttgtagatgcgtccaactatttccaaaatagcaccttaaacgcgtgttaaagtcattttcaatcgttggtaaaatatctgttagtaattccgtagcattaaagaaattatcctgatttaaaatcatgacactttgggtttgattaattgtcataattgtttctacgtttattactaaaggcgacaagaaatccttaagttcttctgataaggtaaattgatgctcaataaaaataaattggactgccgaatgagattggggcaaccttccacgaccttcaactagatagcggtaccaaggattctgagaatccactgaactcgcatcttccaggcttggtgtcatttgtaataagtatagttcacgcttagttagcgaagattttggaaagtggaggacatgaccatcttgctcaacgatgatataatcctcactctgtttaacttcctgtttagtaataacttctggaaacagttccttaaaatccatggcatcctccactacagttttgttcattatatcatatttataacctctttttgagcacagaaaaagaggagaatgtctcctcagaaaatttctgttataaaatagtgatccgaatagaatgctgtttcgactgctttggattaagccgtacgatattttgtttatcttctaaaatatcagactcttcaatagaagttgacaaagaactccagggttccaaagccaaaaaaggaccaccattgttacttgtccaaagaataagattctcaaaatcatcaaagtcaagttggattccttttgcatgatttctagattttaagtaaaccgtcttagatcgtagttggtctaaagtaatagcatctttttcaaataaagcatgattaagagataattgtttttgattttctaaaaaaggatgtctagcttgtaaatctaacaagcctgtatccggaaacgactcaggaattgtgcaagtttcaaactgttcaaactctagatagtaatcactaaatacttccttttcaaacaaagggcaattaaagcctgggtgagctccgatagcatatggcatatttttttctgattctaagtttttgacaatatatgtaatggcaatgcttttatttcttaaggtgtaagttatttctaaactaaaacgataaggataatttatcaacatttctttactacttttaattgtaaaacgaacagaagaatccgatatgtaatcatagtcgaatgttttgtgacgtacaaagccatgccttggtatgatacccgtaaaatgtggagcttgagctggtctgtaaatgacgcaatcatttcgaacacttccgcatataggaaataaaataggagcttgcccaccccaataagtggcgtccccttgccaaaggtactcaacgccttgactatctgtaatagaagtcattgttgcacctaacgcttttaatgtcacttgcaactcatgattttgtatcgtaatagccattatttttcctttcataaagaacaataattgctttaccagcttttctctagcaattatctttccttccaagaagttgctgttttttgcaaaattttatttagttcatcaatattttgaaaacctattgtacgtaaccattgacgtgcaccagcttctcctttttcaacatactctttaacacttccagcccaagttgctctaccacaaaggacaccgttaaatttagcaccagcttctttagcaaacacaagagtctcttgaaaaagctgagcaggaactcctgcactcaaaaaaatgtaggggagtagtgtcgcctgatcttgttctctaaaatatgccgcagctgtcgctttattataagcagtctctccttgcgcaaaaccttctacatagtccatattgacaggcacttccaccttcaagacatcaatattaaatcgaggatttgaaaaaactttcatagcttcaataaccttacgtggcttaattttggcatactcaatacctgagctatccgtaatcttttcatcatatgacaaaatttcaaggaaaaaaggaatgtcttctgcaacacattcagaaccaatccgttcaatataagcttctttttcttcgtttacttcatccgaactatcaacatcataataaagtaagaacttaactgcgtctgctccctcttctttaatgcgtttcgcagaccaaatgtctaaacagtctgggagtcgcttggtactactggtatcataacccgttttttcgtacgcaagtaaaagaccggcattgtcatctaaaactttcgtagctggcaacccatattctggatctaacaacattgatgaagcgtaaggggttaattcttcagctaccaaaactttaagtgcttctatttgagaaacagtgggctcctcagattgatattttgccattaatcgcttcaatgctccacgttggtcaaaagccaaggccgaaataataccatttttatcactcaattgttccatatgtttttgtttttgttctgttaatcccatcctatacctctttcacttggatttgactgattaattcttgatagtaggtcagattgatatgccctgttaatgtttcttgtgcattaagcatacccaagacattagctctcttaagcaaatttgtatcatctagttgatgttccaaagcagacgcgattcctgcaaccgttgcatcccctgaaccaactggattaataacttctatttttggaatcgtcacttgatagtagtgattcccatgtttagcaaaagctcccctagcacctaaagaaacaataacccaatcaattcctctaaaaagatcttgctgtaaggtagattttaattcgtctaaactatagctaattggttttccaattaattgtgttaattcttcaaggttaggtttaatgacggtcggcttagcactagattttaaaaccgaacgtaatgcttctcctgaacagtctaaaacaactttcttattaaagtgattcgctagggagattaacctagcataataatctgaggggagtccctttggtaaacttcctgatactgttatgatagttgcagcatcaaagataagttttagatgattcaaaaaggcgtctgcttcatctttagtaatatgtggacctttttctagaatttcagtctgctgaccctcatgtaaaactgcaatacaatgacgtgtttctccaccaatacttaaaaattggtgtctgatttccaatgcatctaagccacttcggatgaaatctccaaaatccccccctaatagaccagttgccactacattatcgccaagttgagaaagaacacgagtcacatttaaccccttacccccaggtgttttggagacgtcggtaactcgatttacagtatccatgttaaagttttctaagcagtacgaaatatcaatagaagggttcaaagttactgttaaaatcatagatatctccttagtcgtgatattcaccacgattccatttatctaagaactctgtgaaaaagtcattctcttcttgatgggcattatgagtctcaacctcggctatcttttcaattaatactttgttttcttttgttggtttatatttagctcttataaacgcctcgatgatatctgtcattaacagcccaccagtaattttcccaccaaatccgataacgttagcatttaattcttctttggcatagatagctgatgtcaaatcacgtaccagagctgagcgaattcctggaactttattaacagcattattaataccaactccagttccacaaatacatacacctaagtcggcttttccactagcgacagcttctcctactttcttaccataaataggatagtgagtacggatattatcataagttccacaatcaataacctcatacccttttgtttttaaataatccacaactgcaattttgtcataagttacaatatgatcacaaccgaccgcaattttcatctgctttacctctcttacgcttagcacattttattcaacatatcgacccgaatttgatgacgacctgcatcgtaagtcccatcaacaaaaccctctactatatgtttagcaactcctggaccaacaatctctgaacctaaagtaatcatcctagcgttattatgagctctagtcatataagctgagcgttcatctgaaacttctgctgcaatcatccccttaaccttagtggctaccataaaaggaccaacaccgtaagcatcaaccattattcctaagttatcttctttttgattcactttagcaacgattgctaaggtattatcaacgaaatctttgctagtatccgttaaatcaataatttccttacctaaacttgtaaggtgttgtctaatcacttccttaagttcaacaccatgcgcatccgccccaataataattgtcatttctttctccttatttcacttttaatacaattgtatgtagttggaagatattgtttgtttttgtttgtaatatcatcatatatcttatttttgtttttgtcaatgttttgttttgtttttgtttgaaatgaacaaaaaaaactccgtgataactatgtcaactaaaattcactactagctagctatcacgaagtttgatacttcttattatttttatttgtaggaacgcttattccgcaagccataatcataaataaaatttaaacaaaacatgccaatttgctgccattttctcccataaagtgccttgcttctctgtattttgactaagaaaactccaattaaaaactttgtaatttaaagtaaaactattttgatgtttttctctatgttcataaaggacaccaaatttatcattattaagttgttgaacagagttgtaagcaaacgaaccatcttgaatgtgatggtgatataaccacttaaaactaccatttcgattaacttgcgctagacgtgcatatccatcttgacgcttcttacctggcccattagcattcactaataaaatatactcttttttgtcatgctcaaagcgaatagctgataattggacgtaagcatcatgaacttccttatatcgtttaacatggttttgccaagtctccccgccgtctttacttgtggctacttctaggttaccagttagattcctcataaataacttaatgtccccatttttcaattgaacgggtacggattctgtattttgttcttttttattatccattgttaaggagtgaattttttcaccattagaaagtatacggttatcattgactgcttttccagtatgccacgtttttccatggtcgtctgaataaattaggcgtgaagattgtgaacctcttagatgagatttccaattcgtagaataggcaggaataataatacgaccagcgtgtggcccccattttaaaactataccttttccaggtcctattcctaaaaatttcatgcctttctgacgaagacttgctgttatatctctaggtgatgaccatgtcctaccatcatcatcgctatatgacatccacacatagcttgattttgctaaacgaaatggtgacgttttatgttttgtaaaatatatatttccaagtagctgttttcccttataaatatcccctagatttgaatggtcacttttagtagtttctgttataacatgataatcagtctttttccctttaaaattatatacaatacctttgtcacggatagtaaaaaccttcgatttctttccattattatataaattaagataagactgtcctccgatttgggtatattctttttcaggtgtgttagcaatactaataacgcctcttccttctggaaacatatcatatattgaaaaaatacgtttcgtcttagagctagtatcttgaactaatgccatatccatattaataggtgagccactatagtcaccactagtaactagcggaactctagggttattacggagattgacaatagtttctctttttccccaagtgacaccatcatcctcactacggcgaataaccattcctatgtttccccaatcacaagcttgctcaattctttcatcagctcccacaagtaaagttcctttttccgtttttaataatgaggggatacggtaaccaaacacattatctttattttttctcccaaaatctcctcccctatatacttctgttttagcagaaagtatagcacctttaggtaatttgagctgatggtttagatgacaataatattgaaaataagattttatatcttcaaaattcaaattatcaacacagcaaacaaggcagtgtgccttagcttttaatttttgccataaattaccactatattttatttccttctctactttctctttgccaatagcaagcatcccctctataacagacgataactttccatccttttgagagaatgttttagtaagatggtgttcctgtatcgcattctttttaaagcccaacgatatctgactagcaatgtccgtattacctatgacattacttgtcgataaatctcccttaggaatgatatccaaagacctcaacttatccctttcaaaacctctatcctctctcgctgtctttctaaattcatcgctattaagtaatgcaaccgaataaccctttgattctatcaggaatctctgttgttctgcaatggaatgactgctttcgggtataatataggtagttctattattaggttgagttgcatttagttctgctaaatttgcctgtttacgattttcttctgtcgctatttccgattttagaggaggtgacaatttttcttgactgtcagaatcacctaagactattaccatatctttatctttttgatcatctactattaaactgtccgatgtatcagaatctaattctaactgcctctcctctattgaattagtaagcttatctaaagtagagtcaaatatgggaacagtagttttttcatcatctattgatataaaagagtttatatcagattttatttcctcactataaattgtactaggatgcaaaaatccacataataagataaaacctagcatcatatatgtactagttatcactcctagacggcgtatcgttatagaaggtttcccaaaggttaatgtcatagaaactccaagtcttaaaatattggttgcatacatcaactctagaaaaatgggagttcagtaatgtttccaaaaaggattgtataccaacttatcactattttcaatatatttttataattttactagttttttattattaagatgagcgaaaattaattatatatgttatttttaaaatctttaatatatcaaaaacctagaaaatataacattctcctaggtttttttattctatttatttttgattagctgcatattctgcattacggcgtttcatttgtttagcataccacataaacaaaccaagataagctgtcgcaaaaataattaatgttataatcgctgataattgacctgttgtcgctttaccaataacgtaaccaaagattttctccatagggccttctagtgtagagtgagtgataagtgaacctgctcgcgccccagctgggaatgcgcctacctttttagctaattcagttgcaaatggggcaatcattgttcctgataaaagaaatagcggtaatagcaatgttccaaaggtaatcatacgaattaaacggccacgtgtaacaaccagtaaagcaggggttacgcccattgcgataataccagcaagcggtagaataccattaccaactttagagagtaaaatagcttctactagcataatcggtgcaagaatgttagcacatgcccaaatctctgcacgtccggcaataaatggccagtccaaaccaatattgaaacgacgaccatgcattttaccattagcaaaattagtaattccttgagaaagtggttctactgcagcaatgaaccaagaaccaatcaaagagaacaactctaaacaagcacctgctgtaaaaccgagagaaaaccagccacctaatgctgcaaatgagaacacggggttgcccataatccctatgacaagtcctaaaatcataccaataaagaacttagagccccagaatccaatggctttatttaatttagccgcgtcaaagtcatatttatctagccctggaaaaactttatcaaaaagcttatccaaaaccataataatggggttcatcatataattcatatgcgttgaagtcatgggagaagttggacctgtccccaataaatcatcaaaggtaggtttcatcaaatcagaattgataatttttagaacaccaacgaagataatagctacagttgcaataatgacagataaaagtgttggtagattattttttttagcataccacataattaaaagacctgtgatagataaatgccaaatatcaaaaatatcaacatctaaggtatccgtttttttcataacaatcataacaatattgacaataagcatgattaataagaagtaaagcgtatatggtgatccccatgtaatagttgctaatggagcccaaccaacgtcaataatgcttagattgattcctgtatttttaacaaaagcttgaagtgattcagaaaaagcaccagttaaaataccaataatagcaccaatacccgtaagagcaatagctaacttaataccaccttcaagtgctttagaaaacttcactccaaatatcatggctaaacctgtcatgacaattagcatcacaactcccgaacccatatggataattggatcaaagaatttattgacaatatttaaaaatacctgcatgttccttctcctttaagactaattccaattttaaatatgttatgatagattgtgttctttgataacttgttctaaagcagtaaagaccggttcgctcataactggtatgcgataaagaataggtcctgcttctacaactggaattggtacattaaaacctaaatcagttttagcaataggagtaaagatatcatatttgttgaccatttcctcagtgatatccttaaccataacagcatcacaatgtacattgtaacctctatctcctaattgtgtctcgatagcatctttaatttgatgacttgagtttacgcctgcaccacaagctgctaatattttgatcatgttaaaacactcctttttctattaaataatgattaattttttctttattgtcgccaagctcatgtagccgatctaggtttccttttgtaataaagaaggtaatcaaattagataaaatatcactttggttactattcctactattaatgatgaagaaaaaatcctgaaccctacactcctcttctggattaatcatatgtttgaaagtaattggctgactatttttgacataaaagattctatctactagacaatactgcgtttcagtgtgtggaatagcaacatattgaataggagtcccatcttttaaatcaatttttaaccccgttggaaactctctctccctttcttttactgcctgtcggtagttaggactaacatagtgttgttttatcaatgcttttgatactaagtcaaataattcttcctgagaatgggcatcaataaataaaatatcttgagtcacagcaaacacctttcttcttagttaagcggttacatttttgttgtaaggcaaacaagccttatcaacttatctacatcaatattatacaaaacaaaataaaacattacaagacattttttattttattttgtttattattgtttattttttcaaaattattattattttagctctatttatggtatgatatatataacgaagaggtaggagaggtcattatgttaaagcgagaaagattacaaaaaataatagaaaaagtcaatataaatggcattgtcactgttaatgaaatcatggaagaacttgatgtatcagacatgactgttaggcgtgacttggatgaattagataaagcaggactgttaatacgcatccatggtggtgcacaaaaagtaaatgcatcaccaactccacaaaattatgaaaaatcaaacactgaaaaatacgatattcaaacaaatgaaaaattagaaattgcccaatttgcaaaacaattcatcaatgatggtgaaacaatctttattgggcctggaacaaccttagagaaattagccacgcaattacttgattttaaaattagggtagtaaccaatagccttcctgttttcaatattctgaatcaaagttcaacacttgaccttatccttgtagggggagagtacagagaaattactggtgcttttgtcggttctgttactattaactctattaaatcacttaatttttcaaaagctttcgttagtagtaatggtgtttttgaaaagtctatcgctacttacgacgagggagaaggtgaaattcagcgcattgctcttaataattcctttgaaaaattccttttagttgatagccaaaaatttggtaaatatgatttttatactttttatcaattagacgatattgattttgtattaacagatcataatattgataatgttgttaaggagcaatacagtagcttcaccaaaattttaactaataacaattacatgtaataaaacaagtgagccactactagaaacctgttatacagcttttagtagtggctctttatttagtgattataactttagtcgttttataaaagtcaaaacaagaaaacttcctcaaacaaaaatatattaactctctttttaagcgtaaaacaatggttgttcaaaagaagaattagatatatcattaaaagcttcgcacgctagaaatcataactaaaaaacaaacaagtacggtgacttgtttgtttttagttgtcagctaagtttactcaactcttttattatttcacttctgttagtgttttaatatcaacaagcactttagagccatcttttttagtaacttgaacttgactaccattaatataattaaagctttcaaaacttacactatatttatttgataattggatgagttgcttttcaaaagattgtctatccataccatatttcttagcgttttgtgccattcctagttcatattcatctagctctgattcatcttcttgtttttctggttcttcttcgtctgaccctttattaacatcataaaaaccatagttgtgagttactttccctgaatcttcaggttcttcatctggagcataatttttggctttattgtctttatttgagcctttgttatgatcactgtcgtgtccccaacctttttcttttggtaattcattaggatgttccatgtagtatttaattgttgagaagagttgttgtaatgtatagccttctggtgctttccataaaccacccttgtcaaaccatgccataggaacattatgataatgatcatgatgaggaacaatcaattgatcatcttcaaatccaactgcatatgccatgtgagcagcaattttatcaagcggtacaattttttctggttttgcttgtttgaatacttctgcagcacttaagtttttgtcactagaatttgatgttgatttattatcagttggtgcaggacttggtttatctgctttattagagtccttttccttataaatttcagcatctttaccccatccttcaactttaggacgtttttctgggtgcatcatgtaatatttagccgtagctaaatagtcttctaaagaatatgtcttatctgaatcagctaaaagatctttttcttcatcaaaccattttaattccacataatggtaatgatctttatgaggaattacaaatgtaccattcttatagtctgtcgcttgtgcaattccaaataataaatcttcaggtttaacaattgcttttggttcaattgcctcatagatttcttgagctgttttacctgtttttggtttgtcttgatttgcttcagattttcctgaaagaaattcttgagctgcttttaattccgactctgataaatctttctttggtacccaatgctcatgtgtcatataatgtaaccatcagatgttgtgtatttaccagcttttttgcctcttcaatttcttgagcactgtagacaatctggctatttggtttgcctttacgttggtctttcggtgttactgcatggtgttcttcctctgtgtgaggttccttattaggttcatgagaaatatgctttggtttctctgtagaatcttttttccctaatgcatcaatatgatgtcctctatgctctgccaccatccttgttgcttctaactctaatggagacatatccttatagtgaataaagtggaaatgattaccgtgcggaatagaaacaccgattgctgtgaaagcattaacttgtgctgggtcataaaccaaaccatcactttctacgtgacgagcatataacggttgagcatataaacgtttcaacattttgtctaaagcagaatctttgttgattggtttggttgtaggtgcatggtgttttggtgccgtagcatgattaccagctggttttgaccagtgatttgcgtgagtgactcttggaatagaaataggggcattagcatgtcttcctgttgatacattaccgcttggtgcacttgcatgaatgtatgaacttgaatttgatggttttgagctattacctgatcggccagtcttgcggttccaatatgcctgtgcggctgataactctgatggagataaatcagctttcgggatataatggaaatgatcgccatgtggtactaaaaaggcatctcccatgtcatcaatgacatctgttggactaaaaacataaccatcatctgtagtatagcgaccgctagctttcgcttcacgtacgctggctgataaagcttgagtttttgcactactatgctttcctgattctcccttagaaccacccttagaccattcttcgcgttgcttttggatttgttcctttgtacgaacatttgttcgtttgctaccttctttaagatagaggtaatacttaccgttaactttgataatataaccatctttgacttcattaatgacatcagctttattaaagacatagctagggtctttcataatcaattcttcactaatgatggcatcatatggcactttcccattgtaataatggtaatggtctccatgagaagtcacataaccgtcgtcagtaattttaacaacgatttgttctgcagatatgccttcttctttactgatttggtcgggcgttttatttacagctgttgcttgtgctttgctatcagatttatctgttttcacataagaaacactattgtctgatttttgggcattatagctacctaattggtaagcacctacaccagtaccaaatagagctactgataaagcactaataataactgtttttttacgattcatcctgcgtcctttctttatataactacctattgatttaacgatttgacaagtaccttaagattagtttccaaattttctaagtaatctttattgtttttgggaactgcttctaaaggacttaaacttgcaattttaactcgagtagctgaagctactgcttgagctaatttaggtgagactccttcttcaacaaaaatagtcttaaccttatatgttttcacaaactcctgaatttcggctaattttttagcactaggttcttgctcggttgagacacctgcaatacctaactgagtcaatccgtatcgcttagctaagtatgagaatgctgtatgtgaagtcacaaagtatttagactttgcagctttaaattttggcttatacttctctgcaatagccattgccttgtcactaaattgatcagcatttttttgataaaccttagcgtttttaggatcctttttagctaattgtgtagcgatgagttgtgcttcctcagatacttttacagggtcattccaagtgtgagggtcatacaaggttgactcatctactcctttttctgcctctacatcttctaagccatgaactttatccaaagtcataccttttgaagcttcaattacagatactttagagtgatgcaaactaggttccaaacgtctcgcccaagcttctagtgtgtgcgaatgataaagaaatagatcagcatcataaatggcagcaacatcacttgatgagggttcaaaaccatgaatacctgactgtgatcgaatcattttaatatcattcaaatcaccagaaactgcttttgtaatggaatatactggataaaagctagtcactactgacaagccatttttttgctggctttgtttagtacaagcacataagcaaattagggtaactactccgagaacaaaaataaggcttttccgtatccttttcattaaacctcctttaaaataaaaaatacttaaccagttaatattttagagtattcttattttagtgtcaacgaaaaaccataaatctaatatttttctatttttaatattgttaagtgcacttaatttcatatcaacaacctttattcatgcctttccaagctacagtaaatcttttcataaacatgaatgggttaaggagtataattagaaccacaataaaaagagccaagcattctgcccaactctttggttttttatttatttttagtatctaaaacgatagttactggtccatcattaatcagactgacttgcatatcagctccaaattgacctgtttctaccgaaacatgatttgctaattcttgattaaagatatcataaaactgattcgctttaacaggatcagctgccccagtaaaagctggacgatttccttttttggtatctgcaaagagtgtaaattgtgagatagataagacgcttcctttaatgtcttgaattgaaaggttcattttcccctcatcatcagaaaaaatacgcatgctagtaattttacgaactgcataagcaatatcttctgttgtatcttctggagcaatcccaactagaagtactaaacccttctcaatagatccgactacatcatcttcaatagaaacacttgcttgattaacacgttgaataatgattttcattttgctctcctaaccattcgtacgtttaacagaataaacatctgggataattttgattttatcaaccacagttgtcaattgtgctaaatttgaaattccaaagctaacatgaatattagcaaatttcatatcttttgttggttgtgcatttactgtcgatactagctttgttgcatttgataaggtttgaagaacatcattaaggaggccactacgattcaaaccataaatatcgatttcagccatgtactcttttttagatccatcatcatcccactcaacatcaatcaaacgttgttcgtagttctcctgactctttaaattttgacaatctgaacgatggatagccacgcctctacctttagttatatagccttcaatgagatctccaggaacgggattacaacattttgcaatacgcattaataaacctgaagctccttgaatgataacaccattttcactcttaactttgagaacatcacgcttatcggttttgatttcaccaccgttaataagttcgtctgcttccgctttagccttagcacgttcctcctcacggcgttctttttccgtcagtttattaaaaatactaatcggactcaaatcaccaaaacctacggctgcatacaaagcttcctcacttttaacactgacacgtggaaggatttcttcaatatgtttcttatctaaatatttgttaggcacataaccttgttcttggaaataatcaaccagtaattctctacctttattaatagaagtttctttatcttggtttttgaagaactgacgaattttattgcgagctttattggtcttaacaatcttaatccagtcacgacttggtccaaatgaattagggtttgtgataatctcaacaacatctcctgtttttaacttagcagtcaatggaaccatacgtccatttactttagcgccagtagctttttctccaacttgcgtgtgaatagcataagcaaaatcaattggtccagattcccttggcaattcctgaacagcaccatttggggtaaaaacatagatgcgttctgtaaagatatcttccttaacagagtcaacaaaatccttggcgtcttttgattcatcttgaagctcaactaattcttgaatccatcccataccaaccgattgctctgcttgattaaccttactggtgattccttttttataggcccaatgggctgcaacaccaaactcggcaacttgatgcatttctttagttcgaatctgaatttcaattggccctttaggtccataaaccgtcgtgtgaatagattgataaccattggcctttggtgccgcaatataatctttaaaccttcctggcataggacgccataactcatggatataccccaccatggcataaacatcactagcagtttccatgatacagcgtatcgcaattaaatcataaatctgatcaaagcgtttctttttatcacgcatttttctgtaaatagaataaatgtgttttggtctaccataaatatcaccatataaaccctgttcctcagtataggatctgattttatcgacaattatatcaaccaactcttcgcgttcacgacgtttttcactcatcatatgagaaatcttataaaattccgtctcattcaagtaacgaaaagataaatcttctaattcccacttgatacgactaatccccaaacgatgcgctaaaggagcgtatatttccatagtctcacgtgaaatacgctcttgtttatcttttctgaggtgtttaagggttctcatattatgtaagcggtcagcgagcttaaccaaaataacacggatatccttagacatagccattaacattttacggtgattttctgctaactgttcttcatgagatttgtactccactttacccaattttgttacgccgtcaataatatcgcgaacatccttgccaaaatcagtttcaatctcatcaagggtaatttccgtatcttctacaacatcatgtaaaaaaccacaagctaccgtaacggcatcaaggtgtaaatctgcaagaatacctgctacttgaattggatgaataatgtagggctcgcccgactttcttgcttgataataatgagctgcggttgcgtaatttaaggcaaattttacaaaagcaacatccgtctcactcatgtactgggatgtgattgcaacaacctcttctcctgttaaattaatttctttgaccatagttatcctctttaatcatagtgatagattgtacctattttatcactttttaacctaaaaataaaagaagttagaggctcaaaaagaattaaataccaagtaaatgtgtctaactaagttatcctttataaataaacgattgtttttggtgtaatcactaaaaataattcgtaaatgagattgattaaacgttttcaataagctataatagtttttagattaggataatatacatgtaatgttttaatggaggagatttatgtcaaaacattatttttcaaaaagcgtattcgctttaactgtcttaacagctacagcaacaagtggtttagctgttcaagcagaagacattgttacaacaccaagttcaacctctacaaaggttgaatcaactacccccactagcacaattgcagaggaaaagtcaaacgttacttctactccaactgcaataactgatgcttcaacagccacaagcacaaataccactaccaataaccaaaatccacagcctgttgccacagaagccacaactagtgatctcaaacctattgaaggtgaaaaagttgaccttcgcatcatgtcaaccacagacctacacaccaatttagttaactatgattattatcaagataaagaatctcaaaaaatagggttagcaaaaactgctgtccttattgaagaagcaaaaaaagaaaatcctaataccgtcttagttgataacggagatgtcattcaagggacacctttaggaacttataaagcaatcgttaaacctgtcgcagaaaatgaagaacatcctatgtaccaagccatgaatgctcttggttatgatgcatcaacactaggtaatcatgagtttaattacggtttagattacctcaaaaaaatcattgctacagccaaccttccaatcctcaacgcaaatgttttggatttcaaaacacatcaaccagtttttaaaacttatgacatcattactaaaaccttcaaagattcaacaggaagagctgttgcactaaatattgggattacaggaattgtacctcctcaaatcttaaactgggacaaggctaacctagagggaaaggttattgtcaaagattcagttaaagcaatcgaagaaatcgttcctactatgcgtgctaaaggagcagatgtcattctcgttttatcacactctggcattggagatgatcgatatgaagaaggtgaagaaaacgttggctatcaaattgccagcatcaagggagtggatgccgttgttacgggacactcacacgctgaatttccatcaggtaacggtactggcttctatgaaaaatacactggagttgatggtatcaatggaaaaataaatggaacacctgttacaatggcaggcaagtacggggatcatcttggtattattgatttaggacttagttatactaatggaaaatggcaagtctccgaaagtagtgctaaaatccgtaaaattgatatgaactcaacaactgctgacgagcgtatcattgcattggctaaggaagcacacgatggcactatcaactatgttcgccaacaagtaggtacaacaactgcgccaattacaagttactttgcactagttaaagatgacccttcagttcaaattgttaacaacgctcaacgttggtacgttgcaaatgaattgaaaggaacacctgaggcaaatttaccacttctatctgctgcagcaccatttaaagctggaacacgcggcgatgctaccgcatatactgatattccagctggacctgttgcaattaaaaacgtagctgatctttacctttatgataatgttactgcacttttaaaagtgaccggagcagacttacgtgaatggttagaaatgtccgctggtcaatttaaccaaattgaccctaacaataaagcaccacaaaatattatcaataccgaatatcgtacctataattttgacgttattgacggcttgacttataaatttgatattacacaacctaataaatacaataaagatggaaaagttgttaatagtcaagctagtcgagtacgcgatttaatgtacaatggtaagcctgttgcagacaaacaagagtttatgattgtgaccaataactaccgtgctagtggtaccttccctggggctaaaaatgccacaatgaaccgtttgctgaacttagaaaatcgccaaactattatcaactatattatttcagagaaaaccatcaatcctacagctgataataactggggcttcacagagtctattaaagaccttgatttacgattccaaacagccgataaagctaaaaatcttgttactaatagcaaggatattcagtatatcgctagttctaccaaagatgaaggatttggtgattatcgatttgtctatactgaacaagaaaaagtagaccttactgagccatcacatcaagaaaagttaagccaaatagaaaaacaaaaaattcaccacatggttgcaactgcttatacaaaagcaaaagcttctccaaatattacaggcactgtctatacacaacagaaagaaaaaacattacctaaaactggacaagaaaaacaatcttatctggctttctttggtgtcgcaatacttggactcgtgggaagtttacttaaaaagaaacaaatatagtcatcactaaaaactgaggccaatcaacctcagtttttagtctcaacaatagattttctctctaaatagtcagatattgagataccactctagcttgtttatctgacatgattttgctaaactgataacaagaaatttagatttaaggagtactaaatgcctaaattaaccctagtctatatcagtcttagcggcaatactcaaagctttgtcaaacgtcttagtgaacaactgtcaacttggcataactgtcaggtttcgactattaatatcaaggaacaaaatcatcaaacctttcctgttgaccaacctttcgtagcactattacccacttaccttgagggaggaaatggcattgacaatggcgatcaagaaattcttaccattccacttggtgattttatagctgcacacaataatgtcaaaaattgtatcggaattgttggctctggaaatagaaattttaacaatcagtactgtttaactgcaaaacaatactctgaacggtttggatttcctatgttaggagactttgaattgcgaggaacttctagcgacgttgaacgtatcgcaaatattatcgttgaaacattatcgaactttaaagcctaaaggaaatagtatggaaacaacattaaactacattaaaaccctgacatcaatcccttcaccaacagggtttacccaaacaatcatgacctatatcatcaaagaattggaagcgtttggctactcaccaattcgcacaaacaagggaggcgtcatggtttctctaaaaggaaaaaatgatactaaacatcgcatgataactgctcaccttgatacacttggtgctatggttagggccatcaaaccagatggtcggttaaaaattgaccttattggtggatatacatacaatgccattgaaggagaaaactgtactatacacctctcaaaaaatggtaaagaaatttctggaactgctcttattcatcaaactagtgtccatgtttacaaagacgctggaactgctgaacgtaatcaaacaaatatggaaattcgtttagatgagaaagtaacaactgctgacgaaacacgtgctttaggcatccaggtcggtgatttcatttcatttgatccgcgtacaatcataacagacagcggctttattaaatcacgttacctagatgacaaggtatccgctggtatcctaatggaacttctttctgtttacaagaaagaagacattcaacttccttatactactcatttctactttagtgcctttgaagagctaggacatggagcaaattcaagcatcccaaatgaaactgtagaatatctagcagttgatatgggagctatgggagacgatcaagaaactgacgaatatactgtctctatctgtgttaaagatgcttctggtccttatcattatgaattacgtcaacatcttgtttctctagctgaaaacaataatattccttataaacttgatatttatccttattatggtagtgacgcctccgctgccatgcgtgctggtgcggaagttaaacacgcgctacttggtgcaggtattgaatctagtcattcttatgaacgtacccatatcgattctattcaagcaactgaactcttagtggatgcctatctcaaaagcaatatggtggactaatggtagccacgctcattattatcaggggaaattcagctagcggaaagtctacaatagctaagcaacttcaagccgaattaggggaaaatacccttctcttatctcaggattaccttcgtagagagatgttaggaactaaggatggtgaaaatactactaccattccccttttgatcaatttactaaattatggttaccataactgttcctacatcatccttgaaggcatacttcgttctgattggtatacgcctgtttggaaacatattttaaaacataaccccaacaatacttatgcttattactatgatttaagctttcaagaaactgttaaaagacattcaactcgacttaaatctttagaatttggagaagattctcttgcaagatggtggcttgagaaagatttcttaaaagagatacctgaaaaaatattaacaaaagctatgagtttagaggatgtcaaaaaacttataatgaccgacgttttaccttaacattattgtacgcactataaacaataatgacttcttatcattggagtatattgcccatggatacagtgattgacctcttatttattatcgttcccattatagccggatttctggcatgtattagtctttatcgttattggaaaaaagatttcgaaagcgacgaagacgacgattaaactcctcggaatcaatgattccaaggagtttttctatattctcatttaatcagcatttctacgaatacgattataggttttaaggatttggcccttatgcttagtgacatagcgataatcttctttaagagtagcaatatcctttaaagctttcatgccattactcgtttgggcatctttacgaataggtcggttactcgttgactgcccaaaggcattttgaacatctaaagaaagcataaaattaataaataactttgcttctttcatagaaggagcattctttataattgcaaccgaagatgggacaaaaactgtcccttctgtcggatatacaatagaaacattggcaccacttttttgcaaattgacactagggtcttcgtaagtcagccccacaatcatttttccttctgcaactgattgataaacttctgaagagctagaagatttgatagcattaatattatgttgtagctttttaacatagttccacgcttttggattggtgtaaccacccttggccaagagtatattagtgagttgtgagaaagcactagaggaagtattcggatctgcaaaggcaattttaccttttaaggaaggctgtaataaatcttcataactcttgatggtaagtcccttagctaattcgttatttacaatcaagacactcccatttatagtataaggtgtcgccgtatcacttggatggatatagtctggaataacagtatgaacattctttgatacgtaagactcaaacaatgccttatgactttcaaattgcgtataatttcctccaaagaaaatatccgccttcaactgcttaccctccttacttaatctatctattagttgccctgtcccaccttgaataagcttaacttttataccgtatttttcctcaaaagctggaatcgttcctgttaaaatggcttgactatttggacttagaataactaattcttttggtggaagtagtttagaaggctggctaatactgtatgtaaaaacacttataaaaataatggaaacaaccagtagtatataaataagccttttcgactgtttttctttcatctttcacctacctaatccatttgtttaaaaatatgttcttccttaaacgcttttactgtctgacccaagtactttttaaaaaccctatcaaaataacgataatcataaataccaacagcttctgcaatttggtaaaccattaggtctggttctctaaacatcaactgaatggcttgattaatacgatattgatttatataatcactcaaagttatatgaaggtgctttttagtgactgtgtaaagataactttcactgtaacctaaatcgtgagctaactggctaatcacaattttcccatgaaaatggctatgaatccatgctagcatatctttaataacttcaggaacttggtcattagcttgtggtagaggtaaatacaattctgtatgctcttgtaggtgcttctccttatgttcctcaattctagccataattgtttttaaacaatcaatcaaagcttgcttttctagtggttttgttaaaaattcaagaacgccatagtgaatagctgattgcgcatttggaaaatcagcatagccagataaaataattttggcataagattgtcctttggttgcctcaaacatatcgaatgctgtcataattggcatattaatatcacttaaaacaatgtctggctgctcttcctgaattaattgagctccttctttaccatcttttgcttcaccaaccactaaaatattcaatgattgataatcaatagcatagcgtaaccacttacgaataaggtgctcatcctcaacgataagtaatctatacataactcactcctttactatatagctaactcgaaaagcatcatctgtcttcgtaaactctaacaatactgttgaaaattgatattgtaatcgtctataagaattaataagcccatgatgcgagtgagttgatcttaacattgtacgtatggcttgttgcctagccaaactaatacctgatccattatttgaaacagtaaaccaaattccatcactatcttgccaaatatctatgtttattgctacatcatgacgttcttttaagccatatttaatagcattctcaattagcggtaacaagaaaagttttggtacacgcatgtgttcaagttcaggagatactgaaatagtgtaagttaattcttcaaatctcacttgattaatcaaaaggtaggattcaatgattgctaaatcatccttaagcacagctgcttctgtgctaccactaaggctatagcgcaataattttgttagttgtataacgattctttctgttaattgtgaatcatagtgactggttattaaaattgtctcaagggtattataaaggaagtgaggattaaactgagcttctaacatcctcttttcaaacaacaacttttgtgtttccaaatcaagagttttctcatgtaaatcttttaaccgtgaaaccatctgattgatttgcacagatagatattgaaattcatcttgactatcaagctcaatactagatttttcttggcgggaaatggcatccatatctagcaccatttgatttatggcgctagaattttttactgcgatgcgatcggctagaactctagatttttgtcgtaaaatcacaaaaataataactgatgatactagagaaaaaaggacgaccagagttactggtatcaggggacgatacatgtaaagtaggatattgtcttgcagagctactttcctaacaacaaaagctcgatgatcgtgaaaactaaaatatctagttaagaattgactatctaccttatctaaactagaggagataaaatcacgattagtaaaagtaaagctattatttagctgatcggcaataatcaagtctgagttaatagccttcgttggaagtaaaaagtctttcccattcatcaataaaaaggcataacctgaaacttttttattaactataattggcttaatgagtgcaaggtaatgccctccctcactatccacaataatttttagtagcctttgatttattttagccttatctaaaacttcactaatgtaaatagacttactaaaaaaattacctaaatgtgaattactagcaaacaaaagttcttgattaggtgagaatactaaaagttctgtttgactttgtaaatgattccttaaatgataatattgcttactcaaatcagcacttcctaagtgtcctgagacaaatggtttcaaactatttttacctaagtcatctaataaggtatcatgtttttgaatcaattgcttataactataggaaactgaattaacatctttataaagacctatctgttgaggcgctaaagaaaaaaggacgaaaagtgcaatcaataacaaggataaaattaaagactggcgggaaaaatgtttagagatatcatcttgtagtcgtttcttaaagcgttcttccattctatatcctctcatttccatctccttttattatagcaaatagctatccaataaagatagtcaactcctttcatacaataactttcaaaagaaaaaaagataagctaaacaagtatcgtcttgttccacttacctttaatgctaggagattattagcaaatacctaagagaccaagtacaatacctaacaccataataccaaacatgatccagttgatattgacttttttacgtagaagccagaaggctaatatcgttaccaacagtggcactacgccaacaaataattggtcaaggtaactttgtatggaagctgcttccttagctcctttagctgctaccgttaagattgtcttgaatttaacatttgaagcagtcattgagcctaccatcattaaaccaagcatacttgaagtcttagtaacaattttaataccacctgattcatacaattttttgataaaccctgcacctacagagtaacctccatagagactataataatgaatcagaaaagctggaatgttatacaagagtagaaagacaacagctcccatggctgagcctgtacttgctaaggagataccgatacctgccgcaataacccttagaattccccaaaagaatgaatcaccaacaccagatataggtcccatcaaagaagccttaactgcggtgatagcactagcgtcaaaatcaggatcttcactgtttttcttttccatagatgcaacaagacccataataaaattattaatgtgcatggtggcattaaaccatgttgtatgacggaccagtgcctctgctttatccttatcagtcttataaaaacgattgatgactggtagtaaagtataaataactcctactgcgtggtattgtgttgccccagtacgactggcattcatcgtccatgagcgccagaagactgagcgaagcattttacggtcttctttagtcaaattatcctgtgatttcatgcgaagaagtcctcctcttctgattctttagagtcaaaggttgtctgtttactgatcgcacctctagtaattgcgtctaattctatatcacgttgtgaactaatgacgcaaataactgctcctagggcagcaactgcaaccgctggtaattttaaataagctgttaaaacaaaaccaagcaagtaaaaaacagctaatttatttgtccataataatttcatcagcatggcaaaaccaacagctggaaggaggcctcccgccgcactcaaaccattcatcaggttttgaggaatatgatggacaaaactattaacaggcccactacctactaaaataccaatgaaagaaatagaagcgataatgagatagtaaataatccatgtaccatagtgaagcatcacaagtttaccttgatggtttgcggctgcagctttatccaccatcggtgcaaagatattcatgaagacgtttttcaaaaacataacaacaaatgctgccaacattccaatcggaacagctagagtcattgctgctttttgatcaatgtttgaaataatggtaaaagttgttgccatcgctgttgctgttactggctctgcggcaataacacccccaatattaacgtttcccaaaaatagcgcttctagggaggctcccattaggataccaaccttaatatcacctagtagcattcctgttacaagaccaactacaagtggtctctccatcatactttgacctgttaagtaatttcccccaaaacaaatcaatacagctaaagctgccatcgtcgctggcattatcatatgtcatacctcactttatttgactaactgactcaagttaaccttagtatttgaaggcaatacttggttaaagacgtctaaatctggtaagctggctaattcttttgcggcttccaactcttctgtatttaataagagacttgatgttagtttgacttttgtagctggatcagacttatcaaagcgtcctacattagcgacgtttactgcttctaaatcggttatatttttagcaattgtacaggcatctttaacagaattgacaatcacaaaaatgcgcttgtcagttgcacgtggatctttaaatagagctattgattcttcaactgaacggattaataatttcatgccattaggcacagccattttaagagtcatctgtgtgatttcattttttgcagcttcatcattagccaccactaaaagtggtgcatttaattctttagtccatacaactgccacttgcccgtgaatcaaacggtcgtcaacacgaatttgagtaatcatttttttcctcctaattattaatcgaaaaagtcatcttctgaacccgctttaaagctaagatctaccagctgcacttgagattcattgataacggttacaatttcttctttagttaattcctcttcaggtttcaaaaatagtaatgacaacaaggtcgctaaattgctgttcgttattaaaaaaatattatttttcccactattcattacagcagtcgccattttctgattaacgctgccacctaacaaatctgtaaaaataagcccctgttcatctggtgcaatctcatcaataaattctacaatagacttagtatagtcactatcatcaatgtaagcatctattgtctgaatctcttgtcccttgcctgtcagaatatcaatagaactctgcaacccactcgcaagttttccgtgactgccgattaggaatttccgcttcatctttctcctcctatttattacattaccctaaattagttctgaaagttttatcaatactttgaataagataacctttactatcattctaacaaatgaaagcggtttaaaaatggactattctactctatatgtggactattctacataattaatatttaaaaacagaacaataaaaaggtcatgtatcctaatagtttacacaacctttacatcactataactttaaactttctcttatatgcatcactatttcgaaagagataatggaataattttttgatagggtatcttattaacaacctttattatgagtagagcacaagcatgtgttaatgccaaggtcaccacaaaaatcacttttccttgatggtgtgcaactaaggaagttgattttaaacagtaagacactatgccaataaaaagagggggaaggaagaaataatagacactcaactgttttaaaggacttaaacgatattccttaaacagtgatgtacgtatactccagttaaataagaatactgcacataaaggagctaataagaagaaatttttatccaacccttgattaaaataaataagaacattctctaaagctagaagtaaaaggaagagaatatacttaagaccacgcgatttggtaaataggtcagtattaaaataatcatagagtaaatatcctgctagaagataaactggagtgtaaaataatccgtttcgtgttgtctgaaaaattgacatataagtggacatcaggggataaaattttgttgactgtataaagacagaataggtctctactgctccaatacaatagagtacaacaactgtgataaatgtccccctagttcctacatacttcaataatccttgaataatgacccaacctagaataacagcagggatgtaccaaagggtatgtgacatacctaaatacaaaaatgccacaataaaccccggcaacaaatagatcttcgctatatttagagattcaaaaaagaaataaccataaggcaaataaatgatagtccacatgctatactttttaatcagtttacgaaagtaggagtgattacacaaaccttgctgtatacgacctctcaaaaagaaagcagtacaaatcaaaaaataaggaacagccatccgacctaggaaacttttaaaggtaaaatgaatgacatcctgactaaataacctcccactatgaactaaaatgaccagtatggaaaaaaggtattgtagcaaactaatcattgatgtattatgctgcttattatccacgcactgacttctcttcatccttaacattactttctataagttatcattactatgataccaatctcttcagaagaatatctcaattatcccaaaaagtcattgaaacgccttaaatggtatctgataattattgttaataccttatcaaccatattaggaaataaaaaagctgatttcgcaaaagaaaatcagcttagaataatttcttgttcagataaccagtgggaactataaacttcttcgtcgcattaaacgataggtataggctatcaataacactgcaattaacatacgtagactaatcagacagatttcattagcagaaaaactatcaaagaaaaagccatgactaccattacgtgataattttaaaagtaaagctgaagtgtctgtcgttgatactgagaaaatagttaataacttgtttatcacacctttattaaacatagccattaaaaagctaggagcaaaaaaggcaagcgttgaaacagcaaaagatgttaatggcgaatttgtgatacttgatataaagaaattaagactggctataaaaaggagtccaacaaattgtaagacaataatatgaacaaaagcagttgatattgtcataggtacaggaaatcccataatattagccaaaggtgatgtccagtataaattcagttgaacgcttgtctcccaaccactaaaaccaaaataatctgcaaataccgtcagaatgagggcatatgctaggataaatgtggaaataccgatggtcattgtactagctaacttagcccaggtcaactgaccacgtccataccgagtcgtcagtagtataggattaatcttcttagccctatctcctgaaaaaagaggagctgataagaatagagtaaataagacaattaaaatataagtactattacttacttcgaaaagttgattccaaggagcaaagttacctagctttagttgttttagtggtagcgcagaacccaactgtttttgatctttaatatttattttattaaaatcaattgttttatcatctttcaattggttatagtaaattaaaaaatcacgatcaaaagtgtctgccacataataactaaaaacatcaaatataggggggcgtcctgctggcggattaacatagtttttaataatatttgttactcgttcttcagataaatcccctgaatatttttcagctattctacgattaatggcaaccgcttctcgaccatgtattttatctgcagaatagccactaatttgcccaacaaaaaaatgctggtaaaatagaccaaaaatagcaagaaggaagataataaaagccccaaatgctgccttacgttgtagaagtttttttaattcaaaaggaaaaattgatatcatcttacttactcccctctaaaatgatagatgtagaaatcttctagagtcggaacaaccaactgtgccgaatcactcggacaaatatcactcactacacgaaatacccgactatctgaaaagactttttcattaacaatagcaatattgggtatctgagataaacctggttcagtcgttatttcccacacttttccctcaatagttttcaacagctgtgcggtgttgccatgttcgataaatttaccattttttaatactataatttctttggcaacagcttccacatccgacacaatatgcgttgataaaatgataattttattggtggataactgactcaaaatatggcgaaatttaacccgttccttgggatcaagtccaacagttggttcatccagaatgagtatttcaggatcattgataagtgcttgagcaatgcctaaacgttgcttcataccaccggagtatgatgaaatcttctttttacctacatcgcctaaaccaacaagctctagtaatctaggaatttcttgtttagctttctttttatcaacaccttttaaggtagcgatataatttaagaaagcaatgccagtaaattgatcataatagcgaaaatgttgcggtaaaaaaccaatgtgacgataaaattcttccgactgctcctgtccattccaataaatattcccactatctgctaatgtaaagtggctcatcaaatttaataaggttgttttgccagtaccatttgctcctaagagtccatacaaaccaggagtaaactggtaggaaatctggttaagtactatttttttcccgtagcttttagtgatattatctagctgtaataacatagtattgtctcctttcaataattaagacagttgaaaaatcaattactaaaatatagcgactgagctaaaggttaaaaatgagctttctcacttactctctaaatgattgtaaagtaatatagctaaaagattatttctaagccctgacggaaagtatgttgttcactatttgtactaatagatgcattgggataacggtcaataactttcatgacattataaaggcctaaccctctatcttctcccttgctacttgctccataaccaaacaaacgtgaagcatctattctttcctcgactatcgaattttctatgataaaaatttgcttatggtttaatgtaaaataagacatggctatcttaggttcatctgtctctaaagaaacttcaatatggtggctataatctatcatattagccaattagagttttctttgaacaaccaacctctcctgtaaagaagttttgaagtaacggtctaaaatagaactcatctttttctatccttttgatatttatccactatagatactatatctctcactttattgcgtgaaaccagacaagtcgttccattttggaagtaaactaatctatctatcctatccactttaaaaatatttaagggatttactaaaaaagagcgatgacattgaaagagcctaggttcttgttttaaaatatcccccaaagtggctgtgaattccattctatctttttcagtataaaggacaactctatgtgatcttgaggatgtttctatataaagaagatcgttaaaaggtaattgtacctggctgtaacgcgacttaaagtagaatgaattttccactaagggcttattgcaaatgccatctacgtacaacaatacttcctcaatcctttggctaaactcttcctgtgaaagtcctttatcgatatagtctaaagctgatacctgataacgaaaggttaaaggcattaattctgaatgagttgtaacaaaaacaatctgagcatatggatcaacttgtctaatttgttttgctacctctaagcccatctgctcatcattttttatttcaatatctaagaaaaataaattatgtaaacctatttcataaattgattccaataattgaactggtttagcaaacgtttctactgttttgaaatgcagattgtactgtactctaatctctttaatgattttttcaaaatgggcttgttgaacaaaatcatcctcaagtataaaaatattcaccttatatcctctatcttattacttgaatattaatagtcacaatagagccactacgatattcttctcataggtatcgtttatgagttatcccgtcttaatatgtgacgtccatgaggctaattttaaaagcataataaatatatgctaattttaacatatatataactatttgaacacctaattaagtagttaagtattaaaaataaattatttctattaaaatacccttagatacagactttatctgaacctaagggtatcttttattataagatattagaaatccatggtaatttccaagccgtaatgatcactaacgacaggtgcttcaccaccttcaaaaactacttgacttgaactgattgaaaggtcttcgctagtaaaaatatggtcaactttaagagcctttttattcccttcccaaccatcaatatcagccataatagtatggtccccaaatacatgattggctatttggtggctatcctttaatgctaatggactattaagaacaagttcataaccctgatttccagtaggattattaaagtcacccatgagtaaaagtggagtttctacctcaagtagggtagtttctagtcgtttccactcctccgcaaatcctttctcaaaccatgagaaatggaggctaactactgtaacgactttgtcattcagagtggtctcagctaccagagcacgacgagtatgataatcagtctcatcgtctacagctgaaactaaaatatcctctggctttaatggtttcagagaaagtatcgctaccccttcatggtacttactataaccaatatgattataagcccatgtccaatgatagtgtagaccttgaagatttaggtaatgcactaattgcaaggcaaagttatcttgatgaagagctggtgtaccttcaatcggatgataatttggactactcttagcaagaggggaagatatgctctggttcacctcttgtaggcagatgatatcatatttttcacggaagatatgctctgctaaatcaaataatttctttagagcatttacttccatccatgaatgagtatttaacgttaagcattttgccatagagtatcctttcatcagaaagaagctgagacttgcccatctcctatcgtttgttacagttcgacttttgccacaactgttttagctatttgtggacctgatttttcaagtttaacagtttttatatctgaaacatttgtaaagacgataatcacacttgtctctttaccagctgctttgatagcttccaaatctgctactacagcaagatcgcctgctaccactttttgaccactagaaattttaacctcaaatggttgaccatcaagagctactgtatctagaccgatatgtactaaaacttctaggccactttctgttaataaaccaaaagcatgttttgttggaaagacactagtaactgtacctgaaactggaacataaatattgccatcagttggttccacagcaaagccatcacccatcattttttgagaaaagacagggtctttaacaacatccaatgcttctacttgaccattagccaccgaaacaatttcttctgttattcctttataagttgtaactggggctgctgctacaggttgacctgtttctaaatcaactattggaataactgtacctgaatctagcaaatcttgaatgtctgatttaaggacatctgctttaggtccgtaaatagcttgaacgccattaccttttaacaccaatcccattgcaccagcttttttccaagctgcttcagaacccacgctatttccatctttaactgtgacacgaagacgagtcatacatgcatctacatcttcaatgttatcacgaccaccaagtaaattaataacttgtacaacttgagaatttgcatcagcagaaccagaagctgttgaaggagcattatcaacctcttcgttatcataattaccattacgtcctgctgttgctaaattgaattttttaatcataaagtttgcaataaagtacatcaatactgcaaaaagaagtgtcacccaaacaaagttgaaaatatcaccaccaaggcccgcttttatgcccataggaacacgtgttaaaaattctatattaccaaatgaatgaacgcggaggttaacaatatctgccatagcaaacgcacatccttgaacgacagcatatacaaggtagagtggcattgctgcaaacatgaacatgtactcaattggctcagtaacacctgtcaagaaagtagccgctgctgctgaaataaacattgacttgtatttcaattttttatctttatcaacgttacgatacatagcataagataatcccatcaaaatacctgaagcaccaatcatttgccccactttaaaacgtgctggagtgacacttgtcaataagtgatggtattgacttgaatttgagccttttaagttaattaaatcaccaacccatgctaaccacagtggatcttgtcccaacacctgtgctcctttagttgcacctgtaaggacagtgtatgtgccacctagttgcgtgtagttcattggaatagttaacatatggtgtaaaccaaatgggagcaataaacgctctaacgtaccgtagacaaatggtgctaatattggagcactgtcttgtgaacttgcaatccatttaccaaagccattgatacctgattgaacaaccggccaaaatactgataaaattaatgcaacaatgactgaacgataaataacaacaaatggaacaaaacgttttccattgaaaaaagttaaagcatctggtaatttacgatagttataatatttattaaaggcagttgcaccaacgaaacctgaaataataccgacaaatacacccatattaagagcaggttgcccaagaacgttaacaaagtaatctgaaactctgatggttgcaccaaataccgtttgaacagttgctttactgtctgctaacatatctgttttaacaccaaaaaagttccctgtaataaggttaataagaataaaggataagccagccgcaaaagcaccaccggcacgttctttagcccagctaccaccaatagccaatgcaaataagatgtgtaagttaccaataactccccaaccaatttgagcaataacattagctatgcgccctaataaaacatttgatggatccaatagactaatggagttaccaatactaaccatcaatcctgctgctggcataacagcaataacaaccatcaaagccttcccaaacttctgccaaaattcaaaactaaagagctgtttgacattatttttcatcttcaatctccttttatgcacttaatagtgcaagcgtttgcgttattatggttttattatagcacttatttgttttttgtaaacccttacttatatattttttctgaattactaaaaaagtctagataatatcatctagacttttatttgtgagtttttattgtttgtgaagtaaaacggtcattgttgttccctgccccaaatggctgtccacttttatactaccattgtgaaaatctaaagcactctttacaatagacaaacctaaaccagtccccccaactatttttgagcgacttttatcgacgcgatagaaacgttcgaaaatacgttttttgtccttctctgcaatgcctagtcccgtatcactaacttctaaggtaattgtatcaggtgaatttttcaaagtcacatttacttgacctttctcatggttataggtgatagcattgtcacacaagttgtacaccaaggaattcaataaaactggattccctcgcaaaatagcttcttctccattaaaattgatttgtatgtgcttcttatctgctttagcttgtaaaccttctaaaactttttgtgttaagtcatacagatttactgtctcttgcggtaatttttcttgttcatcaaggtgagaaaggttgataatatcctcaaccaatttaactaatcgttcagattctttatgaattttagctgcaaattgtgggacttcttcgtttggaaccatttgattagctaacagttctgagtaaccagaaataacatgaagcggggttttcaattcatgagagacattggcagtaaattcacgttgaagttgttccatttggagttgatcagtcacatcaaacagtagaacaaccaatcctgttactcggttgttatctgtagttggtcttaccaagacgcggtaatgattattttcaatgccaatattagcctctttctttttcccttttagtccttgatcgattaagtctttgagagttaaatctcggctaacttccatcataaagcgcccatgccaatcatcattaatttggaataactttaaagcttctgcgttgatactaacgattcttgcttgatcatctaaaagaatcattccttccttaattttagaaataatggtatcaaattctttttgacgcttttgtaataacagtttttgatgttgaatcttagcctgatggctatcaagacgccttaataatggtgttatctcctcgtaactatcatttgataaaggatgatctaagtcaatattgtttaaaggctctgatactttttttgctatatatcgtgcaattaatacagataaaataatagcaagtaagatgataattgctaagggacttatcataccaaggagaagataaaaaatagtttgttgcgcaactgataaacgaactatcgttccattatttaaacgttgcgcagcatagatagacttctcagtaagtgtcgctgaccacctcgtgctctcaccataaccactcttgatagcttctttaatttcttgacgattggcgtgatttttcatatgttttgcatctgattgggtatcataaagcacttgtcccttattatctacccaagtaatacgcacatttgaagttttaagattttcaaaataatctttaccttcaaaggaaattccttgtgacgccagtgccgtttgtgttctcaactgttctcgctgaatgtgattgaagtaattatagagaaatcccataatcatcaaaattgtaactaaaacaattcccaaactagcagataaagttgtacggaaaatttttttagtcatgtctttcctccaaacggtatccaactccccttactgtagcaatcaaatagccatcctcaccaagttttgttcgcagtgtcccaatgtgaacatccacagttctagtttctcctaaaaattgttctccccaaaccttatccagaagttcttgccttgtaaagactctattgggattacggaagaataatactaataactcaaattcctttagggttaagtggattttttccgttccccttttgacccaataattagtcggatcaatctctaaatttccaatgataatatgagcttttgaatctacttggcggctacgtctcaagactgcttttattcgtgaaatcatttccatcatcccaaaaggtttgacgagataatcatctgctccaagatctaaccctttaactttatcatactcactacctttagcagttgtcatgattactggtatcatttccgtttgatgttttctccttaaacgctctaaaatagtcaaaccatcatctcccggcaacataatatcaagcaaaatcaagtctggaactttctcctgaatagcttcccaaaaaagctctgaactcgaaaatccttgagctttaaaacctgccatttgcaaagtatagagcatcatttcgcgaatatcagcatcatcttcaacacaatatatcattacgcttctccatctaggttacctgttattgagaaaagcacccacttagcaatatttactgtatgatcaccaatacgctctaggtacttggcgatcattaaaacatctatgggatattcaccatcaacatcctgtaccgaaaaatataacactaactgtttctttattgtatcaaattcctggttaactgtcctatcttgttcaattacttgatgcgcttgttcttcattgtcataaataaaagcatctatactcttagtcagcatactaatgacattattagacatgctgttaagttgatccctttcagaacctgaaccttggataatatgacctaaactaacaatttccgcaatttcataagcttgagcaccaatacgtttcatatcataaaccatttttaatgcagaagaaatacggcgtaaatccttggcaactggttgctgacggagtaaaagttttaaacatctctcctcaatatcccgttccatttgttcaatcttgtgataagtttcagaaatatcgtcaaggtaaacgtcattactatttgttagagcacctaaggacttcccaatgatgtcctcacacaatgcccccataaaaataatttctttattaaggtcattaagttgacttgcaaatcgtgaacgaatcatccgaatctccctgtaatgtagttttctgtacgctcatcttgtggcaatgaaaagagttggctcgttttgttatattcaaccacttctcccatcagaaagaatgctgttttatcagaaatacgaacagcttgttgcatattatgtgtcactataacaatagtgtagttcttcttcagttggataaccaattcttcaatttttgctgttgaaataggatccaaggcacttgtgggttcatccataagtaaaacatcaggctcaatagcaagagcacgcgcaatacacaaacgttgctgctgtccgccagacatacccagagcagatttgtgaagacgatctttaacctcatcccatagagccgcctgtttaagggaacgttcaacgatatcatctaactctgctttggaatgaataccgtgcgttcttggaccaaaagcaacattatcataaatgctcattggaaacggattaggtttttgaaacaccattccaacctttttacgcaattggttaatatccaattgtctatagacatcctcgccttctaaagtaatatcccctgtgattttgcaatttttgaccaaatcattcatacggttaatacttttcaagagagtagactttccgcacccagaaggtccaataaaggctgtgatttctttttcttcaatgtctaaattaacatccttcagagcgtgaaattctccataatacaaatctaaattattaattactaatttactcactgttcgactcacttcctaatcgtttggctactagtccagatacaaaattgacaataataactaaaagcaataagatgaccgcagtcgcataagtttggtcaacatataagccctcacccgaaatagcatacatatgtactgctaaagtacgagatgaactaaataccgaatgtgctacttttgcaactgttccagctgtgaaaataagtgctgctgactcaccaatgatacgtcctaccgctaaaataataccagcaaaaataccagacatagcactaggtaatacgattttaaatatggttctcaatttaccagcaccaagcgcaaaggctccttctcgataagaatccggaacagatagtaaagcttcttcagttgtcctcataatcaaaggtaaaatcatgatgctcaaagtcagagaacccgatatcaaagataagcctaagtgtgtgtattttacaaaaaataatgcaccaaacaaaccataaataattgaaggtatccctgccaatgtctcggttgcaacacggataattttgagataaggattatcacgtctagcatattccgttagataaattgatccaccaataccaagtggaactgcaaataataaagttaaggcgatgataaagatagtgttaatgaaagctggtaatagtgaaacgttctgagtattataagtccatgcaaacaagccagtattcacatgaggaagccccttaactaaaatataaataacaacaaatgcaattgtagcaaaacttagaattgctcccaaatagacaatagcaaaaagaaagaaggaaaggggatctttttttaaagatgctaaatattgttttgacgttctttggttaatattttccatcttattcctctttctgtaatgctgaaaaactgatattaatcattaatataaagataaagagtaccacagctgtaccaattaaggcttgacgatgcaaaccagaagaatagcccatttccataacaatgttagtggttagagttctaacgcctgatgtcagcgattgaggcaagacagcttgattacccgctaccatgatgacagccattgtttcaccaatagcacgtccaattcccaaaacaaccgatgctaaaatgccacgtttagcagctggtaaaacagcaaagaagacacttcgttcatgagaggcaccaagggcaataccgccttcataatagctctctggaacagctcttaaagaagattctgaaatgctaacaattgttggtaaaatcataattcctagcaaaattgaagctgctaagactcccataccaaagccaccaatatattgccttatcatagggacaataacaacgagtccaaagaaaccataaacaactgaagggattcccgccattaaattgatagctgactttaaaggcttataaatattttctgggcagaaataagccataaaaacagcagtaaggatacctatcggtcctcctaaaagtaaagctcccgctgtaacatataaggaacctacaatcattggaaagatgccaaaaatattattactaggatgccagactttaccaaatataaaatttccccagccgattttcgtaatagctggaagaccactagagaagagaaagaggcaaattaaaatagctgatataacactgacgcaagccgtgatgaaaaacacagcttgcataagaccttcttttgtttgtttcattgtttactcttaccttactttgataagtcagaccaagacgttgtctttccagtaaaaatgtcttttacttgttttgttgatagatcattaactttatttttcttattaacaactactgcaataccatctgttgcaataacagtagctttgacccctttggatgactctgtcttatccaattcacgtgatgccatacctatatctgctgatccatcaattgcgcttgtaatcccagttgaagaatcactttgttgaatttcaacatctacttttgcatttactttatgataggcttctttaatcttttccataaccggcgttactgaacttgaacctgctataacaactttaccagatgacacttttgcttgatatgctttagcattgtcaagtggaatatagccatttttctcaacgactgcttgcccatctttgcttaagatataatcaataaaatcttttgttgcttctttttccttaccttcttttgttacaatattgaaaggacgagaaatcttatagcttcctgatttaatatcttttacagtcgcatttttgccatcaattttaagcactttaacgctactatttaatgaacctagtgaagaataaccaatagctgacgggtctttagagacagtggttagcataactgaagttgaattggtaacagttgctgcatcagaagtatggtctactttttcgccctttttattttttgactcgatcccaaataactctatgaaagctccacgagttccagacccttcctctctagaaacaatgttaattgtccctttagatgaagatgatgaatcatttgagcatcctgctaggatgccaattcccataagaccagataccgccaaaagagatagcattttgtgttttttcatgatgaactcctaaatattttttgatttgattttattatagttaagaaatatcaaatctctttgaggatttttgtaaaatcaatgtaaaattaaaaagagttggaaaattatccaaactccttttttctattatggtaattcagccagtaagtcggattgaaacagttgttacatcacataattggagtataactatcccattatagagttaacttacgaatgatgtcaatgattttttcagccacttcctcagcatttaaatgatttgtattaatatgaataacattggaaaatgtgtctaaataatgttttttagcaggcagcaggtgatgagtataccatttgaaaaaatgacgctgtctattaaaatcatttttttgacgttggtataggaccgtctcatctgcatctagaaaaataatataatcagcaaaacattcctttagcctatttacctctagtaacaaattagaaggtaaagtccaactataacccgccacctttggaaagtattgtgtataaaaagcaatttcctcagctccataatccattaacactatttcattatctctaacaagttcgtatctatctcgctcatgctgaataaatagttgttgaatttcacaataatcgtctaatttattgttatcaagctgatgtttattaatcttatcaactactggagaaatatcctcaaaactaatagcgattttggggtaaacattctcaatgattttcaaagctgtggttttccctacagccataccaccttgaatagcaataatcataataactccgctgagtaactaataacacttagagcatagagcggcgctgtttctgtgcgcatgatgcgtggccccaagcccaccttgatagctccaacctcttcaaaagctgcgatttcttttggagaaatgcccccttctggtccaaagatgaagaggagcttgtcacctgcttttacagtctgcaagttctgggctagcgctgacaattcaccctccttggcagactcttcataggcgataaaaatcttatcaaagcctgcaagctccgcttgaaaatcagccttcttctcaaataaacgaacctgaggaagacgattacgcttgctctgctccgctgcgcccagagcaatttttgccagcttatcttcttttttagctagtttcttgccgtcccacttgacgactgaccagtcagctgggaatccccagatagccgcagcacccaattctgttgccttttgcgtcacaaaatccaacttgtctcccttgggaaaacctgaggcaatggtcacttgaactggcatttcaacattgttgtctagctcttctagaatttggaagcgatgagcagagctgtccaccacctttgccagacgcttgatggcatcatcaaaaaccaagaccacttggtcatcttctgtcaatcgcatgacattgaacatgtgcttgatggtatccttgtcctcgatggtcacataggcacctgcttcgccatttacaaaatactgttgcattagccgccaatcactcctgaaatatcatctgtctttttgaaaacgcaggcattccactcaccttgaaccatgtgagtctcaaggaagaaaccagctttttcagcactctcacgcaccatgtcccacttctcagaaatgataccagacatgatgagatagccctcatccttgaccaaacggtaggcgtcgtctgtcagatggatcaaaatatccgccaaaatattggcaacaataacatctacctcttgctggacacctttgagcagatcaccagcagccacatgaatattttcagtgccagggttcatatcgatattttcctgagccacgcgcactgcaacatcatccaaatcataggcatagatgtccttggcacccaagagagagctagcaatagacaaaacgccagaaccagtccccacatcgataaccgtctcaccaccacgaagcacttgctccaaggcaaaaagactcatcttagtcgttgggtgagtcccagtcccaaaagccataccaggatccatcttgataatcttctcaccagccttagcctcgtagtccgtccatgacggcacgatggtcaaatcatgggtaatgcgagctggctcatagtacttcttccagttatcagcccagtcctcttcgaccaattcctgactgtcaaggttgacgctacccgtcgcaagaccaaagccttcaaaattagctaaacgatcagccaaatcagccttaaccgcctcaatatcaagcgtatcaggataataagcagtaatagcaatcatatcagactgctccacctcaggataaagctcaccgaaacgatcctcctgtccaaggtagtcagccgaatcgctaatggcaaccccctgactgccagtttcaatcaataaattcgagacagcttcctctgcctcacgattcacgtgaaccgttagttcattccatgtgttcatgtagtaactccttcattatttctacttaaatcaataaaatagttcaactgccatcgctgtgtcaccaaagctgttctatttaaatcgctacaccaaggagggtaaaatcgcatagccatctttccttgagagttagcagatgaaagaatacccttactcactgcaacctctttgggaatgatgaacaaacctttccacctaccatctttaatgacaataatcaaatcttccacttcatcttgttcataaaaaggaatatttttaccatttccatctttctgccaaaatactgtaaaataccccatcttgctagctgtcttatgagctaaacgacaccttttatagtttccatcgccttcaattcttatgaggataccttcatatttttcattccacttttcttctttaacttcaaaggaagaataccattccctaagtagctcaactatttctataactatccctcctttatcttcaaatcaatatgattaaccatacttttcaaaataatttattttttgcttgaccctgaccttaggttatcctttatactatgtaagtgagaggaggttattaccatgaaaacagttaaagaagtcagtatcttaagcggtgtaagtgtgcgcaccttgcatcactatgataaaatcggtttattcccacctaccgccctatccgaagcaggctatcgactttatgacgatgaagcattgattcgcctgcaagaaattttgctatttcgtgagttggaattccctctcaaagatatcaaatacctgcttgagcaagcaaaagaggaaaggcaagacttattagcccaacaaatcaaattgcttgaatggaaaagatcgcaccttgagcaggttatcacccatgcgaaacgattacaagaaaaaggagatgattatatgaatttcgatgtttataataaaacagaattagaacaattacaagctgaagcaaaagaaaagtggggacaaacagcagcctacaaagaatttgctcaaaaacatgcttcagatgactttgcacaaattagccaagaaatggcaaaaataatggtacaatttgggcaattaaagacacaaaatgtatctgatgaatctgttcaaatgtgtgtgaaacggctacaagactatatctctcagaatttttacacctgtaccaatgaaatccttgctggactaggacaaatgtatcaatcagatgaccggtttagtcaatcaattgacaaagctggtggagcaggaacaagtgaatttgtcagccaagctattgcttactattgccaataaactatcagaaaactagacaatcatctagttttctttttttattctatcttctttgtcatatagaccatatccattccttcttgctcaggttcggtatgggttgaatgataaccacatttttcataaaaactgaccattagtttttcttgcgcaatcgtacataaatcccactttgtaagcttaggataggttttctctaataaagccatcgctgctgagccgtagccctgcccttgatattggggaagaatagccgccgtaccaagccaagcacgcttctcctcgtctttgataaccaatctaagaaaaccaacaattgtctcatcaacaaggacaaaatgatagaaacaatctggtcgctccactagtttccatcgaatctgctcaacttcttccacatagggatcgtattgatcgtggtatttctcatagactgccttaaagctagctctctgaatggcaataatcttctctaaatcactagcttccgccttttgtaaagtaatcatcttccacctccaaataatctctcaacctctcctgcaactgaggaatgacctttttatggcttaaaaattcgtcaatggacatgagtttgtagtcttgtccttcatcgcctagaacaatgctatcgtactctttctgactgatatgtccaaccataaaaactgataatttatcaggcttcaacatacccctataagtcttgacccaatcaatatggtttcgagttaaggtcagacttaattcttcatcaacttcacgaaaaagacattccaaaggtgtttcattgtcctcacgaccaccgcctggtaagtcccaaaagcctgcatagggcaaatctggaaaatcatctcttaggctggtcaaaatctttccctcgcagaaaagagcgatctttgcacctgagaaatcaaataactcatcaaaaatatccatgcaataacctcaattctattcctaaagctccatattttctgatttgttcaggggcataataacgttccatatcctctggtctggctgtttctatatcatccaatgtatatccacattttagcaaatccatcaagtctaatatctcggataagggtaaaactctgtctctttcagttctgctctgccattttcaaaagcatccgtatcccaagaaagaccgaactcttcgatactgtcatcggtgaggaagtccatgaggtcgctcaacccttcagtggcaacctcgttgagagtctccgcaaaataagccagaaactcacgcgacaagcccttcttaggctcataggggatagtcaccagatagtcctcagcatcaaagcgagacttgacagggttgtaaaagagtacatagtcctcaaaaacgatgtcctcgctactcgtctccccctggtcgtccacggtttcaatagcagagctgttttgtgcttctaatataaaagtgacttctacagtatgatttttcttatcccaatccatggcaaagtcatactgtaaatgcttatccaattcttcttctagtaccgataaaaatccaaatttagccatcttatgtccttattttctatttattctttcttattataacatgaaatagaagaaaaacgttacagactcaggttaatcaaaaggtagttcctacttatttttatgttacaatagtctcaaagactagccgtttttgactgacttcatactatgttaaaagcgtcagccaagagaaaaactctatatagaaaatagaaaggatttgaatacgggactaattttctagaagaaaagatgaacttcctaatgtctgacgacacttcgtcgttccctatttctttacgaaaattttcggtaaaccgaaccgtccctttgtatcatcaattatgattatcagacctatgcaggactgcgaccgtgaggcagttctgaccttacaaaatactggctggactgctcttacctctcctgtctatgaccgcaagtggactgagagtgatttggagaagaatctggcaaatggcatgtccttctttgtcgctgaggtcgatgataagatcgctggcgtcttggactttggtccctactatcctttcccagctggcaagcatgttgccactttcggcattctcatcgctgaaccctaccaaggtcagggactgggtaaagctctcttgaaagctctgctaactgaggctaaagctcaaggttacatcaagattgccatgcatgtcatgggcaataacagcagagccatttccctctatcaaaaatacgggtttaccgaagaggctcgaatcactaaagcctttttcattgaaaatcattatgttgatgctttaattttcgcaaaagatttggagaataatcatggctgacaatcttgctctacgtatgcgtcctcgcaatattaatgaagttatcgggcagcaacatctcgttggtaatggcaaaattattgatcgaatggttgcagctaatatgttatcttccatgatcctatatggcccaccaggtattgggaagacttctattgcttctgctattgctggtactactaaatatgcctttcgtacttttaatgccactgttgatagtaaaaaacgtcttcaagaaattgcagaagaagctaaattttctggtggcttagttttattacttgacgagattcatagacttgacaagacaaaacaagattttcttttacctctacttgagaatggcaatattattatgattggagcaacaactgaaaatcctttcttttcagtaactcctgccattagaagtagggtacaaatttttgagttagaacctctttctaacgaggatattaaaaaagccattcagctagcaatttccgataaagaacggggatttccttttttagtgacaattgatgatgaggcgctagattttattgttaccgccacaaatggagacctacgatctgcttataattccttggatctagcagtcatgtctacttctcctaatgaagatggtagccgtcatattagtctagagacaatggaaaatagtctgcagtgtagttatattacaatggataaaaacggagatgggcattatgatatcctatcagccttacaaaaatcaattagaggttctgatgtcaatgccagcctgcactatgccgctcgtttagtagaagccggagatttacctagtttagcaagacgtttgaccattattgcttatgaagatatcggcttagctaaccccgaagcacaaatacatactgtgactgcattggaagctgcccaacgcattggttttccagaagctcgtattcttattgctaacattgttgtggatttagctctatcacctaaatcaaattcagcctatttggctatggatgcagctttagctgatttacgtcgttcaggaaatttacctattccacgtcacctaagagatggacattacagcggtagtaaaaccttgggcaatgcaagggattacaagtaccctcacgcctatcctgaaaaatgggttaaacaacaatacttaccagataaactagtaggacataattactttgaagccaatgaaactggtaaatacgaacgcgcacttggttcaaataaagagcgcattgataagctctcagactgattgctagttttaaaaatcgcaatcgatttcaaaaatcgataattttgcttgaaaattttataaaaagtggtatcataaagacatagaaacattgctgtggcatacgaatccacatctaagtgttgaccgactatttctttgtatttcgggaaacgaagtcatctctagtgcgcaagccgttaacacgcggaagccacttaaagaggtgcgagttacccacctgcttattttgtgcgggatcaatacaaaaagtggatcatcggtgccaatacagcttcctagcctccttagctcagttggtagagcagtagactcttaatctatgggtcacaggttcgagccctgtagggggcattaaactatacataaaaaagcctttgattaaaggcttttttgcttgtctaaagtggatttgtcccatcttttgtccccgaaaaattttttaggatgaaaattattttcttctgtattatttcgttgagacaatatacatataaatatcactttgtactaatttaaacttcacttttctcaaaaatgactttagcagatatcaaactgattaagataataccgatgactaagagagttggttgtaataaatctttgatgtcatattgaccacttaggatttggctttgtttctgaatcaacaacatgggattccattccttggtaactttgaaaaagccagagatgaaaaaggctacaatggtcatcagacaagctattaatacgcctgcagttttacgaaagattacagagtaaaaaagaatgagactcagcaataataatccaaagatccaggatgtaccgtaaacaataagtttatgctgaccatgattattaaaataataaagtgtataagcatactgggtaagtgatcctagtatatagctgatgctccaaataagtgtcatcatgataaattttgctaagataatggcttttttgcttagtcctttggtaataagattaataagtgtacctctggtaaattcttgagtcaaactaccactaaaaagaaaaactaatagaatcaatcctagctgattaatatttttaaaatattgactataagaatcaaggtaggttgggtcaggaatagcttcttgcagtttcttaggcaaaatccctgccatgatttctggcatcagtaatgctgtgagtggtcctaatattccgaaaatgattgaaataaggagaagggcaagagctttatgactacggctattttctagccactcttttttgagcatggggatcaatccggtcatttaatcacctccaaatagaagtcttccaggctatcttccagtaattcaatgaagtatggcgtgatttcttgctcaactaaatacctgtaaaaacttgctaatgcttgttcacgattgtttgcctcactcaattccaaatgtaccttataatattgatctttttgatttaaaggaaatcgcagagctaatttttgtgcttcattgtctgagacttttattaaaaggttcagttgattcacactggctgacgctttgtctcttagatcttctagattatggatacctgattttgttagaattagaacttgatcacagactttttccacatctgataagatgtgtgtcgagaaaatgactgtcttttgaccacgtagttgagaaataatggagaggatttcttgtcgtccttgagggtctaaggctgatgttggttcatcacaaatcagaattttaggattgtgaatcagtgcttgggctagacctaagcgttgtttcatacctcgagaataggtgctaatgcgttgctgattatcggctaagccgacctgttctagcagatcagcaattggtaaactggttttgttttgagctaagccagcgcaaagttgtaagtattcttgtgccgtcatatagtcataaaactccggaacgtcaggcaaataaccaataacttgattactttttgtctgcccaaaagtcactgggtttcccattactgaaatggtaccagagtctactttcaataaacctaaaatcatcttaatggtggtggttttaccggccccgtttggaccaacaaagccataaatcttattttcttctagctctaaggaaacctgatttaaaatgatttgatccccaaaggatttggacagattttgtaaagaaatggctgtcatgcatttttcccttctaagctaagaaaagcaataggtccaaggagattaacaaaaaggataattagaacccaaactggtttagaaaggtagtttgtctttgttatttttcgtaattttaagagtgcaatgatgataaggataacctgtaagaggataagagggataaagaaaggtaaaaattggctagggatgttagtgttcatctgaaatctccttttcgagtttttttaaagcagcaagctgagcttggaaggacttttcttgctgtaagtattgaaactgtggactatgaaacagggcaattaccctttggattaagatttgagaattggttggtggctgaattcctgttggtaactgttggagccaaggatcgatggcatcaaaaaagctgtcgccatgcagttcaaattgttttaataggtttcgggtagcctctgccaattgatttaagtaactaattgctttttggggctgactttcagcgaaataacaggccaaactgtagtaagaggaaatggctgtattaggatgaagctttttgaggtcaaatgtggccataagattttccagtcgttccaaaatgaattcttgccgttcgggacattcaaaagccgttaggcttaacagatattggcaaatcagcagaatttgctggtaaatttcaacttgtaaaacttgttttgcttgctctgtttcccccttagcagcgaagctattggccaaaaataactcctcaccaagtttataaggacgattctgataaagtgcgataatatcatcgtattttttttgttgaaaaagtattactacttttaacatgatggcagactgaagttcagattcaacagttgttttgctgataatccgattgattagttctaatgaccaagggttactatcaatctgagctggattgctcaaaaccagttggacgaggagtaaaagggttttgttatcattgatataatgttttgctaagtcttgaatgttatgaaagaattcagtcccattttgttggtcaatttgtcctcgcaattgttcaaaaagatgccctctttcagagtcagttagtgttttttgaaaacctaccaactcatctaaagtcatatcaaatagttttgccattagaatcaagtaatcgatatcaggttttgcctgattgttttcccatttggaaattgtagccttggttaaatgcaaatagtcactcagtttttcttgagtcataccaagacgtgtgcgttcaaataaaatagtatcaccaatcattatgaacctcctttatttgttattataatgtttcctaaatgaaaaataaagttcctatttagaaacaatcctagtaagaagattctgtttaagaaataaaatttctttcatgtcacagtacagtacatcagtcaattaaaataatttatttccgtcctttttaaactgtagggaatcatatgacacattaaaaatttttgattaaaggcttttcgcctatctaaagtagatttgttccatcatttatccccgaaataaatttgaaatattgttatattgtactcatctcaatcacgaacaatataattgaaaaatggctatttttgcttcttttaattagtagtatgatataattttgtaagatattttgggaggttaaattggatataacagcttatcaaaaatgggttagtgaattttacaaaaaaagaaattggtaccagtataattcgtttataagaagtaattttttatgcgaagaggttggggaattagcgcaagctattcgaaaatatgaaattggtcgtgatagaccagatgaaatcgagaaatcaaacaacgaaaatttaaacgatatcaaagaagagcttggggatgtattggataatatttttattctcgcagatcaatataacatttccttagaagaaattattgaggcacataaaaacaaattagaaaagagatttgaagaatgaaaataactgtcttttgcggtgcaagcaacgggaataacccaatctacagtcagaaaatagtagaacttggtgaatggatgattaaaaataatcatgatttagtttatggtggcggaaaagttggcttaatgggagtaattgctgatactgttattaataatggtggccaagcaattggcgttatacctacatttttaaaagatagagagatcgcccacactaatttatcaaagcttattgttgtcgaaaatatgccacaacgaaaagggaaaatgatgtctcttggagaagcatatattgcattacctggtggaccaggaactttagaggaaatttcagaggtaatctcttggtctcgaattggtcaaaatgatagtccatgcattctttataatatcaatggttatttcaatcacctagaaagtatgtttgatcatatggtctctgaaggcttcctgagtcaaaatgatagaaataacgtactattctcagacgatatcattgaaattgaaaagtttattaaagattatcaatcacctacaattcgtaagtatagcaattaaataaagaaaatagccatttatatttggctattttctttattctagttaccatgttattctaacttttcaattttattcgaaaataaagaatcatactcagaaatatcttcatctacaaaaaattcttcaatagcttctttattattgatatttagttttttacctatacttttttgttctaccaaatttttaaattcttcatctatcatctattagcacctcgttattaaactatcaccatagttgttttatctcattgtactcttcttgaattttttcttcaagagtatgaccatagacttcaattagcatagaaatatctttatggccaagaattttcgcaataattcctagatcatatcctctatgccataggaagcttccataggtgtgtctagcaccttttgttgtaatgatgggttctatattcaactcttgaacgatgcctcttaaaaccttatttgtaccgtttgtactcggtacactattaggataaccaaaatgttgaaataccatattgtttgtattttgtaatccaagctctttatttgattgattttgttcaatcttaagatttttcaagatttctagacactcattatcaactggaacaattctgattgaggttttatttttaggtggaacaaactgacttgtttcagagttaaatcttctatatgttttaaagattcccttatcaaaatcaatatcttcccaagttaaagcaattaattctccgtatctcatacctgtttttaataaaaaatagataatatatggtactaccgatttcttataattgaatttatcttttacagcattaatgagatccaaataagctttttcactatgaaggtatttactatctgcatcctgactttttactgttgagaataattctacattttgagtaaaatcttctatcataaccttatcagcaatagccatttgcaaactctgtttcacgccagtatttaaccggcctaagaaattgcgactaactcgttgtccatagttattcataattcgttgatattcactaggtctgatttgagaaatgggtttatcaccaaatagcttttcaagcgttaccttccgactaagatatttctttttagtcacatcacttctattactaggcatgatttttaaatctagccattcttgataaagttctggtaatgaaatattttttgtgattatgctaccagttctcaatttttggagaataggctctgcttctgcctctgctagtttctttgttttaaagccactattataagcaactgttttaccttcctctcggatttcataagcccataaattctggtttcctctccttctatatcttgcatttgccatatgttatacctcaagtccaatcacttctgaaactgcacttctagggacaaccataagacgtttacgatcatagaaagtataaccacgttccaccattaaatttctagcttgatggataatatggtttgctgttgaaggacaatagcccatttcaattaagtctttattagtcattacattatttgtcattgtatttttttcctttcgtgttataatttatctagaatattttttctatgtcgacttctttcacaagtcggctttttttatgccccaatattcagagctttgctgttcacgtacatattgttcaatctccttttcgtcattatcagtaaacttttcaactcccctgcgaagtaagtcttgtaaaaagacctctgcctgatcgataccgtaggcttcgtattttgccatataaacctttgcaattgtctttgacacttgtttatcagtccacgcttcagactgccttaatgttggtttttctctcacaatactcagtcgtgttttctcctctgtattgatatagttttgccaccatcttacagattctcttcttcgtttatttttatctcttgcttttggagaaacaaaacggtaatgtccattgatagcctcaaaatatatagaggcgagagggcgcatatcatttagctgatgagcaattagattagccttctcttgccaacatcttagctcagctcgaacccatgaattaatgtcaatatccgtctgtaattttccattttgctccattaatttattataaacacaccattgttggtttcctcttgcaccaaagacaactgtttcaccaacgagttcacctgaatcaataacgaatttttcatggtactctgcatgtctcgcagttgttatacataagccttttttactatactcataaagcctttgaacatttaacgactcatcaaaaatatcattcgcaatatctaatctggtaaagttcgaattattatcaattagtctctttactaaactagtccaattattatcattaccttctataaattcctcatactgccgacagccttgtccttttagttcaacatgaactcccatgctactattaggatctaagttaaagtaaacttttatctctgaacaagcatagtgacgttgatacttattgactccccattcgttcaaagtaaaattggttaaaggtattaataaaagtttctctattacatactctggagtgacatcttttactgtaacagcgaaataatctatcttaacgctgttaaacaatcttattcacctataattttgatatctgaggtagtcagttttattccaccccaaccttttcgatttatattccatgctagacgaacttggggattaatcaattcaatcgttttttcaataagcccatcattgcttgcaattttactaatcttatcaagattatccaagatttctaatggaattgtttttaagtcgtcggcagacattcccatttcttttaagactttaactttttccgcatcttgtacttggcaagttatttttgaaatttcatcagtttgaactgattcaccattgatattattatatttattgttaatacgtgcggataagataattacttttttgggaatttcaaattgagatttttccaagtttaagtcacctagacttactgtatctgttaatttaattgttgccatttttctacctcattttcataataaattatttgcatcttttcttcctgtacacgaaagttactatcagctctactctctcaatggatttcagcatttaatggtattaaactaccttcaccccttatgtatcaagggtttgagcactatttcatgtacgtgtgtaccccctattagtagcggggtaattattttcatataaatttcaaaagaattttcacagattattaacttatcaaacttaggtttgtcctcgagcactctgcttttatctcccgagtcgctatggcttccagcacctcgctcctcgttagataatcgattgctctcagaaacctcgcttaagtttgttaaatatacctgaatccttctcattttctaaaatgtttaatcgctctgtcagctccttaacctgtttctgtaaagactgattatttttttttaactgaaacatactatcttctgcttcaaataagaatttatagaaatcctctgatagcattttcaattcattttttatatctcgttcggactgagcttttgagtcgccccagacttctttaatagagtcatctaaattctttgtcttatccactaaatgagataagacaataaatttagtaacttctacttctgtaaaatcaaagaaaacttgtgtgctacgcttagaaactcttctcctgacttttttaaatttgtatccagataacatttcaattcgtaaacgccatttcttgattgtactaaccgacttgtttgtttttaaagcaatttctttataatctatagcattaccacctatataatatatttataccttattaataagatataaatatattatattcttatccaatcaaaaaatcaagataaaacttgcaaaaaagttatatcctgataaaataaattatatacaatatacgtgagggaaaattatgacatatataattcaaaatttcggtccaaatttgactagattacgaaaagaacgtggaatcagtcaagttgaactttccaatcaactccaaattggtaagcagtcaatttctgattatgaaaagcaaaaggcgtttcctacatttgctaatctagataaaattgcagaatattttcgtgcaacccccactcaactattcggaaccataaaagaaattgagctagagaatagtgtcttagaaacagatacttatacttcaaaagcagatcatattcttaagtctgttaaagaattttatgaactaactaattatcttaatgattttaatagcccagaattttacaccagcgaaacaattaataatttgtatcatcttattactccaaaaccaatattggatccagaaactgatgaacaacttatgagatttattccaactggaaaactagtacgagcagaagatattagcggaaatcccgaagactatgaattggcatttaaaccaagtccacttactcaaactttaagtagaatagatgaaataaatgaactttatgaaaaagtaaggtttgttgaagcttttaaacataataatgaaactaattctagataataatatatacaaataacagaaaacctaaaacgatatataatatttttctctttacaatagtaaaaatatactgtaaaatggacgtaagataaaaacagttattctcatagcgcttgtttatcgtcgtccaaaaaaagtccctcattgcatagcagtgttgggacttttttatttagtaatgcaataaatcaaaagctttcaaaaatcttcgtctagacgtttcaaaaattccttcatcaattattttttcaactagcaaaaataattcttcttttggaaaatttttaatatgagttgctataaaattatatctaacattgtccggtacgtcagcttcaagtatgccaacaatttccgtttgtctttctaacgtttttgagtgtagcaatgggacgccaatactactagtaaagtcatctaatgatagctcttcttcctttgataatctttttttaatgttttcagtgtacttatttgaatctttagaaatatattctgacattgcaaacatatatttttttattggaagatgacttgctactggttgggttgcaataaatcgaataacaatttcctgaggaattgtttctttatctagaaaatatgatctaacatactctttaaaatctggaaacttatatatgtatctttcatccccaaaggcaacaactatatttttcgaacgaatttcatcctctgttaggtttgctaaatcttcataactagtcaagacagtttttaaatctttgctctctcctttaacttctattatttttcgaaatacattttcatatttcgctatttccgaaggtaaaaatccttgatttatcttagagattaatctataaatattggtaaaattatcagtttttaaacacgaatagtaaacgcttaagtcaggtaagcttgagaccactgtttcaatagattcagaatctggtagatattcaactacacctattttttgagctgattccgatatatcaaaaggactattttctgcaaaatctgtcaataattttctaatattttcatcagttaatgaatagcccaaaaataggattggtgactccaccaaatttgaaagtatttttgcattaattaatgctgactttgttacattcttttcatagtcttcctttgttatagttattgttgaagcatcatctacagttccatgtatcttatacaattcaccataatcagaagactttaaaaatagccccttatttcctacattaatcttcacactgacatttattgtttttaaacactcttcaataaaattatcgtaattagttgtaattattattcttgctttagataacatttgagaaaattgttttatctcctcaattttctcttcccgaatttttaagtttgagaatctatttgctactaactgtttaaatggagatatatttaattcataagctgtctttaagtctaaattatcaacttgaatattaccatttataaaagcttttgacacttctttttctaataatgaagctagattagtataaatatcaaaatcattgttttcaaatctttctcttaattcgaaggcttttgcataatatgattcttcatcaaacaactctagccatatatcttttaatagtttctcccatgtcggtgcattctcaaaatatctttgagtaatacctgaaccaacaaatataattgggaattgattgttttcactgatttgttctataaaattcactagttcttgtcctcatcttttattaattattagcttgttcaactgttaatcttattataacatcttggataccattttattaatttttattattaaaccatatactctaaaatataattgtcccctttttgtcccacattattttttctaacaataatacttcaaaaatttagctaaataaaaagcctttaaaatcagcattcttgattattattatcacaaaaaattgtaagaaatcgttgtagggggcattaataatattgtcaaaaaccttgattttaaaggtttttttctttgtttcagcagatttgttctagaagatattctttaaaaattagctttaagatactaaacttctgaccgtttcatattccttatttattacttctgtcaagacgtgaccataagtttcaagtaactgtgtaatatccttatgacccattaatcttgcaactacccaaatatctacaccttttgctaataagtaacttccataagtatgccttgcacctgttgcagtcatttttgaattaatatttaatatttttaaaacatttttaagacttttatttatcgcactatttgtcgaaacaccatatctatagtcataaaatatttgattattcatgtttacaatttttaagtttttcaacataacttgctgatcatccttcaaatctcttaagattaatgctaaagattgactaataggaatagtgcggatagaagtttttgttttaggtggactaaaagttcccttatcgccactaaatcttcgatacgtcttaatttctagatcttcaaaattaacatcatcccaagttaatgctaaagcttcacccactcgtaaacctgttttaaatagcaccagtaataaataataaacgatactatttgaataatccaaattgttttctaaataagatatcactttcttgtaatcaaaaatactatgtagatatttatcatctgcatccttaacaaatttcctaccagctatgacaactccatcagtaaaatcagataataagacaccatctcttttagcaaattggatagctttttttatatctgaatttaaccttctaacatggtttttagtgtatttttcagcgtacgtatttaatttcctctgatacgcactatgctttattttatttactttctgatttccaaaaagtttacgaataacagaacctcttgtaaaatatttgttctttgtagtctctgctagattgctaggctttataattaaactgtaccattcaaaccacaaatcatacaatgttatatcagaagatatagaatttactaataacttttgttgctctatcctcatagcttcattcatagcttcacgctttgtcttaaaacctgaaccagaagcaactaactcacttttttcattgaatattctataatcccataatttctttttacctctttgtctatatgttgccattttactcctttcttagacatcaaggaatttatcctcaatattatatcatttaactatttaataaaatagaaccaaaattatcttcaaaatattttctagcttttgttgctaatattttatatcgactacctttacctttcggataaacaataaaaccatttggattaattgataaatctacttctttttttatatctggatttaacaaaatatcattaatcaattttgaccttccaattcccaataactcttgcaagttatcaatatcccaccacttgccttgttcattatcacttaataaatttaaatattcttcttttgaaataataacaacatcatctggtacaggaacactcacattaaaaacctgttgcatactcatcctccttataacttgcttaatccgaacgttatttgttccaggtaattaggttttccactttaaaaccgaactatttttcagttgcagttttaatttaaaatccatatcccccgaacattattctttaataaaaaaacaaacaaaaaaagccatgaaattaatcacaactttatttctatcaacttcttatccttcaagatcatttaatattcttcttaaagtactttttatttcttctgcttcgctataaccgacatcctcaaacctagataattccctttcaaaacttgaaattgatttacgtaattttgatatttcatcatttttaggttgatttgataaatcgactattttttcctctaaagaattaacttttaagcctaacatttgattttctctgcttacttcaccaaacttcaaaattaattcattagcaaaagccattttttcaataagtttatctccatttttcacatgattataaacttcttcctttgactttttctcaataagcatttcatcacggatatatttagtatcttctttaacatatgagtttttttgaactaattcttgtttattcttttcaatattgtttgataaattgctttgtatcagaacatatttatcatattgatttgtcgaaattttggaaaattcgtctaccaatttctcttgaccttcttctaaaagctcaagttctcgttgaatagctttattatccctagagtttgaaatcaaaactcccacatttgtaaaaataattcctacaacaccacctaaagtagcccaatccattactgaataatcccctatcattttttctcctattctatcacattttattccaatctgtattatttaattaaaaaagccatgaaattaatcatggcattatcttatttttcacttttctttttgaaaaaggttaaatacttttttatattatctttaaaaccaatccaaactgctccagcaattaacaagagacctactattgtaaagatagtcttaccctcaccagtttttggcaatacttctatttttccatctgattttttaattgctacagtaccgtctttttgaacatttccaccaacttcagcagcatcttttaattgcgtacctgatggtgtctgtactaaaactttaccatcttgagtaccaatgacttgatctcctgttacagttgtaataggttgattaatagttggctttgttactggttttatagatgattctgaatgatcactaggtttattcgtagaaggtttgtcaataccggcatttggtttagtaccattatcagtaattccatctactggatttgttgtacttgatgatggagtacttgaatctgtcgtacctgttgtttgatctgtacttggtgttggtgcacttggttctgtggtatctgttattggatctgtacttggtgttggcgcacttggttctgtggtatctgttattggatctgtacttggtgttggcgcacttggttctgtggtatctgttactggatttatacttgatggtggtggcattatagaatcagatacacctgcatctacccctgatagcattatagtatcacctccactaattacaacatctgcacttgctgataaattaccagccattaaaaatagtcctgaaacagtaattaaacttaaaacttttacttttgacataaattttccttctttcttaaaatactacatttacaggtgtaccatgtacactcgcaatctcaaattggtctgtacctaatacataattaccagctaaacttaatttgtctcttttatctgttactaaattaatagtaaactgataaacattactcgcatctgactcatatacttgtaaactttccaaatcaaaatgataaccagccatcaacatggtttttacagtttgggcaactgtaggatttgtaatggataatttattttgataatcacccttaatatctgattgtgttgggatttttacaaggtaatcaataggtacagttatagatcttttaaccttctccttttccttatcagatacttgacgatcactagcttccaaagtagattttgcttctttagttgaatcataagacttaaccttatgtttcggttcaactcgttcaacttttgtatgattaccacttgttttaatcactggattatctttttgaataactttataaactataaaagccatcactaacaccattaaaaataaaactatttttctacgtttcattaactacctaccgttttcactttatcagacaatttataaccagctttagagggattataaaaactataatgctctttttttaattctaaagtagaaacataacgataattccatgaatatggtccaaatcctctattatctccagaataagttgaataattttgctctactattaacatatcgccattttcaaatacatgactaaccactccagtatgcccagcactagaagtacctgaacttgaaaaaacagctccagaagatggagtattttcagagcgtccaccgaatgcagatacccaattagaaacaaccatattaccatttcccattctttgcgttggatgcattccgcctttaagccataaaccatacatcaaacttgctgaaagatctgtacattgaccaccagtagaagctatcgcattccatccactagacgttcgataaaataaaccaactgacttaggatctattgcatactttttcaaatcacttggtaattgatctggtttccatgcattataagaagtgtatttaactttccctgacttatctttaccaaataagccctgtaccgcattactagctgaatcacaaagagataaaactgtagaatcagaaattatatcgctcttaccagacgaggacgtttttgaaccaccaccaaaacttttagaaaatttttctgcatcaaatttatattttgaaccattaaatatttcataggctttttgcccatccgcagtcttttgagctttattaatatatgcagtatttcctcgttcgtaagcattccaaactaaagtggcctgcttgggatcagtcatctgtgccatctcttcaaaagaatgatttccacctgataaatccattgctttattccagtctcctgatttaatggatttcataacaaaggcattcatggcatctgcatcttcccatttgggatcgcctaatggggcatactttgtgaaaggtgtgatttgataaataccacctccagcttcagtcgtatagtaagataacccagtaggtctcacattaaaggcaattgaatttgtttttaaatcattaccataatgcccttctgctcgacctatcatagcaaatccaccttctgaattaacccaaccaacaatccctgatgcactcgcaccagataagcctttacttacccaagcattgaataccttctctgctgtttgatttgcaactgttcccttttttgtccaatcactattggaagcattctcacttgaggtttcaacttgtgaagatacatctggtgtaatttgacaatcttgttgagaacttgacgaagcagtcaacaataaaaccaataaaaaaggaaatacaatcagtattcccaaacagcctaattttttcttatgttttactttagttccctcctttcaaacaaaataaaaaagctccaacaaaaattgatactttaaaccactatgaaatatgatataataatgaagcagaaaagttaagacggtggctcttatttctgaaaggtaggtggtcccatgggcaattcatcaaaatccaacagaaaggaggagctagatttgtctacctttgaggtcttaacactcatgtttatagcaggtaacttcgttatcgctctcgtgaagttagtccttgaactggtaaaatcgacaaaaaaataaccgtctcaactttggcgagttaacggttattttttaacggttattttctgccaccgtcttaaacggttctgctaagcagttgttagaagcaactgctttttatttacaattatattatacataatctaaaaaatagtgtcaattaatatatagtttactaaacctctcaatgtcataaaactccttgtactacttaccttctctcagcttttctagttcttccaaaacttttgactgtcgttcaagattatgttgctttctaacttccttagttttactggcattaaatcccttttcaaaagcatttttaccatgattttttgtcatggatacatcactattaaattgacttaattcaccctctagcttattaagctttcgctgttttaatggtgaagtatagttatttgaatgattttctatatcatttgttatcatatcctgatttgttaatgaagtatctccatctccttcttgaaacgtgtgattatccgacttaacattttttaaaatttcctctgttgaattaccttctgatataaacgatagctcataagaagattcctttcccaattgttcaatccttttacttgcttctttaggtaactctgattgatattcaccttcattagtcagctcagcctctttagaaataacagtatcatccgcattagcttcatcatacttatcagcatcattagttttagactgaccatcatctaaattagcttgttgtctttctttgaaagcattccaattatcttgtgcattcatcattgtaccaacaccatagccagctcccatcatggcaaggcttgacatatcgtgtgccctctcataaatggattttggcgtaattcctagattttctgctttttcattaattttatctacagactgattaatgacttgagaagctctagaccctataatcagtcttaagaaagtttctttatatttccaaattccccaaaacacacaaccttggacgaaaactgttattagcaacataaacagtattgcctgacctttaaaattactaccactaagcagggaaccatctgtaaattttttcttaacaaaggtggctattaaagtttgagtatagaagactatcaaggttaaaaaaccagctaaggcaggaaaggaaacagccccaaacatgactttcaaaacattgaaaatgatatcttgcattctaggcaaaaatgaaactaataaagctaatggaaaaataaacattaatataatcactaaaacatctgccataaaagcaattaactgaatgagtattaatggaactgcgagtataaccgcttcaaaaatctttaagataacatagcctgattttatccaaagataatcatttactgcagaaagccatctatttttttcctccccttcggttgccttatctcccaaattatcagtataattcaatatatccttttgttttggagtgataaatttacctgatttatcgtacttacctaaaacttgttcgttatcaaacttttcttctttacctgtttgattattgtgaaacttaccatttaactgaccagtattgacaaacaaataagccgtataagaagttttcatcacataattatcagctactgatgatttttgtgtgatctttgttttaccacctgatggattatccagtgataaattagttaccgcatctgaaaacgaaccagctagttgatgaacggtatctaaaatataaataccacctgatgttgattgaatcgtaccaaagtaacccatacctaaaatgataaccacgaacaagtggatcaaacgtttagaaaaatctccttttgaaaaaagatatgaaataaatattgaaaaagctgaaatcgcaaccaataaataaagcaaggagcttgtataagacccattacctgatagattttcccataatttttgagacgaatgataaactgtttgtttataggtatcatacaaactgaaattttcaaaaaagcgtagaataacagaaaataaaccaacaatcaagttaagtaggaaaaagggaaaattaacaaaaacatctaacaaaatgctttgagctccagtctcagctccgtgagttatctccatataagcctttaacgcaaatatatccacatcttttaccttcgcaaaggtcgaagcaatcaaaccatcatctattttgtccatctgattacctcccttctacgaagcatatttattttcaaggtgacttgatactgttttcttcataggttttaacaatggatcaatatctggatgaatgttatgtatcgaaatcatattcaagttaccgtaaacatcataataaagacattgacctgaaatcatattatcaatccattctagattcttaggtgttacttctaaaccaacatgacttaaaatatcttcacgttccgatttttcataaaatgaaaaaattgtcccaaagccggtcgtatcatcatcgttttctgcatcatgaaccgattgagatactagcatcaacacattatacttagagcgaccaacacgacgcatagacttgataacagccttaccttctgaggattgcataagtacccatgcttcatcaaaaatttcaactgtttcatcatcactacgctcaccaaaatgcttacaaaacgcacctaaagcaaacattaaagcaatcgaattactttcatgatcagatatatgatctgaaccgtccttaggcaatgataaatccgcaacttctaaaactgtcacacgttcttcgtaagaaagaccagcaacatcaccatctgaaaatgccaactctaaaatagaattctgaataatagctttaaaataacgaccaactgactgaacttcatcactttcagaatcaataagaacttcaataacctgattaaaaccaacgacttcaccagcttcacgttttgcaatgacttgactaattgcttctgttaaagctgttgtttgatctaatttaatctctgtagcgttttttaacaaataaagcaacatatttttagccgttgaggaagcaccttccttatcaagaataacaataggatctaatacaccatgattttctttgacagaactatcaagagtgacaaaattcgtttcctcaatttgcttcttacgtagaggaaacttacgtgcatactctggatcagaaacaacttttaaatagtgttgccgtagttctcgtttagggtcaacataaaggacacgaacattttgttgagcagtatgtaaaaagatcatctgtgctaagtatgatttcccttgacctgtcgccccagttataatcacgtgaggatttttagtaaccttaccagcaacatcttctttattcgcgactgtcgcattaaataagacaagatttttagatcccataatagcttcgtcaatagaatcccaagcagttaaacgattatctactcgtccaatataccaaccaatcctgttacctgattgggtatttgtaaaaagcatcaactccgaaaaacctcgagcagttactaaatgattccacttacgagttgttttttgtaaatcttgaccataaagtaacgcttgaaataaatatggtgtatcatgactggcttcataaacattgactttcatatcatcaaagtaacttaaaatggcatatctacgttgttttagttgatttaaactagaaccagcaactaccaaataacaaccatactctatgatttcttccttatttccaacttttttcataagatccttaagcgaatatgctcccatcaagatatcatcttgttgaaccgtatttgtgttataagcttctttcatgatttgatcatagcgtgtatttgagcgacccatagtgccacccaattttgtcttatctataaattccgctttaaatcttaattcaaccggaaaactcattctttgaactagttcaccaagatgaaagccattaaatatggtagagaaccgacctactggaagaacggatacaaatgaactcccataagcactctccaattttaaaaaaccaccttctagtgatttaatcaacgtatctgtcacatttaacatattccgattagctataacctcacttttagtatggggaacatatcttaaaaattgcatccgttgataataaaataaatcaacatccgttaatcttttggctttcagggtagacaataaactatagacaagtaattcttcttctgaatgttctttataccaatcttcatctacttctacctcataaccagctaaagaagcgaagtttgatgcgatagattcaaactgattataaataaattcttttatattagcattgtattgccctttaccaagatcaactccaattaaccaatcaaactgatacggtatctccatttcatgtgttaacgtatcaactgtaaaatcgagtgtttctaaccctaattctttaacatcatctgctagatccgcttcaaaatccgacattttttcaccaagaagataatcttttggtattagacttcctgcgaaactaaaatcctagttcacggttgatcattccagcaatcaaattcattcgtaatccaaaccgtttgcgtcgatttcgataggttgttgaaaatattttaaacgtttttactttggcaaaaatattctcaaccttgattctctctttggatagcgtatggttataggttttatcttcaagagttagtggcttaagtttgcttgatttcctcggagtttgcgcttgtgaatacatcttcatgatcccttgataaccactgtctgccaagattttagcagcttgtccgatgtttctgcgactcattttgaacaacttcatatcgtggcaatagttcactgcaatatccaaagaaacaattctcccttggcttgtgacaatcgcctgagccttcatagcatgacatttctttttaccagaataattcgctagttgatttttttaggacgattgatttttacctctgttgcatccacaatcaccgtatcctcagcactaagatgagtttttgaaatcgtaaaaccactttgaataagagttgattcaacccattgacttcgacggattaagttgctttcgtgaatgccaaaatcagccgcaatttgttcataagtgcggtattctcgcatgtattgaagagtagccatgaggagatcttctaagcttaacttaggggttcggccaccttttgcgtgtttacgttgataagctgtttttaacacagctaacatctcttcaaaagtagtgcgctgaacaccaacaaggcgcttaaatcgtacatcagttaattgtttgcttgcttcataattcatagaactattgtaccatattttgtttcgcaggaagtctattaatgaaatatcaaaatttttatatttagctaattttttgataacctgtgctactttcgttttgtgactatctttcttatcactatctgtaatagtgattggggtatttggaatacgatagtatgcgacaacaactttatcttttcgtaaagctaaattctgatgtattctatcaatcggatattccaatttttttaccatctgatctcctttcttagtctttatattttcgttttctcaaaaactatttcttcttcaatatcaacacgttctccttgatagataccttttttatttaacccaaaatctttgagataaaccagataatcccacaaaaagatatgcatcttttttccttgcggttcatattctacataaaatttcgctaacttgcttggaacaaaccaatacaagagcattgaaacggaatgcgttaaagcatttaacacctgcattaatggagaacataccgtcagcatcaacattaagatgataaagaaaacaataaaaaatgataactgcataggtgtagaaaaataccaaatcactttgccttttgccgttttaacttcctgaatccagtaaggagcattcaagcccctgctgtaatcaaaatatttttcttcttccataacttataacttataaccccgtctcaacaccaaaccagcgaagcattccacccaaaaaagatagaatctgttgacctttaagcattgatacaataatcgcataaatagctaaggttgagaaaacttttaaccaattagcttctttccaattcttaataattataaagacagcaattacactaatgaggtaaatcccatcaccttgaaaaaattgctttagtcctgaaacgttgggaccacctgctaaaataacactattcacttttactaaattcattttttccctctcttacacctctatttaaaataatgatacatctcttcaacataccaaccattgtctgctttaaataaatataatgtaaagttttctgatcgtgtgccacctgttacaagatcttcaaaagttactgataattgcacgacttgatgctttttttcttgataataaatcgcattattaagatctagctcactaactttaaatcctttccccatcagttctggagttttcattaacagtttcaagtctgtcttgttaattaaggcatatttattaaagaaaactggtaaaaacttttgaatagaacttacttgttctttcgatagttccttgacttgatctaatgttttcttctcaaatgctttagatttacctaaatacaaatcttctgccacagtataaggttgactaacgattgcaagcaatcctctttgcatctgaaaaggaacagccaagttcatctgatatgattttttatcaacttcataaccaatacgcatcaaagctatatagtaatctttttctttttcaacacttattaaacgttgtgtctgcaaagtcctagactttctaacatcatctgtcatactggcagttgagaaagaataataattttctaattctgtttttctttgatctgcagtatcttgtgaatagttgatatagtagtagacaaaattattcatgtaatactgaattctagatatatctaatgaatcatcagtcttcttatgttttgactttttttctacagcaataactgtttcttttaaatgttgtacctgattagataagccaattgccctcaatgatccaaaaaatcctacaataaataacaaacctaagataccatagacaataaaattggctgtcctttgctttacttcttttgtcttaggctgtttacctccctcttctttctttgtatatctcaatagaaacttttttattttttgtatatcaatcatttaacccctttctataaaataaaaaagcagtcactttttttagcgactacttctacttataatgatctctaaaagataaaaaatagatttctccatcttctatcatataaatcaacctatgttcttctgtaattcttcgagaccaagcccctgaataatggtattttaaaggttctggttttccaatgccttcaaatgggtctcttttaatatcttctatcaaacgattaattcgtttcaagatttttttatcttcctgttgccaagaaacataatctttccatgcttcttcagtaaaattaaacatcttctacctcaattaaaccatgtttagtgacttgcttctctttaacttgtgatataccattaataaccttatgtgatagataatcattttccatcaaacgaatcgtttcttgtaaactttcccagctatcttgagataaaaccactatattttcatcaggatttttattaactacaatcaaaggctcaaattcatcattgaccttcttcatataatcttttaaattatttctaaaatgtgaataaacaatagcctccatattaatcacctcaactttactagatatgttgttattatatcatttgacaacatgttgtacaagttttggttttgataatcactaaataaataacttacaaatgataacaatacataaattatcgttaagcttccaattacctcctcattctgtttttaacacgtaaaaaccttttgaggtgtttaatactattccttcttcaatataagcatttaaagcatttacccaagttactgaccgttgccaaaaatcaattaaagaatcaaattcaactttccttaagatatatttcattactttattttcattatttgacaaaaatatataatattttgtcactattgaatgaactgataaaccttttttcaaaagatattgaacaatatagtcatcaccatcataaagtccttcaatacatctttttaaaagatagacttctgtaagtgacataatcctatcaacattccaatcagaaaaaccacaaataaaaaaggcatcatccttaatgcctttttctatcatacggtttcttacttgattttccgtaaactgcatgatgtctaactcacataaaaattgacttctacctttttcacgagtccttataattgcaatcattatctacttaccctgatatttcgacatatccgtagtctgaaaaaccaccttggctttctaagtcaatatctcgaccataagcttcatgatcaaaatacatctccagagcctctttaccaactccttgtacgcctaattcatcgaaataatattcacctagttctcgtctagttgtgacatcagacagtaaacaacaatcaccaaaattaaaatcataatccacaaagtctgaggcagtataacctattacctgatgcactgctttaacaagttcactatcaacattctctaccagttcaacaaattgattaatcatctcaatagaatcatgttcttttagtaactgacaatccgaatctgcaataatatactctaaatcatcttcttcacgaagccccaaagctaacttaagctcactcatttccacaggaaaacaaactaacgtagctctaccagtttttatatctctaacaattgcactaacatccatttttgacactccttaattaaaaaaggagcaagccattgacttgctctcacccttaatgaaattcttgtagtttatgaccaatcgctgacatagacttatgagccttattaatcatattattttggtagtagtatgatttcaaatgttgttgaatcatgtcgaccatataacctggtaaagtcaattcttcacgctttttaagtaagctatttaactctccagctttttcccatgactgttcatactgatggctgaccaacagctctgaaagctcctgagtaaccactaacaactttttatctgcttctgaacgtgttcctgacattttattttcctcttttttctttagactctaacaataaatcaacctattacagttggacatctaattttcataattttcacccacaaaaaaagaactcctataaagaagttctaattactcatatataaattacattacgaggattcaatacagaaagttaaaaattcatctaaattactcttatttgaagaaattaacttatctcttagctcttttatcgtctccacatcctgctcccctcgttctacaggaaacagctttttgtagtgtctcttttctttatcattcttagcataccaataaccaatatcattaaggacctcctcgaaattgctatcattccatataggaacaataaaatcttttttccaatcttttacaaataatgtagaactcttataggaatctatcttttcctgcgatgtatcatcaatatccatgataataaagattttaacgtttttgggatttccttttttatcgcactcaaccttgaaaaatttttctttaaaacattttttagttttaaaatctctattttttaaaatatcattaatcgaagatatttgtatagatgttttcccatttgacctcgagtatatttcaagaggaagcctcagttttgatttaatatgtttaacaaaatccagttcacttttaccgtgaacaattactatggcttttgtgtatttacgaaaactcatttttagtcctcgcttaaattatgatcaagaaataaatctgaaaaatcaatatctaatggatctggtacagcaccaaagaaaccagacaaatataatttttctaaattgttatttactcctatttttttatctgcctcattgccagaaatgataactttattacctttaatatctacatttaaaaaataagctgagctcggtgataattccttcaataacgttgtatcatgcgttgtaaatattaactgaccattcacacttcctttcaagtcattcagaatactattcattaaaagatcatgaatacctgagtcaatttcatcaacgatacatattttcccatccaacacattgttaaaaacttttagaagatccagaagattttttgttccctgagattctaaacttattggtacatctaaaagatcacctccaatattttttcggatcatgagttcatattttatttcttgaccttgagcatcctgcttatatttaacatcttttatatcaatatataatgcactaaaatatttataaataatttcctcagtataggaaagtttttctttttccgacttatcaattttaccttttgaaatatctttcaataataattctgtcgaatgaaaaggacctctaaaattaccactccaaataaaaattttatcaaattcatcaactactttttgaaaatttatagaaacttgttcattaataaactcttcatttacttctagacaataattattaaatattgataggaatgtatgtttaccccaatatttttctatttgttcagtcaaatctttaaaaatagtattcttaaaaattgtcttatttaatgattgagataaaccatctatgttagtaatactgaaatgaactcccttattggattttatcttaaatactagctcctcttttactagttcattattttcattatattctagaaggtaataaccattatctttttcgatattaaaataatattttagaatcgtattaccttcagatgcaattctatgagtatttttcgctatgcccttaaaagtggtgaagaaactgattttatctaagatttctgatatatcaccaaagttagttttttgattttcttctttatttgtttgttcttttaataatgattgtaatcgtgtattttcatttaaggattccattgattgtaatgacaaaactagtaacttaaaagcttcaacaatatttgtttttcctgaaccgttttctccatagattgcaataatatccttacattttcctctattcagcaaatcaaaagtcaaatttgaaaaggacataaagtttttaaattctattttactaaacatatgcatccctcgtttctattacgattttttgtttttaacatatgtacaatacaaattgtacaccactttactaaaaaacacaagataaattatccttttataaattaatatatataacctcttttgattattctgaagtcatccaaaccttcctcaaattagtcagtttcatattctcgaaataattcccttttcatcaatattctttttctaaccttaactctttcagtcttttagaaaaacttttcatattgttttttgaaagcacaatagtattactaaaattatcacttctaccaagtaaataatctacagtaacatctaggatatttgctaactttattatattatctaaagtaggttcagctttaccactttcccaattactatatgacttttgacttatatttaatttagacgctagctcagtttgagttagttttttttctttacgcaattcttttagtttttgtggaaaattagtcaacttcttcatctctaaacatttcccttctcatcagaattcttttttccaaacgatatttaccagctaaacgaataactatctctttttgcttttctaaaggttgcataagcaaaccaaactttaaaagtttccgtttaaaatcagcaagttcccttaacttatcttcgtagtctttttgaatttcataaacaccaacataaccaatcttaatcaaatcataaatgtctatctgataatctctaagctcacctgtttgaatctcaggataataaaactcacgatcaggaatcataaaaactagtaaatcaatcattttatctaaattatttcgtctattaacacaataagcaaattctcggttactatacaaaacaaaacttacctcctacaaaatacctaagctagctttgatactgtcaagtatcttctccccacgttcattgacttccccagaattaagaatggtttgtaaatagtcaccatccacaatcatgtcatactctcttatcatagctaaagacggagaaacagaatcacttaaccaacgtaaggttcgttcaatactataagcctctggctttgtaacaaattttaaaggctcaacacctccaaacattaattgccactttctatctgcttgaaacgacccatattcatttttcccatcatacacgtcaatcttactaacaattaaccctctggatatttcaccaatcggcactccagaaataaattcatcaactgccgcattagctttactttgagataaccgtatctcataacgattccacaattcaaaaatttctaaagcttcttcaacagtaattccttcctgctttgcaatttcataacgtttttcataaaagttaaaatacatttctgattgacgactaccaaaataaagcgatattccttgtctattctgctcaatctcttccatatccgaaaaatttaaagaaccgccacctatataattccaagttctcaaactttcaaaatctaactcatgacgataatattttgaaatcatatctgacaaatgaaactgttcattttctctatccttacccagatacaattcatcaatagcaatatcaaaacgtgtcacattcatatcatcacgatatgaatttcttagataacttaaccaatcatgccatgtaaatttttcagtttccatcaacaattccaattgtcggcatccacgaccagacaattgaacagttatttgaaaattacctgtctcatgtttatccgcaaaatcaaatatccaaatatctccacgtttccaaagatgattgtaattcatcaacttcgattcaaaaggctgaaattctttaaatgcacagtgcaaaaagttacgacagaaaaattcaagatccctaacatcctttaacgtaattctgacatagtcaatcatcacttgtaatcgtgaactatcattttctactagatatccaaaatgtgattttatctcttgatacttttcaagtgtcaacttccgctttccttgctcatagtttctaagtgatttcaatgtcaaaccagaacttaaagcaaattccttttgttttagacctgttttctttcgaaatttttttaaatagatagcatccacaataaacaaactccttcttaggattagtgacccacttttttcactaaaatgacccacctttaaaaatctgaaaacccttgatacatataggtttttgggggttaaaattcgaaatttttcatttcttacccccctattagaaaacgggggttttaaaattgataaatccctctgtaaagccctagtgtgtgcgctgtgtccggcgtgtccgttttcgctacgctacactacgcctacagctacactagggctttacagaaggatatttaaaaaatacccttcatctactattcacccttaaaataattcaatagtaactctttccagctaccctcaaattcatctttttgtgtcagtaaactttctaagacgactgcatcagaatcatttaatacaaccttttcatcttcacgactaaaagtcatataattatctttttcaatcatatctattaaattcttaatcttaccaaatgaaaaacctgttttcttagctaaatcaccaatactcatattttccatttcctccatttcatcatcaaaatcaaaccctactgaacccttaagtaactcattttcagacgttttttccacaaactctctcaaagattcgtctttaagaatcgccttagaaacttcctgattttctgtaggatcaaaaggattctcatgcctatttattttttcaaaagcatcataaaaagagaaatttttaggtaataaaggagaataaaattctcttgctacttcaccaaaaacagctgaataacctcgaccataaacacgacgacctgcaagatatttaataaacctaaattccttatttctattttcatcaccaaacatcatcacataaccaccatcatcgagacgaccaaccgagatatggtgcatcatattagatctaattttagtgggaagatcatctgcagacggcttttgcattgctataatcgcattacatccaacctgacgtcctaacaatatatattgagtaaatgcattatctacaatctcacgttcctgataagacaaagaactcattaaagcattatattcatcacatacaaaaaaataaggttccaatccataatcataaaactttttcatgtctttatgacctaaacgcttcatttcatttcgaacaaaatcataacgtgcaaacattatcgtaacagcattttcaaacttctcaataatatcagccttttcaaaggcaattctaccttcaaaagctgataaatctgacatagtaacaaaatcggctcttttagggtcacatatatcacaaactccaatttccgcaagacaacgaaggattgaccttagtaatactgttttacctccaccagtaccaccagcaactaataaatgaggatcattgatgaaatcccaataatagccatccattaacttaattcccttatctttattccatatcacatctttaaccgtaatacgtgataagaaagccgaataagctaatttgtaaattttaaagcgtggatcatcagttttttccataaaatccatgaaaaaagtatcttctaattctccaccaatatccttaaatttcttttgaaattttcctccagccatttcaaatgaaacacttaaatcatacttaccttgtttcacataaacttttggaaaacgatattttgtcttcgttttcttatttgattttttacgtttttcataaacatagccattctcatataaaaacttagacattctttttaatcgatctagtttattaaataatggattagcttcttgcaaaaaccaagtcaaataccaagaaacaaaaaatgctaaaaacaaacctgtacctacactgatcatagacattttatccatcatttttaacaaatctaaatagtaataactatacacgcctacaggtgtcaaaaacaaaataaatagaaaagaaaaaaggtaataactcatatacctcatatatggttttaccttaatccctctatattgtggtattaaacgagccaaattacccctcctttaccgtttatttattaactttagatgcttcattttttgatgcgtttccattatttgcaacatcctttttcttaagtgatgatgcaaaaattttaaacataccacctgaaacgttagaccatgtcacaacaacatcacttaattcaatagggtcacccaatttaagacctaaatcctcgattgcataagaaggcatatcagtaattgaaacaaaaattgtttcattttgagcagtactaaatactgcaatatcattccacttcacttcacctgttggtttttgtggataacgaccaaatcgatctggtggttgtgtcgtatcatcttccgtaaattgaactggttcttcatatcgtctccaagttaaatctcctaacaaaacatttacatccaatccatcattaaaggtacgatattccttatctgcaatttgtaatttttctccaaagtttaaaccaatttttgccatatttctaatcctctactttccttatttcacttcaataagcttttcagcccatacattttttgcaggttcaatatttctaccattaattgtattgtcaataaacaataacggtttttcaacagttaccatttttccatttccaatcacacgtgaagatgctggtgtataaacataaaacttaccatgtttttcattaaacaaaatgtgtcttgtataagacccttttttaccatttaattgagcaggtccagcttcaaatccttcataaattgcatctccaataaaatttggaagtaacactaatgtttcttgtttcataatttcctcttttctaaaaataagaagcactttttcaagtgcttctgaatattgactttttaattttctttgcgttttttaaatcctgctaaaccgatagctgacaagatgattgctccaagtgctgtaagaggggcaacgcttgcttcaccagtttgaggtaatcctttagcaggagcttttggagttgctttttgtggttcaactggttttggtttctcaggagtatgtgttaccacagtttcagttttaaccttattcccattgataaaaaagtctgcggtattgtaaacatcacctgctttgatacgtttaaccaccacaaaatcatctgccccaaattcactagaacgtgcaactttttcaaggaagtctttcttgaagactaattcatagagacctgtctttttgttgtaaactgtttctgtgtactctcctaaattagtcccttttttaatgactgtaccatcttttaatgtcacatcaactttagcgaccactttatcacgtaagtaaagatcaggtgtgcgttgtaattgatccacaaatttgtattcaaatagatcataagaacgacctgttggaactacccaaccctctaatttgtaagtaacttcatcacctaatttgacagtaccattgttgatagacttgccatcttctttgtctaacacatctttatgtatttctggagttgtcaaatcattgactacaatattacctgtatatccattgccaaagtcgatttgtgcaacaccattttgaatttgacctttagtaaactcttttttaactttaaatgataagttataagtaacatctagacctttttgaacataagctttataaaaagcttgtggatcttttgcagtccacatgtaaaactcaccaacaggactgattcctgcttctttaataagcgtttgaagtttctcatctaaagtatccgtagaaagcacatgtcgcatttctaagagttgtgacacatctgtgccatcagatgctttgattgagttcactttcatagacttaccatctagtgcgtcatctttataatcatcaataaagacaaagtttttagctattttaccttgtgatgcagtcattcctttatattggctaaagtcttgtttagcaacgtaatttaattcagcatttggtaatacggttttaccattaacagattgacctgcttcatcaatgacagcttttgaaggattagcagctggaactaaaacaggatgaacactaactgagtagttaatcttttcaggaatagacacatgtggtttcacttttggttgagctggagtgtaagtttttaatgtaggtgttacaaatttaggctcaactggtttttcaggtactggtttttctgcttcaggagtcactttttctgttgacggtggtgttggctgttttggtataacaacgttaggaacaacatcattattattaacataagacactaaagcagacccatgtgtgtcatgtacccagtcatcatgaatcttaaagacttcaacgcttccactagaaccatgtggtttaagctcatatttaagattgagttgtaaagttttgtttaaagtttctgcaaaagttttgttaccattatgtttcttctcaaaaatgatttgtccgtctttagttaagactctgaaagcaatattttgattaacagcagcattttgagcaacattacgatactcgtacttgtaaagagtgatagagtcaacaaatgctgtcacagagccatctttgttagcaacataatgatgattaactttacctgtcaatttcccatagccgattgtcttcacaccatcgatcatatcatggttaaactcgaaacttccgtcaggtttagtttttgcagtcatgattgagtttccatattcagcgttatcaacacctttagcttgagctttgatatcaaaagcaacattattaatagactgtttatctgcttctgctttagcttttagagcttgattataaagtgctaatttagcttgatagtctttttgtaactgtgcgttagtcgcatctgctttagcttgtgcatctttattacgttgacgtacacctgcattataagcttcaactgatttgattttcgctaatttagcttgataatctttttgtaattgtgcattagtcgcatctgctttagcttgtgcatctttgttttcagcatcaatttttgctttagtttgtgcatttaactgacttacacgttgagactctgctttgttttctgcgtcaatttttgcattttcagcagtagcatctttaatagcttgtgtattagcttgtgcttttgcagtaacatctttaactgtttgtgtttgattagctaaatcagcttgtgcatcagtagttgtcgcatgattaactgcagctgtggttgtaacagctacagctgcttttttagctgtagctactgctttatcaagttgagttgatgttactgtttctgcttgattttgcgttactgtttgagttgttgcttgagttgtaacttgatcagcagacacttgactagtctgtaatgtcgtgatcattcacttcataccaattgaaagtatcgtataacatagctttattgaaagcacttgaattaaatcgtggcttacgctttttatggagcttctcattgaaaaggattttggctcgtaaggcatcaaacgagtaacctctacccattcgctctacctgcctaataatgctgttaattgactccgtataagcattagtgagccttttatcaaagtagttgaatatttcaacatgccagttgtctacggctctcacgaggtctttatatgcgtctttagagttgctggacatacaacggtgtctccattgactataacgaagatgaccttcatctggatcaggagtatcccatatccagtaaaactcttctttgagttcataggcttcttttaaagcaggaagattacctaaccaagtatctaagaggaatgattcacgttcatttagatcgtgtttacgctttagaaggataaacctttcacgcataagggtacgtctttctttttggctcatatgggctttcaaagactttctgacgttatctaaggcttgattagccattctaactacatgaaacttatctacgacaactttagcttgtggaaggatagtgttcactgcgtctttgtagggcttccacatatccattgtgacgtactcaatgtaagtcctgtcactgatttctgaaagacgttggatgactgtttccttgttacggttaggcttgatgtcataaatagtcctgcgttcaatattagtcaatacaagccgaggtctacggataatatgtatctcgtctatcccaagccacttaggagtttcaaactggtattcacgttctttgagtgccacatagtccttaaaaacgttcctaatggttttctcgtcaacaccaacgctttctgcgacttctacaaaggtcttagacatggattgctcttgaatggactttaaaagccttttggtcatactacgcttttcatctacagatatggtagatccgcattcacgacacttgtatcgtctacggttcaaatgtaagcccactcgctttaaacgaatgggcaaatccataattagttgatttcttgaactgtgtttgtacaacttgtcaaaaccacattcaggacaacgttcaggtggtccgactgcttcaactttaaacatcatatcggtttcattttcttgtggcggttctattgttttaatgtctggtagggataataagtctgacatattattcatcctttattactctgcggtgttaaggtatcaattatagatttgatgtcgaaatcatcagtgttaaattatttttgtgaccacaaatgcacttagaaaatcccttaaagcattagctggttcacttgaatagggagttgtaaaaaagttcccttagcctgcacaacaagataatttcgaaatatctttatcgaacgtaagtgcaactaattttagcccttcagccattgttaaatatggtgctagggtttctgttaaatcttctatcgttaagccaaatttaacagctaatgatgctgcatagatgacatctcctgcattttcagatacaatatgaacccctaatacttttagtgtttctgcatctgctactagtttaaatacaccggttgtttcacggtttacaattgctcttggaacagcacctaaaggtaatacagatgtcttcacatcataccctttctcttttgcttgttcttctgttaaaccaaccgttgcaaccgtcggattcgtaaacgtaacagcaggaactaccgataaatctatttttttgtttaatccaccaatagcattatcagtaataattccaccttcataggctgctacatatacaaattgtggtcctaaagtcacatctcctgctgcataaatcttttcattacttgtttgaccaaaatcattgatcaggatttcattattttttccagtttcaacacctgctgcacttaaatttaaagaatccgtatttggttttcttccagtggcaacaagtaactgatctgattcaatgacttctctactgccatttactgttacgtaaaccctttttatctctccactttgttcaacacgctcaaaagttgcccctttgacaaggtttataccctgttcaattaacgctttttcaactgactctgaaatctcaggatcatactcctttaaaagtcgctcacttctttgcataagcgttatttctgaacctaaatgatgaaatagttgtccaagctccattccaatgtatcctgaaccaattacagttaatcgttttggtattttctttaactcaagaagtgttgtactagttaaatagtccattttttcaagtcctgaaatttggggcaacgaaggcgatgcacctgttgcaattaaaaagcgttttgcagataactttgtcccattgacctcaaccgtactagcatcaacgaattttgcttcacctttaattaaatcaaaattatattcatcaattaaatccatatatttttgattccgaagttcgctcaccaatttatccttttgcgtgattaaactagctaaatccacttctccagcggatgtttgtaaacctataaacggattgtcttttgataaatgattgatttcccctgccctaagaagagtttttgacggaacacagccaatattcacacaggttcccccaaccgttccacgctcaatcattccaacttttgcaccgtattctatagctttaattgccgaagaaaaggcagcagcaccagaaccaataataagaaggtcataattgtcttcattaattaacgccacgttttctagtgatgatacttcttcaatttctccggcttggtaatttgcttcatcaatcgcctttattgcactttcaacctcaatatcatcgggcagttcaaatactgcttcaccacgacgataactagactcaatatttttagcacctatcttttcaagtgctgattctacgtgtttttcacaacccgtacaagtcattcctgaaatgtttaccttaaatttattcataaaaaagctcctttcgttaattaatctctcatgttaatgtttctattattggacacgaatgtaatttcttttcatctggacatcgttgttttaagtcgtctaacatagtttcaattcgttttaaatcctctatttgtttttgcacttccttttgttttttagaaacaaattcgaacatatcttgacaacgaacttcatctttatctacaacaccaagtaatttataaatctcgcttaaagagaaaccaagttcctgtattcgtttaataaacccaacacgcttaacgtcatcatatgaatatatccgataaccagcttccgttcggtgaggttcttgtaataaattttttcgctcgtaatatctgatcgtttctttattaactccacatttatctgcaaactcactaatgcgataaatcatcttatttcaccccctgaatattataaaccatgtaccatagtacacggtcaagtaaattggactattttatttttttcccaaagtatcactcgtatgtgattgatacttttatataatactattgattatcctaacatcccaccagaaaatccgatttaaacaccagttgtttttaaactattaagaaagtaattccactatatattccgaagaccctttaaatttaagttaatctaaatatttctgaactttcatgctaatcaattaaatttcatacgtgtttcttatttaatcttacctcaacaaaataaattttattaaaatatataaaaagcagactatgttatattttccatatttaaagtgttaaaagcccaacagtataaatgtcgattcttctaaaaatataagtagttgttatcttttgatttcattatacctttactattctatttaaatttgttcggtttcagtcacaccataaaattaactttttaaataagattttatttcggtatcaacataaacactttatagcgatctgaaaaaagagtaagattctgattcccttaaacttttattcctgataagagaattctttatttttaaaattaaacattgaaaaatttttatcattgtactaaaattaggtgtggttaatatattatttaaccatactatttcaatggaaaggtttatagttcaatgaatctacaaaaaaatgataaaacaaatagttttatccattatgcaaacggtccttccctagaagaaataaatgggacaattgaagttcctaaagatttgagcttttttaaaactttactagcttattctggaccgggtgcacttgttgctgttggttatatggatcctggaaattggtccacttccataactggcggtcaaaattttcaatatttactaatttcaattatcttaatgtctagtttaattgctatgctacttcaatacatgtcagctaagctaggtattgttactcagatggatcttgctcaagctatccgagcaaggaccagtaaacagttgggaattgtcttatggattctcactgagcttgctataatggcaacagatattgctgaagttattggtggggctattgcactttatttactgtttcatattccacttgcgattgctgttttcattacagtatttgatgtattactcttattattgttgacaaaaataggatttcgaaaaattgaagctctagtagttgctttaatattggttattttcttagtttttgcatatcaagtggctctttctcatcctatatggacggatatttttaaaggtttagtacctacatctgaagctttctcaacctctcatacagtaaatggacaaacaccactttcaggtgccttaggcattattggggcaactgttatgccacataatctttatctacattcttcagttgttcaaagtcgaaaactagatcataataacaaaaaagatatcgctagagcaattaggttttcaacttttgattcaaatattcaattaacagtagccttttttgttaattcactattactcattatgggcgttgctgttttcaaaacaggaagtgttactgatccatcattctttggtctatttaaagcactatctaattctactattatgagtaattctattttagctcatatagcaagttcaggtattttatcacttttatttgcaatagctttattagcatctggacagaattcaactattactggaacattaacaggtcaaattattatggaaggatttattcatatgaaagttccaatttggttccgtcgtatcattactcgcctaatttctgttattcctgtaatgatttgtgtcttagtaactagtggtagaagtactgttgaagaacatatagctattaataacttaatgaataactctcaagtcttcttagcatttgcattaccattctcaatgttacctctactaatatttactaatagtaaagttgaaatggatgatgattttaaaaatacttggataattaagattcttggttggctttcagttataggattaatttatctcaatatgaagggattgccaaatcaaattgaaggtttttggggagataacccaactcatcaacaaattattcttgcgcatcaaatagctcatatcatcattattagtgtaatactaactttaatatggactattgttgaattgtataaaggaaataaaaaatacagtacgatgcaacaaagtgcaacttaatttagtaaactaggtagcctcaagtaaagataaaagtagtagaataattctactacttttattgatattattttttaagaagtcaattataacattgaaaagaactcaacataaggagttgctatctattttgataatattattgatatgtataaaaaatcttgttgtaacctaaaatatttagagatcattagatacagccttagtggctggtgctaactggactcagaatttattcttagagataaaaatgtatgtacatattcccatattctagataacttatactaaaaaatttttattctagaatataaaaattactttaatcttttttaaaacccaaaatgacaaatcccttgattttactagatatttttatttagaaattaaatttaaattactttaattactaatagggacatctaactcaacaaaaaaagccctagggatggggcttttagtgttccttgaagtggattcgttgcgattttaaatgaaatttttgataacctcaaattcctctttttaatgcaaagttatttataaaggctagcttatcataggaggttacattccatttaataaccatcttctatttgataagcacactatcaaaaaactaattacactaaggcatatcatataaggaacaattataaaaaagtcggttaaatcaatagtcatcggatgtgagaaaagtttccctattattttatagagagaatttgaagcatcaaaaatagcagatactttaaaaattcctccaattgccactaaaataatggatgtaatccaataaaaaatagtaactccaatagaaactagcatattagaaaacaggatactaatagttgagacgactagtagatactgtagaacaacgagtgaaaataagattgtagttgttaaaaaataaaatagtgaatatccccaaagcaatgaagctaatatattgcaaactattatagcaataaaaaattctgaaaataatactaacagtttagtataaaagtatttagttagatgataccctgaaaaatagtgatataaaatacatttgtcagagtaatctttattaaagaaatatacaatgacaaagccgaatattaaaaatccaaattgggtaaatactgtgtaggtactaaagtaaaattctcccaaagttaaatgtcttattttatctatccctactggtaaaatatatcctaatacataggtcaaagctacagtagatataatataaaataatgttctacctcttatagactttctaaactccaatcctaacattttttattctcctaaataccaactaatagcatcatctaatgtgtctactttacaaattttttgattatcaattagaaaatagtttccctttaaagacctgatattattgatatcatgtgaaatattaataataattttttcgggataatactgaatatagttttgcaaaaatacgtttatctcatcaacagactttttatctaaagcattagtaatttcatcaagtataataatatgcttgtctaaagacaacaaaactaataatttcaccttttgtttctgcccatcacttaattgctttaacttaaccgttttacttatttgattaatattcaataactgataaatttctttagaaagcttccacggaattgtcctttctaaatcgttaatggtaacatcactaggaagattagaataactcgaaataatcagcgtgtcttcataaatatcatttgaaaaataattccctctatttatgataaaatctttagctagttgagatttacctgatccattcctacctaaaagatgatttatttccccttcttcaaagtctaagttagtattctctaaaagtattctatttcctatttttaaggtgtaattattaataaacatagctactccaatttacttatttcagacagcaacctatccataaagattaaactctaattaatgggctgaaccagcaacccatctattttttgaatttcttacaaaataccataaatcgtttacattgtctaatttatttttcttagttagaacttttgcaaagctcatatcatttagaattggttttacttctctctgaatatttttatttcaatagtcaaattactttatataacaactaaaaatatatttaaaaataaatttttggagatttttttaattttgaaaatcaactaagattaatatattcatcttttatgtaatattcaaatacatttgagtactctaaaaaaggtatatcttgtatttcttcaataacttatttttgttctagatttgttctagaaaatttatctttctttattaatttttataaacaaaaagtgataaattccttgatattacttgttttctttttttatacattaactttaaatacatatagttactttgtaggggcattaaactacataagaaaaagcctttatttaaaggcttttttgcttgacagaagaggatttgtcccatcatttgtccccaaaattatttattatttttcttgaaaatctttatgaatggtaattgagtttagacaatcacagcctattatcctttacacaataatattagttgaaattttgatatgaatttgacaaaaagatattcataaatttcattgctgattggtattctccttggttcagattaagtttcctattaatagaaatatatttcgccatttgatttgtttcatccaataaaaatcgcaaattagcctcaatgtcttttaaagatttatttgaaaaaattttcaatagttgatctttatctgtaatatattgcaagatatccttgtcgagctttccaaaagataatgaatcaagctctttttctattaatattttttgttttagaagtttaataaaagcatttttaataggattagatatcataaactctgaataaataatatcatttcttgctatccccttgactacataagtactaacccaatatatttcattaagaattttgttgatttcatcttctgacaattgctttgtttcgtacagagaacttctttcaaaattataatcaagatatttattctttttatctaaaagtacttttgaaaaagcatcatctaaataatcctccaagaattctggtttaataagtcttaaatcaatcctcgtcagatcttgaaactgcattaagtaagcaaagcaattgtattccgtcttatttctaaactcatttggtttctgcattataagaatatcaccgaattttttatgataattagtgtcagaaataatatcttctataaaattagtaacaaaaacaatatcataatcttgaaaatcatctttcggtacatttgggttagcccgagatccattcaatagtacagcttcgattctcttatcttggtttgctatgtttaacaccaaattatatatttcttgctcatctctcataatggctacctcctacttcactttatattaccatgttttttctaatacctttatattacccttgtatttttctctaagcatgtaatcatagacttaaattagcatggacatacctttacgacctccaaggattcaattttaaatttttcttaacaactgattatgattccaaatattttcaaccgtttaatgttagtatgtcatcagttatcatcactctttttatgatagttaagatttttaaactatcatcttttgaaaaacatttcatcttgactatttctgttaataaatcagctccatgagcaaaggcatgtatccatccaagctcctcgtcaaagcctctaaaatcaggttcatctataagccaggagaatgcctgattcataatttttatctgatcttcttcagatatccaacttttattatttgagtcctccaataataaagctagtaatagagcagtaaaagatctgtttaacacagtattactgttgggtactcctaatccttgtaaaagaaatttatcccttaaaactctctgaaggacatttaatttctggctttgcatcagtttatgttctattactaatttaacccaagacccatatactatttcatctcgaactcttgggttccaatctcctatatgatgtaatcaaaaagataaaacatcctcatcaattggataattattttctatctttttgattacatcacttgcttccatgtttctccttgcatgactttatattttatattttccaaagtgtaacatttgagttttcgttttcactttaaaatgattatagtaactttaattttttacttggatactcacttttatatcagaaatttttagtacttattctttgactctaggaataaagcgaaggcctaccttgtaacctctattaggaaaaaattgaggcatactataaatatacgatagaactaaaattaccagagaatatagaaagtataaaaatctaaaatacttctgctttaatttataatttccttgggttttacagctcgtgtaatatagtatattccagaaattaaaaagtaaaacataggtaatattcttaataaggcaaatggtgtttcaaataagaatgctaaccaaaatattttcccttgcatttcccatagaccttgcgtcagataccaactttttggatcaaatatggtgatagaagttgttcttatcaagagaaagaaataaaataaagagaaaaacgcatgctcacaagtatatttataataactcatagccatcgctgattttgattcttgatcagaaaaaatctctgaactggtttcaggctttattttttgaaaataatgcagccctccccaacgactaccgctaatatgcttccatccactgtcctcaaataaagtgatatagttagcatagtcatctttcgacatgtattttttaaaatccatttttattgacatcttgtctttttctttatctctcttaaaataatagaaggctggaagaaatgagttaatgcctgtaaaagcatagccacttttttgaaccttatcgatccattcttcctctttttctgtggatttaaaaaataatttaaactttatcataactatctcccccaaaacccaactgattagcagtattaagtaactttcttaatcgattcgtttcaagttctactatttcttttcctgtctcagtaataatataaacttttcttcttctatcgtcacttgggatagactttatccatttttgtttaagtaaattttcaatggcaccgtacattgtccctgcggctattctaacatcaccgccactcatttcttcaactttttgcataatagcatagccatgtgcttcctcaaacaaagctaataagatataataggtagtttctgttaacggtaaatgtttattccttttcatcaattttctttctatacagttaaactttatatagttattctatacaatacaactatataagtcaactgtatatttaaacttattaaaaagaaaagaacagatagcctatccaattattcgtttggagttttttattttagtcgtaacttctcaaaagtactatagttttttataatctattgactatagtactgttgtttattcatctcatcctgatcttaatacctttaattatgacttcttatccaatctatacagttaaaatacctcctcataaacacaatagtttttaaaattaataatagagactagagttcatcactctggcctctattattttttattcaatttatatccattgatttatttcttatgatattacttgaataagctaccataaccaatgataacagtaatcctaaaaatttctttttctatattctacaaccacttttccaatgtattatctaaaataatcgttatttgggtttattcatctgtttgactagtttttttcacaattaatcaagaagttttacatatatccttgaatctctatctggaaaaatgtagtctacatctagttcatctcttgttatttgcttaaatccttgattttcataaaagaagtgagatcttttctctttttctggagtatccaagacaattcttgtgaatttactagctcgagcaaaaagcataaatctttcaaataattttcgaccaagtcgaacaggatttcctctatattttggatatgtaaaaaatttttttagaacagctgttttatcatcaatacgcagtaacgcaatcgaaccaactactttttcattttctaaggcaatccaaaattgaccttttctgttttgataataattttctatttgaaaaatatcgtcttgttcagccatctttatatcaagtttagcttctatattctgacaataattaattaaatctactagctgtgctaaatggtacggattattctcgtattctttaatttccataatatatttccttattttgactttaaagtatatttctgcaatgaggtatgcataggatatcatattagttggaaatattgatctagataagtcaaatagcagcaaagctcttaattcggttttattttttcaaaaagtagctatcgccttattgatatcttatcaaaattaaacttcacttttttcaaaaatgtacatgctaagtaataacgtcattataataagcaaaaacactaatatgctcggttccattaagtcttgaactttaaactttccacttaatatttctccttgtttttggataagaagcataggattatagcttttactgattttaaaaaatccagatactacacataacaccaccataaaaagacaacctaacaaaccccctaaagttttacgaaaaagaactgaaaaaaagagtattaagcttatgaaaagaataccgataaaccatgttgcaccgtaaaccattaatttatgacttccttcgttactaaagtaatataacgtataactaaaatggatgacaacacttaataagtatgacactgtccatagaagggtaattactataaatttagcaaggattataacttttttggctaatcccttcgtaactagattaattaaggttccttttgaaaattcttgcgtcagtgtactactaaataaaaatactaaaataactaaaccaagctgattcatatttttaaaatactgaatataagaatcaatataggtaggctctggtatcgctccctgtagttttttaggtaaaattcctgccataatatcaggcatcataagtgcagttaagggacctaatataccaaatattgaacaagtaatcagaatagatataactttgtatgtcctaacattctccatccattctttttttaacattactgctaaagatttcatttggtaacctccaaataaagctcctctaaactattgtcaatgacttcaatagctgatgggctaatctttaaagaaactaaatcttggtaaaaaccagctagtaaatctgctttgttatccattttagagcctttgagagtcagtgcatactcattatctttcttttctatctgatagttatgagatagtaccttagcttcagactttgtcacttttattaaaatacgaaccgaataattttcctctgatttttttccttttaactcttcaagagaataaatcccacacttagttaacaccagaacatgatcacatattttttcgacatcagagagaatatgggtagaaaaaatcacagttttttctcctctaagatttgaaataatatctaaaatatcttggcgacctttcgggtctaatgcagaggttggttcatcgcaaataataattttaggatcatgaaccagtgcttgggctaatccaagacgctgtttcattcctcgagaataagtagcaatcttttggtgattatcgtcaagtccaactgacctaagtagttctttgttagaaagcttatgctttgatctcgctaaaccagaacataaatcaagatattctagagctgtcatataatcgtagtactcgggaacatctgggagatagccaatcagttgattggtatctgttcttccaaaattaacttttttaccaaaaattgttatgaaacccgtatcaaattttaacaatcctaaaatcatttttattgtcgttgttttacctgctccatttggtcctacgaatccataaatcatattttcttctaaatcaaaagaaacattatttaatatttttttaggaccaaaagattttgtaacgttttgaaatgagatagctttcattcattattcccttccaaaataagaaatgcaattggcccaattatattaagaaatataatgaccaaaaaccaaactggctttgaaaggtgtttagtcatcttaagtttacttagtttgactagagaaatgataattaaagctccttgcaacataatcaacggaactaggaatggtaataattgatttggtatttctgtattcatattagtaatccttttttaaatcgttaagtttttgaatcatttgttgaaattctttatgccctgatagttctttaaattgtgaattttgaaataagtcctcaactcgttctattacctgtaattgactcgtcggtggtgcaataccagtaggtattgtctctaaccaatcatcgatggtataaaagaaagtatcaccgtgtaattcaaatctttggagcaattgttttaaagatttaaaacattgttttaagtatcctaatgccttatcatcatcacttttactataatgacaagctaaactataataacacttgatgactgtgttgggatgcaaagagtttaattgaaacgcttctatcatatgttcaagcctttcaaaaatatcgcctttgttttcttcaacttcaaaagttgataaactcaatagatactcgcatacaagtagaatctgctgataaatttcaacctgtaatacttgcttagctcggtaaacatcgacttttgcaaaaaagctattagctaaaagtaattcttcacctaatttatagggactattctggtaaaggtttatcacttcatcatattcaaggttgtgaaaaagaacgaccgttttgaacattatcgccgtctggaggtcagactcaactactgttttactaataattttatttagtgtacttagtgaccactctttcatttctgaatcattaaggttggttaggttgctcaagaccatattaatcattatcaacagagtcttaaaatcgttagggaactgttttgataattccttaacttcctgaaagaaatctctctcagacaatacatttgcttttatttttagatccttaatgagctgatttctttgatcatctgacaatgttttttgataaccgactaagtcatccaagctaatatcaaaaagattagccatcaaaataagatagtcaatatccggtttagcttgattattttcccactttgaaattgtagtttttgttaaatgcagataatcactcaaattctcttgcgtcataccaatctgagtacgttgtaaatagatattctctccaagcatcggtcaatctactttcacgtccattatagagtttctaaatcaaaaataaaagttcctatcaggaaatataatataaaaaagtttccctagaagaaactttttcgttgattaataagtggcaaaacagcattaataataacaatggttaaataaaaattaacttcactaatatttgtcattgaaaaataatgaattataaaagagcccttaagaaaggctcttttataattcattggtaactactatttttattgtaactctttcaaagatacaatagcagacaaaccataatatgacgatgctcctagtaacaacgaccctaaaatatccgttaaaaaatgattttctaaatagagtcttgaaaaaataactgatgcaaggatcactaatgcaaatattacgaaaactacttgtgacaatactcttctcaatctctgtctcgcaaccactaaaacaagaatcattaataaaaacgctgatatcgtatgtccactgggaaaactataacccgaatcaaaaacaagttgattcataggtctatgacgtgcgatgatatcttttaaaagcaatgccaaagcattggtaccaaaaaataacataaatagccacacagctattctttggtttaaaaaatattgatacccaaggataacaagtgctattaatgacgttgtcaaagggctgacaactgttgatattatcgtcattaagttagttaaatcgggatttcgtatgctttgaaaaaaagctgaagtgatattatccaaataacttatcatatcactttgagatttaactgctaatgttaacactaaaaaagaaacaagtagtataacacactggaaaaaggatttcttgttcactacataacctcactttaataaagagataaatcttcatacattatggtttaaaatatttaaaaaatgcttaaagtacgcgctaaccttttaggtttaaatatgactattcacaaactagaagaaataccaaatacgaacttttcctattaattagcgttcaaattttcattaataaagcaatattgctacaatatacttgaaacggagggaataatggatattacagattatcaaaaatgggtgagtgaattctataaaaaaagaaactggtatcaatacaattcttttattagaagtaactttctttcagaagaagtcggcgaattggctcaagccattcgcaaatatgaaattggacgtgacagacctgacgaaaccgaacaaactgatttggaaaacttaaatgatataaaagaagaactaggagatgtcttagataatatcttcatacttgctgatcagtataatatctcactagaagagattatcagcgcacatcgcactaattagaaaagaggtttgaaacatgagaataactattttttgtggagcaagtactggggaaaatcctgtttatagtgaaaaaacagttgccttagcacaatggatggcacaaaacaaacattctctggtgtatggtggaggaaaagttggcttaatgggagtcatggctgatactgtgattgcaaatggtggctacactactggtgttattccgacatttttaagagatcgtgaaattgcacatgaaaatttatcagagcttatcatagtaaataatatgcctgaacgtaaggcaaaaatgatgctacttggagatgcctttatcgctctacctggtggacctggtacccttgaagaaatttccgaagttatctcttggtctcgcatcggtcaaaatgataatccttgcattttatataatgttaatggctactttaatgatttaaaaaatatgtttgatcatatggttggtgagggttttcttagtctggaagatagagaaaatgtcctattctcagatgatattactgaaatcgaagattttataacgaattataaagtccctagcacgcgccaatactagattgataaaaaaaggaagtttctaattgaaatttccttcttttttcgaagcgattacccttggttcatttttctttcagctggtcaagcccatcctctcaatatccaaactcatcctttctgctcgagaacttataaatttttaggtaatctttagagaagccaaaactatagtcttgtctatgtattttatcttattagaagtatccaagtgctcgtccctattgactaatgacttagaaacctatacattatacattataatatttctttgtcgttaccgttattaataaggaggtaatcaattgaatcaagaaaaaaagagacttaacctaatcgggctgatacttttagctcaggctattgttttaagtttggcgactacactatttgctgaaatcttacaaaatgatgtctggataggtatagcaagtactttaatcgccttactcattccttgtttttttatgggttttaaaaatttaaaaaaacatctaacggcaacccatcatacaatcactttcaccactattttattcttgttaagcattatatatactactaataatatagtctccacaatatgggatgttgtgctaaatcatctcaatattatggaatcggaaagtcaaaattatgatgccacattcaatatacttatgattagttattctgttgttgtaggtcctttttttgaagaagttttataccgaggaatagtattgaatttattatccaagtatggtaaatggtttgccattatcacttctggcatcctatttggtttaatgcaccaagacatttctcagctattgactacatctattgcgggtatcataatgggttttatcgcttaccattattcctttaaggtagccctactccttcatatctgcaataactttatcgtagaaattttcacccagctatcaacagtaaacgagttatacgggacttattttgaaaatatattgctaattttagcaatcttatttatattatattacctttttactcataggaatactgctcgccgtcgtataagtctgcactctaacgttcgagaggctgactcaataaactctaaacaacatacaaaattattacttactagttggccttttattctccttgtcatttacgacattgtcctaacaactattaattaagaccaagccacaagacacaaaaagtatggttttgaaaaggataatcatcctccttttcaaaacacatacttttctttatgtttactaaaaggtcattaatagtgagataatgtcaatttttttattatcaaatatggtagactacacaggacatatttacacttctagatttcctctccacgcttctgtgccgccatctacattgattactttgtagcctttcaactcaagaaattggcatgctctaatagatcttccccctcgttgacaaacaagataatattccttatttttatctaactgttcaaacttatgactgagttgactcaaaggaagatttatcgcacctgaaatatgccccccacgatactcatgctcttcacgaacgtctatcaaatggatattattatgctgggcaatcaatgtttctaatgctacaacagttatctttttagtcataatctttatttcctttgatacttggcaaatttagtcaaatgactaatcactttattatttaaaatggtgacatcgttctactattatgactattatcgtaaaccttttaatcataaaaaccatggtagtacaaaatcacgaagtcgacagcatcacacgaaaaatacaaatattattttaatgctgtttgaagtgctgcttgtaatgttacaatctcttgatcaacttgttgtaccgtaacatttggattcaactgaactccaacagcatgtgtgattgctttatttaaagtattgtaaactttaaattctttgacgttaagtacttttttatctctagtaaagcgtgtattccagatttccttatcaagttttgattttgtatagattgtagctctatcagttggttttaaatcaggataagttaaaaccttttgttctaatgcctttacatcgttaacttgagctttaattgaatcaactgaagcaaatggatctaaaatgcgaataaccagcttagttatcccaaatcccatatcaatatttgcttgactaaccttatttgctaaatgttgagttgaaaaagtgattgcttcaatcacatctgttaaggcttctacacgactaccaatagaattcaaatcataaactgtctcagggttggcacgcaatgaagtctttaatttttcaacactagtaatagcctcattaaccgttttttcataatctgttccctgaacattatctttgatatttctcaactgaatgctatcttgatcaagcttttgagccatttgctgggcttgattattactgtttacatgatttaccacttgtggagttgtcacttgatcagcatgtacttctaatacagctggtgaaaataacaatgcaccagccactagagttccagatagatacatcatatgtttaacgttcataatgaatttcctcctttaaactaaaatcacttttactgcagtatttttaatttacagggcccatgtttgtatcttactacttgtccaaaaggtcgtcaagcgctttcttttcccctatattttacattattacaaataaactgcatttttttcataaaactaatattatcattttgctataatatacttgcgcctatccttttgttaatttctgataatttaatttatattttcatgtaaaaaaccataacgataatttaccaccttatataaatctaaatattttagaaaatttctacttatcactatttttatcaaatagattagcctaatgtttttcttaaaaaataaatttaataagaagcgtactattttagataaaatcgttccattatgcccaaaaaccatactaaaactcattatttttactttctgtttagaaattcatactagaccaagtattttagacacttaaaaagccttaaacataataagttcaagactttttattacttagtattttaaactgtgagtttgtttggcagttccctccgatgatttttaccccaattttttgaaccaaaagttaacaatatcgtcagccatagtattgatatctagattacatttactggtaactatgttaccatgtgtatggataacttatatcaaaaatatattaatctaaaaaagtgaataacccttataaaataagtaaatcctaagtacagcattaacttcaagtaaacaatttaacggaggtagtatatgaaaatagcaataatcggatatagtgggtcgggtaagtccactttagcaagaaaattgggaaattactataattgcaatgtattacatcttgatagtattcacttcgccccaaattgggaagagagaaaatatgatgacatgattgacgatgtcagcaacatgttagaaaaaagaacatggattatagaaggtaactacaaaaaactgctatatcaagaacgtctagcagatgcagatgagattattttttttgactttaatcgcttcaactgcttgtggagagcattcaaacgttactgtaagtttcgtggtaagactagacctgatatggccaatggatgcccggaaaaattagattttgaatttatcagttggattcttaaagacggtcgctctgacaaacaaaaatcaaactataaacaagttgttgaggactaccctcaaaaaataaagattctaaaacaccaacgcgatcttgatcaatacctaaaagaactccctgttgcatccaatacagaccctctcaagagcttgtaattattatactgacagtatttactcgtatatctcgctttaccttttctattcttattcttgaaaattaaattgtttttcatgttccaattttctgaatattctgctataatatgataatcacttggtcaagagacaaaaaactattcacttttagaaaatagctgtctctaatcgacctttggaatagaggaggacactgaatgacaacaaatgtaatggcaaattatagctacggagaagattgcttcaaagaaattcctagcgttttggcaacttaccgtattcaaagcattgctttcgtcggtggcaaacgtgccctagacagctcagaagccgaggttcgctctattttagaggaagcaaatattaaagtcacaggaagctttgtctatggaacggattcaacacaatctaacattgacaagttagtagccaacccacaagttcaagccgctgatgctatcttaggttttggcggtggaaaagctttagacacagctaaaatggtagcaaaagagttaggtaaaaatagctttactatcccaactatttgttctaattgctccgcaggtactgccattgcagttgtatataatgatgaccattctttcttaagatacggctatcccgagtctccacttcatatttttatcaatacacggattattgcacaggcaccaagcaaatatttttgggctggtattggggacggtatttcaaaagcccctgaagtagaacgtgctaccttagaggctaagaccaataaactaccacatactgcagtgttaggacaagcagtcgctctgtcttcaaaggaagctttttatcaatttggtgaacaaggtctaaaagatgttgaagctaatttagcttcgcgtgcagttgaagaaattgcgcttgatatcttaatctcaactggctatgcttctaatttagttaatcaacctgatttctactacaattcttgtcacgcgcatgcattttactatggtacaaccgctattcaaagacaaggtgaattcttacatggcgttgtagttgcgtttggtgtgttagttttacatgcttatttcaacgaactagaagaacttgaaaaagtagctcgttttaataagtcactaggtttgccaacaactctagctgacgtctctttatcagaaaaagatattccaaaaattgttgaaattgcaatgactactaatgaatacaaaaatacccctttcgatcccaaaatgtttgctcaagctattttagcagcagacgctttcggacagacactagcctaataattcaccaactcgattattccgatacaaaaatcccttagacacatcatctaaggggtttttgttattaataaagtaaaaatactgctctccattataggaagttgcagtattaatttaaattcttagtattgtatcagtatttttaaataactgctaaaagattatttttgtagttgtttcaattgtgctaactgatttcccaatgatactagcatttctgtctgtaacttttgaatctctaacaattcaaactgatcttgttgtaccatatgatcaatcttttcgtgcaataatctaatttctaactcagaggttttattgacattaaagtcatttcgagcttgcaaacgatcataatcagcagcacgattttgactcatcataataagtggtgcttggattgcagcaatcgttgataaagctaagtttaacaggataaatgggtaaggatcaaattgaataccaaaaggcttcatgatattaaccaacatccaaatagccataatggatacaaaaacgataataaaagtccaagatccgccaaaacgtgcaacatcatcagcaattcgttgaccgatagttgcttgcttgttcaaacgctcttcaacgttgaagggcttctcttcttctttcatcaaggtagtcacattatattttatcttctcatttttctgattcgctcgctgaacaatttcgtcaagataattcatacaataatgacttaaatttccatacgaaataaagtcactatccagagcaaaaggataacgtgctcttattaaacctttaatgcctaagtctaaatcggaaacaaataggccttctgcttcactataaactttttgatcaataaaatcgacacataccatttttatacctccctttctcaaccaagatttattcaatatttgaatacggtcaagctagccaacaggctataggcttttggtactatataagtgagtatttgatacacccctattaagctttacagcgttatttcgttagtctaaaaaaatcgctgacatccatattatgccttaattttatgctacccatcaaaataacgctttattctaagtctataaacttaaagaaaacttaaattaactaatttatcttagtatagaaggtggcttaaaaatctagtttaacctctgttttggtacgtaacttttattataataataaacgaccaactaaaaagtaagaaagttaagaggactttcttacttgctttttttgtatatagtcaattaactcaagagtcagatcatagcgtaaaaagggagtaatcaaatagataccattaaaatagttcaaggcttcatcaatcaaggacttactctcgtttaaggccaaagttaaacaagcttctttgtcgtcctttaccttttcaagagcagataaaaatgactcagaaagtttaataccaggaacttcattgtgtagaaaaacagcgttattataacttgttattggcataattccgataaaaaagggttgttcaactgttttagtaagatcagctaattcctttaacacagagtgatcaaatattggttgtgtcataaaataatcagcaccagaagctacttttttctcaatcaattttacggttcgagtaaggtttttcacattaggattaaaggcagcagcaactgtaaaatctgttggacgtctcaagctagcaccactataagataaaccttgattaagttgtttaatcagagaaaggagtttaaaggaagtcacatcataaacactagtcgctcctgggaaatcaccaagtttagtcggatctcctgttatggctaaaatatggttaaaacctaataattccatgcccaacagtctagactgtaaaccaattaaattatggtcacgacaagctatatgtagtaaaaagggtgtgctaatttcatctttaagcaagctagctatacttaaattacaaatacgtgtattagatagtgaattatctgctaaagtaattgctgcaatacctttttggtcaatcgctcgtatagccttttgaaactgaacgatatctaaatgctttggaggatctaattctgcgataattgttacttctttttttaccttatccactagagtatctgttcgtctgatacgcctaacaaaatcttttacaggtattataggagtaacaacctttcgttcaataggtttcaatcctctaatagatcgtttcacagctctaatatgatctggagttgtcccacaacaaccaccaataagcctaactccttctgctacgagaagttctgcagattttccaaaatactctgaattctgactaaactggtattgactattctcaccatctaaagataactgacttgcattaggataaactgacaaataagactgggcaaataaaggaacttgcttcaatgattggatcatatgatagggtccaaggtgacaatttaagccaatcacatctgcacctagcataactaattggctgagcgcctctacaataggctttccatttgatgttacccctgcttcatgaagagaaatattagtaataattggtagatcagtcatctccctcacaatttttaaaactgtcgttatctcctcaatatcataataagtttcaaacaataatccgtctagctgtcctgtcgccaataaagcctcaacttgttccaaagtttcttctacaatattatccaatgttaaatcgcattgtctttgagaacgaaaacctccaacagtacctaaaataaatgtttctttacccaaagtcgcttgatgagctatattaactgctgcttgattgatagagacaacctgatcttccaaaccgtagttctttaatcgatgacgttgagccccataggtattcgtctgaataacatctgcacccgcttcaatataagcttgatgaatggctagaaccttttctggatgtgttacattgtaggattcatgacaagtatctagcccataagtataaaggagagttcccattgcaccgtcagctactagaatatctgtttttaatttctctaaaaacttggacatcttctttactcctccctcatggcaatcctttactgattaacctattaattatctaattgctgacgaacctctttggtagctgaaacaagaacctccaaggcagcaattgtttctgcttcacggcgtgtttttaagccacaatcagggtttacccaaaattgctcttttgatagacattttagtgatcgttgaatattgacaataatttcttccttagtaggtatgcgaggggaatgaatatcataaacacccaggccaattcctagaggataaactgctgtttcaaaactttcaatgatgtccccatgacttctactcgtttcaatagaaataacatctgcatctagtgcacggatagaatcaataatttcgtcaaattttgaataacacatatgtgtatgaatttgtgtctcatctttcacagatgaagttgcaattttaaaggccgcaacagcatcatctaagtaagcctgttgcttttgctggcgtaagggtaaaccttctcgaagggctgcttcatccacttgtataatagcaatacctgattgttccaaaagttgaatctcatcttttatagccaaagcaatttgattaaaaagatcagatcggctaatatcatctcgctcaaatgaccagttcgttatagtaataggacctgtcaacatgcctttaacaggtttcttagtcaaactttgggcataaaccgtttcttcaaggcttaagggttgaatatgtttgacatcaccataaatgataggtggtttgaccgcccttgaaccataagactgtacccagcctaatttggttgtcgtaaaaccagctaacttttgaccaaaaaattcaaccatatcaacacgctcaaattcgccatgtactaacacatcaagatcaagatcttcttgaatagcaatccatcttctaatttcagtttttatgaaatctttataatctgagtcagatagatttcctcttttccaagcaaggcgtttcttcctaatttcaggtgattgaggaaaggatccaatagttgttgttggtaaaatcggtaactgtaatttttcagcttgcaaagcttggcgtaatttatacggacttcgttcaagctttacttctgctaatgattccaatgctacatgacgaaaatcagcagcttgaagagctgaaaaacgagataaagcttcgtgatatccctttgttttattaccatcaaaagcactagctaatagttctaattcctttagtttttcatcagcaaatgataagccattctttaacacagggtctaaatgtgtttcgtatttagtcgtcaccggtacatgtaaaagacttgaagaaggttgaagagtcaatcgtttaacaaagggacctatctcttccaataaagccaacgtttcttctaaatttactgcccagatatttcgaccattaacaattcctgcaaataattctttttcgcggaatagaccttgcttaacagcagctaaattttccgccctaccatgtataaaatcaaggccaaatcccgttactggcagcttagagagtttatctaaacagactgctgattcaaagtaggtttgaaagatgaagtgggcttgtggtacttctcttgcaaaaaaatcataaacagacttagctatatctactaaaagttcaccttcatcagttacaaatatcggctcatcaatctgaatataggtggcgcctgcatctatcagatcttgaaagacctgcttataaagtggtaataaccgctgaacagtcgcttcaaagtcgacaattcctgatgataaggaaacataggttattggaccagtgataaccggctttgctttatcaccaactacttccctagcttctagataaagatcaagtaagtaattattctgcaagtgaggtttagtctcaacctcccattctgggactatgtagtggtagttggtattaaaccactttttcatagatgatgcgacattatctttatcacctcttgcaatagcaaaataaaggtctaaattcctctcatactcatcgaaacgctttgggattacattgaattgaaatgacaaatccaaaacatgatcataacaagaaaaatcccccactggaataaggtcaatacctgcctctttttgtttctttaaatgattgatacgtaattgttttagttgtttttctaaatctttttgttcaagattccctgcccagaaagcttcgatcgcttgcttccattcgcgctgttcaccaagacgtggataccctaaatttgaaacttttaccataatttcctccatcaagttatagctaataactaacccttttagttttatgaattattttagtccatgaaaactataatatcaatagcttttaatattttatatttttagcgatttatatagttttaaactatataaaccactatggacctttttataaattttaaaacagcagcatgtagatatctttaaaaagcaatcttacaatcaactcatattatcaagatacagaaaaatctgttgatattattaacaattagtcaaactattacacatcggctatcaaaagttcctgtctagacaaaaacacaaaaaacgtatctagaaatagatgcgttttttgtgtttttattaatcttccattcctacacgttaaaatagtaatctcaataaagccatagtaacgataccagtaagaacagtgtaaaataaatttcgatatcgaatagtgacaactagagttggtatgccagccaataaatctaaccattttagtgttggcaattgtcctaatttaactgaaaaaaagctagagaatgttagggcaaataaaatagaaagaggaagaaattttaaaaatttcacaagactatttggtagccctttgtattttacaaatatgaatggagcgactcttggcacccaagaaacaacaaaacctaaaagaatagcaagaaaaacggtactatttatcatctaaaacaactcccacactacatccaacaacagtcgcaagcaatactgataaggctcctgacaaaaaagtagctaataagaagtaacttaaacctacagaagcaagaacatatacaacaagtcgctttccatcagataacatcccaaacaactgaaatacaaagagacctataaacatggcgactaatgcaaagtctaaaccaaacatttctggattaggaatagtactccccagtaaagttcctattatcgttgagattacccatgtcaaataactcatcacattattaccatgcatccaactaggcgatacaactttgtgatgtaatgcttctccaagtaaaacgccgtagctctcatctgttattagagttcctatggctaattgattcattaggtgagcagacttgaagatagtagtcgcgtgtaaactcattaacatatttctcaaattaactaaaaatactgtcatcgtaatagtcatcaagtctgcttttgctaataatagcgcacacatagcaaactgagcagatcccccatataccaaggcactcataagaccaacttctattgcagataaatctgatgctgaagcaactatcccaaacgccaagcctattgagatataccctaaagctgtgggcaaggcatctttcactccctctttaaatcctttttccatcatatccccctaaattttcagtatattcagttattatagcacaacggtgattactaagaaagaagaggaatgattatttatctttgccagcaattagactaataaatatcctgtaattattctataaacctttgatattgtagccatatagttggacaatattattattttcatagaatgatttttaaaaaatgctttaggtacggtcttaaatttaccacaaaataatttgtaatgaaaattcagaaaattgtagaaaattttgattttttatgttttaatagtttttgtaattattatgttacaagaaaaggagatttttatgaacacaaaacagcgtttttcaatccggaaatataagttaggtgccgtatctgtacttttgggaaccctattttttttaggtggtatcacaaatgtagctgctgattctgtcataaataagccatctgatattgcagttgaacagcaagtaaaagacagtccaacgagcatagcaaatgagacacctactaacaacacgtcatcagcccttgcgtcgacagctcaagacaatcttgttacaaaggctaataatagtccaacagaaacacaaccagtagctgagtctcactctcaagccaccgagacattttccccagtcgcaaatcaaccggttgaaagcactcaagaagtttctaaaactcctttaaccaaacaaaatttagcagtcaaatctacaccagctatttctaaagaaacccctcaaaacattgatagtaataaaattatcactgtccccaaagtatggaacacaggctacaaaggagagggaactgttgtagcaattattgactcaggactagatatcaatcacgatgctctccaattaaatgattcgacaaaagcaaaataccaaaacgaacagcaaatgaatgctgctaaagcaaaagctggtataaactatggaaaatggtataacaacaaagtaatctttggtcacaactatgttgatgtcaatacagagctaaaagaggtgaaaagcacttctcatggtatgcacgtaaccagtatcgcaacagctaatcctagcaagaaagatacaaatgaattaatctatggtgttgctcctgaagcacaagtaatgtttatgagagtcttctctgatgaaaaaagaggaactggaccagccctttatgttaaagctattgaagatgccgttaaactcggtgctgacagcattaatttaagtttaggtggagctaatgggtctttagttaatgccgatgaccgacttataaaagctttagagatggctagactcgctggcgtttctgttgttatagcagcaggtaacgacggtacatttgggagtggagcatcaaagccttctgctctttatcctgattatggtttagttggtagtccatcaacagctcgtgaggccatttctgtagcatcatataataatacaacactggttaataaagtcttcaacattatcggattagaaaacaacagaaatctcaacaacggattagctgcttatgcagatcctaaagttagtgataagacctttgaagtagggaaacaatatgattatgttttcgtaggaaaaggaaacgacaatgattataaggacaaaactttaaatggtaaaatcgccttaattgaacgtggagatattacttttacaaaaaaagtcgtcaatgctattaatcacggtgctgtgggagctattatctttaataacaaagctggggaagctaatctaacaatgagtttagatcctgaagcaagtgctattcctgctatttttacccaaaaagagtttggagatgttttagctaaaaacaactataaaattgtatttaacaatatcaaaaataaacaagccaaccctaatgcaggtgtcctatctgacttttcaagctgggggttaacagcagacggacaattaaaacctgacttatctgctcctggaggctctatttacgccgctatcaatgataatgaatatgatatgatgagtgggacaagtatggcttctccccatgtcgctggtgctactgctctagttaaacaatacttattgaaagaacatccagaacttaaaaaaggtgacattgaaagaactgtcaaataccttcttatgagtactgctaaagcacacctaaacaaagatacaggcgcttacacctcaccacgccaacaaggagcaggtattatcgatgtcgcagcagcagttcagacaggattatacctaactggtggggaaaacaactatggcagcgttacattaggaaatattaaagataaaatttcctttgatgttactgttcataatatcaataaagttgcaaaagatttacactatacaacctatttaaatactgatcaagttaaagatggctttgtcacattggctcctcaacaacttggtacatttacagggaaaacgatacggattgaaccagggcaaacccaaacgattacaattgatatagatgtttcgaaataccatgacatgttaaaaaaagtaatgccaaacggctatttcctagaaggctacgtacgttttacagaccctgttgatggtggggaagttcttagtattccttatgttggatttaagggagaattccaaaacttagaagttttagaaaaatccatttataagcttgttgctaacaaagaaaagggattttatttccaaccaaaacaaacaaacgaagttcctggttcagaagattatactgccttaatgactacaagttcagagcctatctactcaacagacggtactagtcctatccaattgaaagccttgggaagctataagtctatagatggaaaatggatcttacaactagatcaaaaaggccagcctcatctagccatttcacctaatgatgaccaaaatcaagatgccgttgcagtgaaaggtgttttcttacgtaatttcaataatttaagagccaaagtctatcgtgcagatgatgttaatttacaaaaaccactatgggtaagtgctccccaagcaggagataaaaattactacagcggaaatactgaaaatccaaaatctacatttttatatgacacagaatggaaaggaaccactactgatggtattcctttagaagatggaaaatacaaatacgttttaacttattactctgatgtccctggctctaagccacaacaaatggtgtttgatatcactttggatagacaagctcctacactaacaacagcaacttatgacaaagatagacgtatcttcaaagctcgtcctgcagtagaacacggggaatctggtatctttagagaacaagttttttacttaaaaaaagataaagatggtcattataatagcgtcttacgtcaacaaggagaagacggtatccttgttgaagataacaaagtatttatcaaacaagaaaaggatggtagctttattctacctaaagaggttaacgatttctctcatgtctactatactgttgaagattatgcaggcaatctagtatcagcaaaactcgaagatttgatcaatattggcaataaaaatggtttagtaaacgtcaaagtgtttagccctgagcttaacagtaatgtcgatattgatttctcttactctgtcaaagatgacaaaggtaatatcatcaaaaagcaacatcacgggaaagacctcaatttattgaaattgccttttggtacctatacgtttgatctattcttatacgatgaggaacgagcaaatctaatcagtcccaaaagtgtcactgtaactatttctgaaaaagatagccttaaagacgtcttatttaaagttaacttactcaagaaagcagccttactcgttgaatttgacaagcttttaccaaaaggagcaacagtccagttggttactaagacaaatactgttgttgatctaccaaaagcaacttattctcctactgactatggtaaaaacatacctgtaggagactatcgtttaaacgtaacgctgcctagtgggtatagcactttagagaacttagatgatttacttgtatccgtaaaagaagatcaggtaaacctaacaaaattgacgctgattaataaagctcctctgattaatgccctagcagaacaaactgatattattacccagcctgtgttttataatgctggaactcacttaaaaaataattacctagctaatcttgaaaaggcacaaactttaattaaaaatagagtggaacaaacaagtattgataatgctattgctgctttgagagaaagtcgccaagctcttaacggtaaagaaacagatacttctttactggcaaaagctattttagctgaaacagaaatcaagggaaactatcaatttgttaatgctagtccattaagccaatcaacttatatcaatcaagtccaattggcgaaaaaccttctacaaaaacctaacgtcactcaatcagaagtagacaaagccttagaaaatcttgatattgctaaaaatcaattaaatggtcatgaaactgattactctggtttacaccatatgataattaaagcaaacgttctgaaacaaacatcatctaaatatcagaacgccagtcaatttgctaaagaaaattataataaccttatcaagaaagcagaattgctgctttccaatagacaagctacacaagctcaagttgaagagttattaaaccaaataaaagcaaccgaacaagagcttgatggccgtgatagagtttcttccgcagagaattatagtcaatcactcaatgataatgactctctcaataccacacctatcaatccgccaaatcagccccaggcgttgatattcaaaaaaggcatgactaaagaaagtgaggttgctcagaagcgtgtcttaggggtgactagccaaaccgataatcaaaaggtaaagacaaacaagcttcctaaaacaggcgaaagcactcctaaaataacctatacaatattgctatttagtctctctatgctaggtctggcaacaatcaaactaaagtctatcaaaagagaataaaatactttaaaaaatagagcaaggcatcaattactagctattaatagttagtgactggtgcctttttgaggagcttaaaatgatgttcctaaagaccttttctctgcagtatcttggtttataacaccataacacttcaaagaatgggaaaaaaactctttttttgttatatttgatatgacataaacagctagctaaaagtcaaattataactatgggtattgaggtatacatgacaaaaataatttatttcgctgatgatgaaaagaatattcgtgacttggtggttccttttttagaacatgatggtttcactgttcgagcatttgaaactggagaccttctcttagaagcctataaaaaccaaaaacccgatttagttatattagacataatgatgcctggaactaatggtttagatgttatgaaaagcatccgccaatatgataatattcctattatcatgttaacagctagagattctgatgttgatttcattacggcttttaatttaggaactgacgattacttcaccaagcctttttcacctataaaacttagtctacatgttaaagcattgttcaaacgccttgatgaaaaagcaatcaaaaatgacactcagtatcagttcctagatttaactctggataccgaaaagcgaatagccctattatcaaatgaagaaatgcccttaaccaagacagaatttgattttcttttagtattaattgaaaaacctgaaactgctttttctagggaaacactgcttaatcgtatttggggatttgatgatattgaaagcagagcagttgatgacactattaaacgattacgtaaaaaatttaagcaataccacagtcaggttagtatcaaaactgtctggggttacggcttcaaattaatcaaagaggacaaatgaaaaagaaaagtttaattagcaatcttatccttattaatagcatcactctatttcttggtttttacctcatctatttttctgtcaactatgtcattaaagactatgtccatcaaatgacaaggaattccatgcaggcgaatttcaccattttagatagtatctataacaacaagaaaataccagatgaaaatatggttaaccaagatagcatctttgtttggtcttactatgctatttttgaccagcattatcgtatgaaatatggcactgataatcataaaaaagagagccatgatattattcgctatcttacccaaaaaagattgtggcaaatttctaaggaaaaagatggtatgtttgtaaccatcaagaaaaaaacctattatgtaatgaccaaagactactctggtatccttgttgatggtagcataaaaaaagttcctaaagcacagtcgcaactttttcatgtgattaacttttcagacattacttacacccagcatctaattactaaaattaatcattttcttatagttatcttagtactaacctatattcccatgctatttattatgaggaagactttcactggaattagagaatctattcaatcagtacaaacttatatttccagcctttggaaaaatcaaggcaatcatcaatctagtcaaaaagaaattgtcttttctgatttcgatcctcttctacttgagagccaagaaatggcaaatcgaatctaccaagcagaagagagccaaagaaacttctttcaaaatgcctcccacgagttacggacacctttaatgtccatccaaggatatactgagggagttcaagagggtattattgatgccgagctcgcacactctgttattctgcaagagagcaaaaaaatgaaacagctcgtagacgatattatcttactctctaaattagatagtaacttaagtgatcaaaaagatgaattttctttaaatgaattacttaatagtattattgcttatttcaaacccctagctaataaacaaaagattagtattacttatagaccagacaagcatgaaaagttactaaaaggtaacgaagagttgattcaacgagctatcaataatatccttagtaacgcactacgctatgctgtttctcatattgaaatctcttacacaaatcaaaaactaactatctcaaacgacggaccagccatttcaaaagaagacttgccttatattttcgatcgcttctataaaggacatggcggccaaacaggtattggacttgcaatgactaaagaaattatcaagcaacatcatggtaatatcatcgctgagagtgattcgacctcaacaacttttacgatttatttcaattgccacaaaattgcctaacttttcctacaaaaattcaaagaagttattgcttttttaacctataatacctatagatcaaaaagttattctaaaagaaagtgagtttttatatgttacattctaaaaaaatacattccttatcgcttattgccgttctctctttagcaacatatacgagtttacaaccaaatcatgtaacggctgaacaatcacaaaaaacatcaactgttcatatgagtcaaaaaactattgaacataagttaaaagttgcagataaagaagctgctcctctctacgctaaaatcgaccatatccaacgacatattgaagtcaaaaaagcaaaagatttaaaagttattgaattgtatattaacaaagatatcaaccaactagagaagcaaaataaacgtctactaactaaattctatacttctattgataatcaaacatgggatagcacaagtgaagtcaaaaaattgattgataagacaaacctatccactaacgaaaaagatagattaaaattatattttgaacaacgtgcttaccttgagacaaggttgaacgaccgctatcaaaaatttgataactctattgaaaaccaaaataaagaactaaaaatattaacgtcaaaaatagaaaaaatctatcaaaaacatggtattacaaaagaggtattaaaaacttactatgctaaaaaaacagtacgagctgactgatttagctaaaaatagaaaaatcccaaaagttaaacttttgggattttatacgcgtaaatatcactatttctagtaaaatctttatcttatttcaccacaatattaacgagtttgtttggtactgcgatgactttgatgatgtctttgcctgcgatttcggcttggactttttcgttagcaagagcaagatcttgcaattcttcgcgtgaaaggtctttagcaacgacgagtttagctttgaccttacctttgatttggacaacgatttcgatttcgttttcaaccaatttgctttcgtcatagcttggccatggcacgtaagagattgactgtcctgaggctgtcaagacttgccagagttcttcacctaagtgcggtgcgaatggtgcaatcaattgaacaaagcctttggcatagtcgctaaagagtttgtcttccttgttggctgcattgacaaagaccatgagttgagcgatagctgtgttgaatttcatttggtcaacttgctcagtaactgccttaacagtttcgttgtaaaccttgtcaagagctccgctattttcctcagtgatctctttagtcgtgatcaaacggtaaacacggtccaagaacttacgtgagccttcaagaccttcttcagaccaagcgattgaagcatcgagtggtcccatgaacatctcgtaaacacgaagggtgtcagcaccgtactgctcaacaacatcatctggattgacaacgttcttaagtgatttagacatcttagcaggtgcttgttcaagctcttcaccagtttccacatggaagaagctgccatcacgtttttcaaccttgtcagttgccacaagagcaccacggctgtcgcggtagcttgttcccaaaatcatcccttggttaaagagtttttggaatggctctttggtaggtacgacaccgagatcataaagaaccttgtgccagaagcgagcatagagaaggtgaagcacggcatgctctgcaccaccgacatagatatcaactggcaaccattgtttgaggagttcctcgtcagctagtttttcagtgttgtgtggatcgatgtagcggagatagtaccagcttgaacctgcccattgtggcatggtgttggtctcacgacgacctttaacgccatcttcacgagtgacttccaaccagtctgtcaagttagcaagtgggctctcaccagtacctgaaggacggatatccttagtaactggaagaactagtggcaattcgctctcaggaaccgcagttgatgttccatcttcccagtggatgattgggattggctcaccccagtaacgctgacggctgaagagccagtcacgaagacggtaagtaactttctcattaccaacaccttctgcttcaagccactcgaccattttggcaatagctgccgctttgtcgagaccatctaggaagtctgagttgatgtgaagaccgtcttctgtaaaggcagcctcttcaacattcccaccttcaagaactggaatgatgtctaggttgaattgttttgcgaattcccagtcacgttcatcgtgagctggaactgccatgatagcacctgtaccgtagctagcaaggacatagtccgcaatccaaactggaatttctttaccattaactgggttaatggcataggcacctgtccagacaccagttttttctttggcaaggtctgtacgagcaaggtctgatttgagactcgcttgacgtttgtattcggcaacggcttctgcttggtcagctgttgtaatagcatcaaccaaggcatgctcaggagcaagaactgcgtaagtcgcaccaaaaagggtgtcaggacgtgttgtaaagacagtgaagtccttatctgtatccttaaccttgaaggttacattagcaccagttgatttaccaatccagttgcgttgcatgtccttgattgactctggccagtcaacttcttccaagtcttccagcaagcgctctgcataggcagtgattttgagcatccattggcgcattggttttctgacaactgggtagccaccacgttctgatgtaccatctggaagaacctcttcgttggcgatagctgttcccaattcttcaacccagttaactggaacttcagcttcgtaagctagacctttttcataaagcttggtaaagatccactgtgtccacttgtagtagttagggtcagttgtgttaacttcacgatcccagtcgtatgagaaaccaagagcattaatctggcgtttgaagttagcgatgttttcagctgtaaactcagctgggtcattaccagtatccatagcgtactgctcagcaggaagtccaaaagcatcccaacccattgggtggaggacattgtgaccttgggcacgtttgaaacggctgagaatatccgttgctgtatagccttctgggtgaccaacgtggagaccagctccagatgggtatgggaacatatctagggcataaaacttaggttttgatgcgtctgttcctgttttaaaggtatgattatctgcccaaaaagcttgccatttgggttcgatttctttgtgattatagaatgtcatcgcacttctccatgtcaaaaaagtatagtcttcttattataacacgaaaaatagcaataaaaaaggtgaaaataccctcaacagcaggttctctccccacttatccttgacaataaactaaacttactctatactatttccaaatgacataatgctttaaccgtgtcctgtgagacatataagcgaccaaaataggattctatacagaaatcctactatttttgcgagcgtttatagaactcaagggtagcagcttgagttttttcttttacattataatgagttgaagcagctatgacatctctgttttagaattttttctattgacagtatttaataacggtggtctgtgagccatcattaaaggaggagacttatgtcaccattaaatatcaataagaataattggcgcgccctaatcgctgccattgtcgcatccggaaccgatgatttaaatatcatgttccttgcattttctatgtcaactatcattactgatcttcatttatctgcggcacaggctggttggattgggacaattaccaacttgggaatgctcgtgggaggactaatctttggtttattagctgatcgctacaataaatttaaagttttcaaatggacgattctaatcttttcaatcgcaactggtttagttttcttcactactaatttatcatatctctatatcatgcgcttcattgcaggaattggcgttggtggcgaatatggtatcgctattgccattatggcaggaattgtcccaactaataaaatgggccggatttcttcactaaatggtatcgctggtcaagttggatctattagctcagcactcttagcaggatggctagctccagcactcggttggcggggactttttctctttggccttctccctatagttctcgtcctatggatgcaatttgctgttgatgataaagatatcttagatcaatataatacagacgcagatgatgaacctctagatatcagtataaaagctttatttgatactcctgtattagccacacagagcctagcactaatggttatgacaactgttcagattgccggatactttggcatgatgaactggttaccaactattatccaaaccaacttaaacgtttctgtcaagaattcatcattatggatgattgcaaccattcttggaatgtgccttggcatgctagtatttggtcaattgttagataaatttggaccgcgtttagtatacgggtgtttccttctatcatctgcaatttgtgtctatctctttcaattcgcaacaacaatgccttctatgattataggcggggcagttgtcggattctttgttaatggtatgtttgcaggctatggtgccatgattacacgtctctatccacatcatattcgttcaacagctaacaatcttatcttaaatgttggtcgtgcaataggtggcttttcatctgttatcatcggaatgattctagacgtttcaaatgtctctatggtcatgcttttcttagcaagtctctatatcgttagttttttatcaatgctaagcattaagcaattaaaacgtcaaaaatatcacactaatttaacacaattagatgtcaaaccaactgactgatattacaaaacagtattcctcaattgagaaatactgttttctttatttcattagataactattcagctcaggcatcacacttttagcatctttcataccaagctgataaatactatcaagtttatccggattcttctctaagcggccaataaccaagctcttactcggtctaattgcaaatagatcgcctgttttttcaaggctcatgaccttttcaagactattattatactgttggtaccgattcgaggctgtctttacaaaattaggatatttcctatacagagttttatacaatcgtccacttgaaggctttttctgataattgagcggcctagtcatcacaacaatcaacttgtcaaatcctaaaccacgggcaaaatcaacgggaatactatcagataaaccaccatctaagtactttttcccctgccaatcaaccatctttgagactactggtaatgctgaactagcacgtaaaatttccatttgttcaaaaacactatcaattttaaaatattcaggtttaccagatgtcatctctgtagcaactacgtaaaaatcaatacttgattttttaaatgcttcatcgtcaaatacatccaatttcataggaacttcataataggtgaaatctttattaacaaaattccctgttcgaaaccatgaccttagactcatatatttagggtgggataaatactttttattgtatcgcaaagccctctctcgttgtctagatacaaaattaacaccaaacaatgcaccagcagagacagatacgataccatctatttttattcctgcatctagaaaagcatctaaaactccagcagtataaagacctctcattccgccaccctctaaaactaaaccaacagacaacataggcaatcactttctaatattgatatttgattaaagtatagcaaaatatagctgttttttctgaaaaagaatatgttgtactatataaactccataattaatttaataataatttctgaatcacactcacctatgatagaataatactaatagtttttaaatttatatttactatatctaactaatataaataaaggattttttatgacttatcaaaaaacagttgttttggctggtgattattcctacattagacaaattgaaaccacattaaaatctctctgtgtctatcatgagaatctctcaatttttatttttaatcaagatattcctcaagaatggtttttagctatgaaagatagggttggacaaactggaaatcaaattcaggatgtaaagctcttccatgatcacttatccccaaaatgggaaaataaaaagcttaatcatattaattatatgacctatgctcgttatttcatacctcagtacatctcagctgatacagttttatatcttgactctgacttagttgttactactaatttagataacctctttcaaatttcactagacaatgcatatttagctgcagttccagctctttttgggcttggatatgggtttaatgctggagtaatggtaattaacaaccaacgttggcgacaagaaaatatgactattaaattaattgaaaaaaatcaaaaggaaattgagaatgccaacgaaggggatcaaacaattcttaatcgcatgtttgaaaatcaggtaatttatttagatgatacctacaattttcaaattggttttgatatgggagctgctatcgatgggcataaatttatttttgacatcccaattaccccactcccaaaaattattcactacatttcgggaatcaaaccttggcaaacattatcaaatatgagactccgtgaggtatggtggcactataatttacttgaatggtcaagtatcatatctagtaaaaaagtatttggtttagaccacccaattaaaacacaaaattatcgtctcaatttccttattgttacaacttctgattgtataccatctatctcagaattagtcactgcccttccagattgtctatttcacattgcagcaccaacagttatgtctgacattcttataagcctattagcttttgaaaatatccgccttcataaaacttacactccacctattattgataaattattagcagaagctgatatttatcttgatattaatgtttttggaaaaatggagggcattctacagaaaatgtcacaatctgaaaaaccaattcttactacaagagaatgcaatagccagcttgttccagaaacagtttttgcatctatcgatgatttaattaattatcttcagtctatataaaaaaattggcatccattcactatatacccaacattattctaaacacttaactaggagaatttaaatggaaaaagcagttgcacttgcagttgattcaaactacttggataaagccttagtaacaataaagtctatttgtgtttataatagaaatataactttttatttattcaatcaagataccccagttgaatgggtacgtaatataaacaggaaactagagcctctaggatcaaaactgattaatgttaaaatatataactatgatattgctcatctaacgacttttctaactgttagtacatggtttagattatttttagcagattatatacctagttcacgtgtactttatttagattcagatattatcgttaacactaatcttgattacttatttgaactagattttaaaggttattacttagcagccgtcaaagatccccataaaaatgaagaaggagggtttaatgctggcatgcttttagctaatctagaactatggcgggaagatgggctcactaaaacattactaaaaacagctgaagaactccaccgagttgtcaaaacaggggatcaaagtatcttgaacattgtttgccataatcgttggttatctctgaacaaaacatggaactttcaaacttatgatgtcgttagccgctataatcatcgatcttatttatatctaaacatagaaaatagaactcctaatattatacattttttaactagtgacaaaccttggaatgaaaatagcgttgcaaggtttagagaactatggtggtattacttccaacttgatttttgccaattaaccggcaagcaaagaaaagtgatttcttacgaaaagtccatggaattgctttctgtttcagatattcatcttttcactcttacatcttccgataatttagaacacattgaatcgctaatttgtagatgtcctactgttcaattccatattggtgcctacacaacagtgtcaaataaacttagcaaactagaacaatatccaaatgtcctagtttaccctgaattaattgaggcaagaattgaaaaattaataacattagccactgcataccttgatattaatcatggtccagaagtaggtaatattttacaaagagttcatttgaaacaaaagccaatttattctttcaacaacacgtctcatcaagagaatataaccaaacatatcgttaatcataattctattgataatatggttgttttaattaacgaattaaacctaaatcaattataaattaacaaaaatccatctttattttaagatggatttttcagaagttttataattctgcaacttggtacaactcaagttctgcttgtgtttctgagccgaacatgttgatcattaatttaactttgttattctcaatctcaactacacgtccttcttgtccgatgaaagcaccatcaatgatttgaacaacatcaccttccttgatattagtatcaaagacatcaacggtttgtcccattgagatgagtattgaacgaatctcttcttctaacaacggtgttggtttagagcgattgccgtgtgatccaacaaatccagtaacgtttggagtattacgaacaacaaaccaggcttcatcagtcattaccatttccacaagtacataacccgggaagcgattttcttcaatttcttttgttttcccatttttctcaacatttacagtttgagtagggatttccacacgcaaaatgttgtctaacatattataagtttgcgcacgttgcaagagattttcctttactttattttcataacctgagtaggtttggagtacaaaccaacccttatcaaaagaatctaacataagttttcctttccttaataaaaaagccttttacggcttattggactgctattttcaatatatattataaagaaaataaaataagctgtcaattaaagtaccgactaaatcattctaaaattcaaataaaaaaggcaaagttctgatgaggtttgccttaagattttgaaaggatagacctttcggtttatgtttaaaaataaatttaattttttttatgctttaaaactatcgtaataagacctgcacttaacataacaattagtgatacaattgctaagagtggacttgcggcttcacccgttgatggtaattttttactatactttttgttttcaatagcttttttagccgccaagtttccgctagtattaaccgattttttggttgctggtttggcctctggtttagcttctagcttagcctctggtttagcttctgacttagcctctggtttagcttctggcttagcctctggtttaacgtctggtttagcttctggcttaacgtctggcttagcttctggtttggcctctggcttagcttctggcttagcttctggcttagcttctggtttggcctctggcttaacgtctggtttagcttctggcttaacgtctggtttaacgtctggcttatcctctggtttggcctctggcttaacgtctggtttaacgtctggtttaacgtctggcttagcttctggcttaacgtctggtttggcctttggtttaacgtctggcttagcttctggtttaacgtctggcttagcttctggtttaacgtctggcttagcttctggtttaacgtctggcttagcttctggcttaacgtctggtttggcctctggcttaacgtctggtttggcctctggtttggcttctggcttaacgtctggttttttatcttctttagtacctctggtaaggtcttgaagttcttttaaaagctttttgacttcatcaagcattttttttgcttcatcaagtccactttgaccagtccaaacactcctatttccgaaagtttgtttatctctaaacctattcaaataagttcccacagagtctgcataatatccaggtgtaggcaaaatacttttatgcttttcataaatttctttagcctttttagataacgctaatccttttgaacttattctttcaatttttttagcatactgcttttgtaagtttttctgggcaacttcctgtgctgcttgcttaatactatttaaagcattcattgcagcagtaatattgagcttaccttcattatactgtttcactacattatcaattgcagtattatatctcaacatttcatcgttagataaattttctaacttagcaatttcttgctttttaccattggcctgatttaccaacgtttctttattggaattaacaacttttttagcttctgctacaaactcatcaacttgactcttagtgctagctctttgaattttttctttatattcttctaagacttcggggcttatattttttattaaggccacgtcattttgagccatttgcttagcttttgttgattcagcattattcagttgcgtggcttgagttacaaatttaagaataagttgcgaatcttttgaagagctaatagatttaactaaaatatctttttggtctgatgaaaggaaacctaatgacttaatgatatcttgagaacgtcttgactgcttacctagttcttgatcactaactttagcatgtgtagttacacttggtttattttgcttaccaatttgtccttgatataaaatatttctaatttctgcttcagtactattaattaattgtggaagtgtatcctgtgatgctctattaaaatcatttactctacttaaaagtatagcaatagctttgtcattaccacgatatttagaaatcaaattcttcagagtaaccgcccctaaattaacttgtttcttatgaggaattgaagccgatattcctgaactagtatccgcgtgtacaataccactacatacagcaaacgctgctgacattgaggccaaaccataagctgtttttcttaaaaagtattttacttttttttcgttattattcatattcgctcctttatatagttagttgaaaatcctaatttattaggataggaccacgtttattttaatttaatttgagttccttaactaattatataacttggagttttttatttcaacacttttctttaatttatttacattttattaaaataaacatcttttttttaatgtttttttgctcaacaatctagtaaaaataatcaaaagattatttttttataatttaatcggatatatatgttattttccacacaaaaaacccttagtaaaatctaagggtttgggttgtttctatctaaaataatctattattaaaatcgattaatcaagtccatgactcctgcggctaacagtttgtcaaagatgtagataacgattgtgaaaaatacagtgtattccaagatggaaataaaatctttccaacgttgttttcgatttggccaagtagtgtcacgcaatacttgaaaaatccctttgacaaacattatcagttctcctttttgcagtttgttacgctatatcaacgcgtttctttgtgtattgtatacttcttacaatatttacaaaatttatttacttctagtcgtgttggcttgggggtgctacttactccgattgagtaatttcggcttccgcattctgtacacgctaggcttgctttcttttgtgccataacgcctccataagtgctattttaacatgatttgtataatcctgcaagctatctaaagtagtcctttagactattccaagcatcttttaccttctcttggaaatttgaatcttccaccgctctagaaatatcttgtgcagccttacttgccgaatcttttaaatcattaataattgagcgtgattcttggttcgttgtattactagcatcttgtgcattataaactgaaccaataccgttttggaaataagcattctcaatatgagtaaaactagaccccttagtatacggtagtatatatgaagcttgcgtgctaaatatatttgaagctgtacctgcactagaatctgtcaaataatggtgtttatctgtgttcttaaagccaacccattgactaataacgacatcaggcgtatagccgactacccactggtctccagataaattggggttaaaatctgtttcggttgttccagttttacctgccattgtataaccataaacattggcattaatagctgtaccatttgagaatgttcctaacatcatactagtcattttactagccactgagcgactaataactcgcttaggcttatctgtaaattgctttactaattttccattagctgtctcaattcgagtaatcaaatgagcgcgatgcattataccgtcatttgcaaaagttgagtaagcttgtgccatttctaaaggattagtggttacacttccacctagcgccactcctagctctttgtttgctgatgacatatttagaccaaacttcctgccataagtaaaggctttattgattcctagtttgtctaaagtataaacagcaggaatattataagaattagctagtgcttgatacatcgggatactttcagtctcaatcccaccatagttacttggtttataaccatgaaaatcttgaactttattaggaagttctttatctattgaccatcctgaagcaatagctggtgaataaacaactaaaggttttatggttgaggctggacttctctttgattgagtcgcgtagttaaaacttctaaactgtgcatctttagtactttgaacacgtccaactaaacctcttacaccaccagtttttggatctaaagctacgctagcaccttgggcagattgaccatcatagtcagatacagggaagaggctagtatcatcaaatgttttttgcattcctgattgataattttgatctaatgcagtgtaaatcttatagccattattgacaatatctttttctgaaataccataagtatcaatggcttcattgacaacagcatcaaaataggatgggtacctgtaatcattaattttaccagcataggtatctgctaatctatttttcataccaattgaagcagcttctttagcttgagacttggttagtttacctgcatcaaccatcgctgccaaaacagtatctcttcggttagttgcattttcaacagaataataaggattataaacttctggtcctttaagcattccagcaagtgtagcagcctcatctactgtcaaattagcagcactggttccaaaatatttcctactagcatcttccacaccccaaacaccattaccaaaataagagttattaagatacatggtcagaatctcagccttgctatatttcttagtcaattctagcgctaaaaagaattcacgcgccttgcgtttaatcgtttggtcctgtgacaagtaagcattttttgctaattgctgggtaatagttgagcctccgccaaatttcccaagtgtagctactgccaaaaaaaatcgcttaaagtttacaccattattttcataaaaagttctatcttcagttgctataacagcatttttgagatgatcagaaatagcatttaactctacataagttcccttttgtcccgaaagttttccagcatattctttattcttatcataaatggtggtggttgtttttagagcactctgtaaatcactaactgtagcagttttagaaagataaaaaagatagctaccaaatataagaataaaagccattaaggcgataaaaagcaacttcccaatacgatagcgccgccaaaaacgacggataggatttttaggagaagggaggtaacgatcaactttttgtagccattcaggtcgagatttagcattttccttttggtgacgaatgcctcgctgatactgggatttactaggtcgggtaatatcatcaatatcatagacttcttcgccatccaaattgctagtttcttctctagtttcttgttcattttttcttgtcatttcgtcgttgtcttcatcaacacgaaataagtctataaacttatcaaataatttcatagacttattatatcaattttcaataaaatgctataataaaaccatgtcattttcattaaaaattagaaatccatacggtgaacataccgttaaagaactccttgaagattattttttgattccacgtaagattagacattttttgcgtgttaaaaaacatgtacttataaacaatgaatttattaattggcaaactgtcgtccaagaaaacgatactattaccttaatctttgatgatgaggattaccctactaaaaaaattcctctgggcagagcagagcttattgattgtctttatgaggatgaacatcttattatcgttaataaacctgaaggtatgaaaactcacggtaaccaaccaaatgaaatagcactgttaaatcatgtatctgcctattctggacaaacatgctatgttgttcatcgcctagatatggagaccagtggagctgttttatttgctaaaaatccatttatacttccccttatcaatcaacgcttagaacgaaaagaaatttggcgtgaatattgggctttagttgaaggaaaattttcacctaagcatcaagttttgagagacaaaattggacggaaccgtcatgacagacgtaaacgaatcattgattctaaaaacggtcaacatgctatgacaatcattgacgttttgaagtatatccaaaatagtagtctcataaaatgccgactggaaaccggaagaacccatcaaattcgcgttcacttatctcatcatggacatcccttaataggagaccccctctacaacccttcttctaataatgaaaggttaatgctacacgctcaccgattgactctatctcatccattaacttgcgaaactattagcgtagaggccccttcatctactttcgagaagattttaaacaattataaaaaaggagttggataataattatccaactccttttaatcattattgcttagttaatggcttactgagtagtggtttatggtaatcaaattctccatcactagatgtctgccagatcactgggatgatcttattcccttcaatttttattccataggcgtatttaactttaagaccaccgatacctcctgttacaaaagttgtagtatcagtacctgattcatattgataaaggtagagcccatttcccttatcctccaacttcgtaactttagcagaatggttactttccttagatttactatccttgtaaacttttttctgagtaactttaccatccttatcaaaagtcatcgttactgtaccgtcctcaacttcacctttccaacttcctacaaggttctctggaaaaatggaaacgggatcagccttaactttattagtttccttagctactgtgatatcttttttaccatcattagaaataaggtaactatttcccgattttttcataataaaattaccagttaaattctgaataatgtggccatatgttttcttatcaggatctgttgatttatcataattaaaatcataatcggcagcaaaattaacttgataactttctttcccaacctgtgtcattttattaaggacaatattaggaatagtgaaatggctcgctttacgattatcagttacaaattttgctttaatactttctttcaatcctttgtaaaaatcattttcggcacctttttcaaaaactgttcctaaagtctgagggtcttgcccagttgatacataaagtatcaattgattgaaagcagttatcaatttctgtccagcttctttttcatttaataaaccatcaacatctaatttgattgtctgattatcagcgatagagattaatttttgtttatgagaggttatctcaccatcattaaaaacttttttgatataagcttttgaaccatcagtcactggataattctctacggaatggctaccatcttttaatttagcaatacgattatcaccaaaataaagattaccatccataagattacttgttactgtaaaagatttaaaagcgaccgataaatcaatagtttggtttttaccatcataatcttttttgagtttaatctcttttccgtcactagtcccttcaaggctagcagtataatgggttctaggtaaacgttccaccgttactgaaaaatgatctgaattgcttgtcgcgacctttttttgattcaacaaaacatccaatttaggaacattggttttcaaggtcaaagacataggcttattagcaatacgataatcagggaatatacctaagcgactacctacacgctttagatacattgaatcatttttgtttccttcttttatttcctgccctaatttacgcgcctcacttttagacaagggctcaaaattagcgtaattggcctcatcatttgtgatagattctcccgtatctgaccaaaccatgtattctttaatattatcaaacgcttgacctgacgtacgagaacgtgctgctacaaaacgactaagtacttgtccctttgaaaaataaaagaatcctagactcagaagtgatactaaaactataccaaaaataactaagcacactttaacaacttttttcttaaaaaaatcaaacataccttatcctctcattcactttatattaaagtaaattgcttaaagaaaagttacaacactgataaaacagctgtatttgtacttgtaaccgctatttttctattataacaaaacgaaaaaaggattgaaaccataatccgatttcaacctctaaaatttttgtctatgattatactaagtcctgcaagaagctttctccaatcatcgcagtatcaacaccaaagttatccgcaactgttgctgaaatatctgcgaaatgccctactgggataagtccgtttcctgtgaaggatgggctataggctaagagaggaatgtattctcttgtatggtctgtacctgcataagttgggtcattaccatgatcggcagtgatcaaaagtaagtctttgtcacgcattgctgaaatgatctctggaagacgctcatcaaactcatgaagacaatcacgataaccatgaggatcacgacggtgaccatagagagcatcaaagtcaaccaaattagtaaaggagaagcctttttcaaactctgataaccccattgtttttatcaaagtatcaataccatgactatttgatttgttatgtcccatatcatgattaatgcctgaaccattgaaaatatcattgattttaccaacagcataagtatcgatgccagcttgatctagtttatttaatacggtatcttcaaatggtgatactgcatagtcgtgacggttggctgtacgcgtaaagttacctggttcacctacatatggacgagcgataatacgaccaaggagagctggacgctccattgtgatactacgagcatattcacaaatccggtagagttcttctagagggatgatatcctcatgagctgcaatttgtaggactgggtcagctgaggtatagataatgagctcaccagtttccatttggcgtggtccaaagtcatcaataacagctgtccctgaataaggtttattcgcttcacgaataactttacgtcctgaaaaatcctcaatctttgtgataatatcttctggaaaaccattccagaaagtatcaaatggctctgtaatatttaagcccatgatctcccaatgccctgtcattgtatctttaccaagtgatacttcttgtaacttcgtcgcgtagccacttggattttcttctgcagggacggtcttaagcgcttggggacgaggaatattaccaagtccaattttagccatgtttggcaccgcaagtccaactgtttttgaaatgtggccaagcgtgtctgaagcaccatcaggaactcctgcattgacaaaatcattggcatctggtgccgctccaatacccactgaatctaagacaactaagtgaatgcgatcaaattgtgacataacttctcctttatcaattgaaaataggaagtcagaccagcatccttcctatttcctttatattatttaataagtgccttcttcaactttttggttcttaacaatcttgatgatacggctagtacccaagcgtgaagctcctaaagcaataaatttttcagcatcttccaatgatgagattccacctgctgccttaattttaacaccttcgccgacatattttgccatcacttcaacatcttcaaatgtagcacctgctgtcgaaaaaccagtagaggttttaataaagtctgcacctgaacgtgtgacaaccccacaaagttcgataagttcttctttagttaattgacatgtctcaacgataacttttaagatatggtcttgacatgcagccttgatttgacgaatttcttcttcaacagtatcaaaatccccatttttaacatctgtcaaattaatgaccatgtcaatttcatcagcaccatttttaatagcatcttgacattcaaaaaccttcgctgcagttgtactatagccatttgggaacccaataacagtacaaatagctaatttacctgaaacgtactctgctgcttttttgacgtaagaggctggaatacatgctgaagctgtttcataagccattgcatcatctaaaattgtttggatttctggccatgttgctgttgttgctagcaaagtatggtctaccgtttttaaaatatcttttacttccacgttactatccttctttcttttgtcaacttttagaatagagttacaataccgacgataaaggcgctaagcatacttacagcaataccaccaatcattgcacggaaaacaagtcgagctagggtgccacgtttctctggacaaagaacagcaatacctgaaacacaaatacctaaacttgataaattagcaaaaccacaaagtgaaatagttgctaccaatgctgtacgataatctaaagatttgattaggtcacccaattgttggaacgaaacaaactcatttaaaatcaacttacttccaagaaggtttccttctagaagaatgtttttgtggtcaaatcccataagaaaaccaaatggagcaaaaacatatgagaagatttgttctaagcggattcccaatccacttaacatcatattaatcaaagaaactaaaccaacaaaggcaatcaaactagcaccaattgagaaagccatttgtgcacctgtgcttgcaccctcagcgattgcatcaatcacattggcgttattacctttattatccatcttaatgtcatcaattttttgaacaggttctgtttgaggcaataagattttagcaatgagaatactgccaataggaaccattgttgaagcaatcaagagatattccattggaatgcctaatgcaatgtagccaccaagaatagaaactgacatacttcccatacctgataccaacacaaccattatctcactatcagtcatacgacctaggtatttgctaaccaaaattggactgtctgtttgaccaagaaacatattagctacggcaacaaaactctcaacctctgaggatttcataattttaccaacgcccttacctatccattttactacaaatccaaggattcctacataataaagtagactaactagggcagataagaaaacaatattgccaagcgtttgaatggcgaaaataaaaccagtttttgctccactatctgctaatgaaccaaacacaaaatttaatccagcttgaccacagttgattactttagtaactccagttgaaacaacactaacaacttgttgacctagtgggatacgtactaagattagcgcaataatgaattgaacgataagagcttttccaattaaacttagagaaacactcttacgattgaaagaaattgcatacacaattcctaataccaataaaataccaataatactataaataaattgcatgatgacttccaaaacctcgcttattgtgatttatcattttcaataagtgtgcggagtgcttcaacagcaacttgaatagctgcttctgtgtcatgagccattgggttatccatacccaaagcgttgcgttcttgattaccaacaacaaggaaatctgatccacaacgaactcctagatgacttgctgctacaaaaagagctgcagattccatttcagacgcttttgttcccagacgtttccatgcttcccatttatttaataattcataactaactggcatacgttctggctcatgttgtccataaaatgcatctttacattgaactactcctgcgtgacttgtgtaaccaagctttttagctgcattaactagagcattcgttacctccaagtcagctacagcaggaaattcaatcggagcatattctttacttgtaccttccatacggatagctccagttgcaataacgatgtctccgcctttaacatcaaggtcaataccaccacatgttccaacacggataaaggtatcagcgccacagagtttcaattcttccatcgcaatagacgctgatggaccaccaataccagttgaagtaacactgactttttcaccgtttaatgtacctgtataagtaacatattcacggctgtctgctacaagaactgcattatcaaaatgttctgcaatttttgcacaacgttttggatcacctggcatgataacataacgacctacatcacctggacgaatctgtaggtgatattgcaatccgacttcacctgaataattctgcatgataaagacctccttaatgtcttgtctatttttttacacttgtataataacatacaagacaacctttgtaaacgcttttatcgaaagaaaacgttttattttttaacttgatttttctaattttttcaattaaactaacttgtatacggaggttacaatgcctaaaaatgaactaaataataaactaaataaactaaagcatgtacaagtctacaataagatttttaacatgattcaagacggtacttattctcctggaatgcaattaccttctgaacccgaattagcagggcaacttaatgttagtcgagctactttacgaaagtcattagcactattacaagaagaccatttggttaaaaatatcagaggaaaaggtaatttcattagagaaaattctagcaacttgtctgaaaacggttacgaaaatagacaacaccctattaaaacttgtctaacttccaaaattacagaagtagaattagaatttcgtgtagaggttcctgcagaagctatcacagcttcacttaaacaagaaacccctgtagttgttattgctgatcgttggtaccacaccgatgatggaccattagcttacacactttcttttatccctatcgaacttatttcagatgctgagatttctttacatgatactaaacagttgttaaacttcattgaagaaggtatctatcaagaaggcatatcaagccactcacaaagccatttgggatatgcgacatctggcaatttttcagcaactaaatataccctatccgatcatggacaattcatattaatacaagaaacaatttttaagcaagagaaaatactaatgtgtaataagcattacgttcccattgagcactttgaattgtccattacctctcattaaggaggcaagcctatgcaaaatagactattaaaagttgcttttttcataacttttaccgaattaattatgggcctaatagttggcgcttattttaagttaagttattttctagcccctccaaaggaaccgtcaatgggtgctgggtacggaatgctcttttctctgttatttatacttattagttacttaattctattagctataattcaattcttagcttatcaatctcaatctaagataatagcaatcattgttttgctacttttttcctcccactactggcaaatattagatggcctatccttatgatcttcttaccgcaagtggtagtgactatcatatctctattatcacaacataaaactcccctttgttaaaggggagttttatgttgtgataagttagtgattagaagccacccatcatagatggatccattgcaggagctgtaggagcttctggttcaggtttatttgctactactgcttctgtagtcaagataagacttgctacagatgccgcattttgaagtgcagaacgtgttactttgacagggtcaatgatacctgtggtaaccatatctacccattctccattggccgcattaaatcctgtaccaatttcagactgttttaaacgttcaataataactgaaccttcatatccagcattgtaagcaatttgacgaacaggctcttcgagagcacgaagaacaatattacgtccagtctcctcatcaccattaagtttcagtgccgctactttttcaataacgttcacaagagccgtacctccacctgaaacaataccttcttcaactgcagcacgcgttgcatttaacgcatcttcgatgcgaagtttcatctcttttaattctgtttcagtcgctgcaccaactttaattactgctacaccaccggctaacttagcaagtcgttcttgtaatttttcacgatcaaaatcagaagttgtagcctccatctgtgacttaatgatagctacgcgattagcaattgctgatgagtcaccggcaccttcgacaataacagtagaatctttatctactgttactttagcagactgtcctaaaacttgcatagtagcatcttttaagtctaaaccaaggtcttcagtaacgacagttcctcctgttaggatagcaatatcttccagcatggctttacgacgatcaccaaatccaggcgctttaacagctacgacattgaaagttccacgaattttgttaagaacaagcgttgggagagcttctccatcaacatcatcagcgatgattagcaacggacgatttgttttaagaacctcttctaataatggtaaaatttcttggatatttgaaattttcttatctgtaataaggatatacggattctcaagttcagagaccattttctcgttatcagttaccatatactgtgacaagtacccacggtcaaactgcattccttccacaacttcaagctctgtttccatacctcgcgattcttcaatagtgataacaccatcattacccacgcgctccatagcttcagaaatgtattccccaactttttcagaacgtgaagacacagccgcaacttgagcaatagcttctttgcctgaaactggttgtgcaatctcttttagctcttcaactgctgctgaaacagctgtttcaataccacgacgaatgccaatcggatttgcccctgcagttacatttttaagaccttcccgtacaatagcttgggtcaaaacagtagcagttgtagtgccatcccctgcaatatcattagtttttgaagccacttctgacacaagtttagctcccatattttcaaagtgatcttctagctcaatttctttagcaattgtcacaccatcatttgtaattaaaggagaaccaaatgctttttcaagaacaacattacggcctttaggacctaatgttactttgactgtatcagctaaaatatcaacaccacgcaccattgctgagcgggcatctgctgaaaatttaatatcttttgccataatttaatacccaggcctaaaatttaacaaagtctactttctttacaaagcaacttttctctaataggcctatatcctttcttgcttaataaaacctatttaacgacagcaacaatgtcactttcgcgaacaactgtcactttttcgttaccgtctttaacttccagaccagcaccattttcgactaaaacagtatcaccctctgcaacgctcggtgcaactaattcccctgttaaggtacgaataccgtcacccacagcaagaactttggctgtctttgtcgcatcatggcttgctcctgcaagaacaaaaccaccgacagatttctcttcagtttcaacaaacgaaatgatcacacgatcacctaatggttttaacataataaacgaacctccatacgagatatattttgattttttagcactcttatacagagagtgctaactacaaaaactattctatcacttggtcagaattagtcaagagaaaaggcacgtttcaaacaagaaaaatttccctagttatcctgtccattcactagagaaatttatattttaacctaagacaagggcatcatctatcaactgttgacctgagtttttatggaaaagttccattaattctgcaactgttaagtttctctttgcttctcctttaacatcaacaacaattttcccgtggtagagcatcacgagacgattaccataagcaatggcatgctccatattgtgcgtaatcattaaggctgtcaatcgttgttcttctatcactttctgtgttaattccataaccatatcgctagttttgggatctagagccgctgtatgttcatccagtaataataatttgggacgaacaagagttgccatagctaacgtgagggcttgacgctgaccgccagataaaaatgcagcatcagtcttcattcgattttctaagcctagacctaattgtgatagagactttttaaatagttgacggtcatcgtcagtcactgactgtctaaaaatgtgacgcttattgcctcttttatgtgcaattgccatattttcttcaatcgtcaaatttgttgcagttcccattctaggatcctggaagactcgactaatatccttagatcgtttttctacagagtctttagtaattgattggttgtctaatgtgattgccccctgatcaatagggatcagaccagcgatacagttaaggagggttgattttcccgcaccgttacctccaattactgaaataaaatcaccgtcttcaatcgttaaatctaaaccacgtaaaacatggttctcattgacagttcctttttcaaaagttttgtgcagattgactaattcaagtaatgacatgttcttatccttcctttgtaagtgatttagaggtttttactcctagtttagctcgtaattctgggacatacaaaatgagagccaacaaaattgctgaaaccaactttatcatctgtgcatcaatatcggttgttaatatgaaaacaataatcatacggtataaaacagaccctaatacaattgaccataaccttttgccaagaggtaagtattttatcattacttctgccaagataattgaagctaatccaataacgattgtacccactcccatattcaaatctgcatagccattattttgcgctaaaagtgcaccagataaagcaatcaggccattcccaatcatatatcctagcattttcatccgatctactttaatactattggcttgtcccatagcctcattatcacctgtcgctcttaaagctaatcctagttgggtatttaaaaagagatacaaaattaagataaccaagcctacacaaacaattccaattaataaaactgctgaaagtttatttaaacctaatcttgttaccattgtaaccaaagtatttttgagagcaaaagagacgtttgatcttcctaaaacaagtaaattaatagagtaaagtcctgtcaacgtaataatacctgtgaggagggctggtattttcattttagtatgaagaaaacccgatactagtcctgccaacataccacctaacatgcccgctatggttgccacaattggattaatatcattaacgatacataaagcgcaaactgcagcccccatagggaaagcaccctctgcagagagatcggctatgtctaagatacgaaaagtgataaacacgccaattgccataattgaccaaagtaatccttgcgaaattccggataagataatatctaacatacaatacctttctgattatttattatttttaatacttgaaacatcaattccaagctcttttgccatatcttcattaactactacttttagattttgaggatattctgaaggaactttagcgacgtctttacctttgaggattttaacagcttgtcttgccgtttgacgacctaaagcctcataatcagccccataagaaaagagcaaaccacttggtaccatatctgctgaacctcccacaacaggcacttttaattctttcgatagattccctaacagcgttactgagctggctataatattatctgttggtacaaaaataacctctgttttagacattaaactcttagcagtatcttgtacatcattagtggaagaaatacctttaacacttgttttaatccccgcctcttggaagattttttttgcttgttttacctgaacttctgagttacgctcgctagtggtatacataataccaacacgtttaaccttaggcattacttttctcaaaagggatacttgctttttaattggagacatgtcacttgtaccagtcgctaaaccttcaggttttttcattgattttactaattcggctgataccggatctgtcactgctgtaaataaaataggtgtttctgttgacaccgttgtcaacgattgagccgccggagtcgcaattcccaatactaatttattatctttaatgagtttttcagaaattgattggatatttgactgatccccttgagcattcttatactcaattttgatatttttgccatctttatagccttctttagctaattcttttataaatcctttcctagtggcagttagagagggatgttctacatattgtaaaataccaatatgttttacatcagattgaccattttgagaagattgtgaacaagctgtcatcagaacagttgctaaaacgctgctaattaccatctttgttatttttttcattactatctccttgtaataccatcaaattttccataaaacaaaaaaccaactagaccctacatctagttggttaattatttctctcaattcctctgtgcacgggagggcgaaaaaatattgccttaaccaactagattattgaaatgatctaatcggctctgctttcatcataaaatgctttagcttcatagatacaaactttgcgtgacgtttgtatccttgaggctacaaacgtctatctaaagaaactaaagtaataataagtatttgtttgtttaataatagacgatttgattaacatattattctctccttgtttatggttgcctataagtttacgtcatttaaaaataattgtcaatagttaaatttgatttttttgaaaattcttgttagatagataatttaaataatagtcattcgttgatataacacgcttttaaggaaatttagatttgctatccttaattttccatatactctactaaagcataataaataccatcgttatcattatcctgagttacatttccaattctctcttgtaaatctttaggagcattccccatgacaaaacctttacccacaatttcaagcagatttaaatcattatagttatcaccaaacgcaatagagtctgcaagagaaatatctaaatagtctgctaaagttttagcagattttcctttttcaatacctggagccattatttcaataaagtaaggagcagattgtgcgattgataaatgtggatattgagctttcaaagtgttctccaattctcccatcagagatggttctcccatcaagagaagtttatgaatcctatcttgcttctctaactccatcaaactcatctctttagattgtaaaccaacaatctcctcctctttttggacccactcattttctttatcacaggaataccattcatgataacgatagacattccatgcaattttcgaataatgcttgcttacataagaacaaacttgtaaggcaacttgaccatccattgtgtgggaagcaattgttttttgttgcatatcttgtattaaagccccattataggaaataatataagaatctattccaatttgttccataatcggagtaattgcctcaggcatcctagctgatatgggaacgaaagtagccccttgagctactatttgtttaattccctgccgtgtcttaggtgttactttaaaattactgttaattaaagtaccatcaatatcactaaatattagccttaccatattatcctccaaaatataattgtacacgcttactttagtctaacacttaaatttttgtttcgcaaataaacttcgtctggtctaatgagactactaatataagctatatttcaaaacaaattagtttatttctctcaatgaacggtgtaatatgttactatatagtaataataggaggattaactatgtcgtatccatacaaagccaatcattccattgaatcaatcaccttaaaagtaaatgacctcgaaaacctcgtaaacttctatagcgatatcattgggttaactgttattgacaaatcaagcactagagccttactaggggtaaatcaaaaaatccctcttattatccttgaaaaaactgaacttgaaaagcatagtacctatggcctttatcacactgctattttagtaccagatgaataccatctcagtctagctctaaatcatttattatctcagcatatccctctagagggtggagctgaccatggctatagcaatgctatctatctaagtgatcctgaaggtaatggaattgaaatttataatgataaggatatctctatgtgggatatcagagagagtggacaaattattggtattactgaaagactagatattgacaatttacttgacagccttgtcaacgttcctaataattataagctttctgaaaaaactagtattggtcatattcatttgagtgttaaagatgctaagattagctcaaaactctatcaaaatgtttttggccttgatgagaaatttgcaatcccgacagctagttggattgcatccggcaactaccatcatcatctagcctttaataattgggctggtccaaatctttctaaaaaccaagaagatagacccggaatttccttattgacaattgcttacaatgatgacaacctttttagagatagcttaaaaaaagcgcaactttaccaactgactttccttgaaaaacaagatcattattatattattgaagattttgatggcatccgaattaaagttgttctaaaaccagagaattaaccatcacttgacttttgcctcttcattttacataatgtcaatatgataaaaattttgatcccaactgcaaaagaaatgaaagtgtgtcaaaacattgcatggcctaaactgagtgctcaaacgaaaattataattgattatttttctactttaactgtttcagacttagaggatatctacagaattaatacaagtgcagctcgttgtgaggctcaaagatggcaagattttaaagctaaacaacttactctgaatcctgctattaagttattcaacggtcttatgtaccgcaatatcaaaaggcacaacttatccacaagtgaagcacaatttatggaaaattctgtttttattactagtgctctttatggcatcattcctgctatgacactaatatcccctcatcgtttagattttaacactaaaatcaaaatcaacaataactctcttaaagttttttggcgtgaaaattacgatacttttatgcagtcagatgacattatggtttctttgctttctaatgaatttgaaactgtcttttctcctaaagagcgtcaaaaactaatacatcttaactttattgaagatcgagatggccaattaaaaacccactctaccatatcaaaaaaagcaagaggaaagtgtttaactgctatgatggaaaataattgccaaactctagaacacttaaagcaattacgctttgatggcttctgttatgataatgaactctcagactctaagcaattaacttttgttaaaaaacagacttaagtaactatttatccacaatttattcacacaaaaagcaagagataatcgtatctcttgctttttgacaaacttgtaaggtctaaaaacctctctatatcaaggtttcaaacaatattaacaaaaaataattgttattaacaacttgtggataactatggggatagacagaggataatctgtttatataaagttgattacttaacactaatgtcattgtatatacctttagatttcaaaaatacttgttaaattaacaataataaacgtcaacatcttgtcacagactgtcaaatacttataaacaagttgtggataaacataacttttaatttttatttaaaagttaatttttgacactagagtaaatcatctcgtttgacttgttcataactattgtcaccatcgtttaatccttcccaaatcacgacttcaccttcttttaaagatttttgtacatcaatgattctttgatttgaagatcctctaaattgtagcattaaatttcgcttactttgatcaaacctaccatccactaaaatatcaatcaaagataacatctccaatttatcttgagtctccagcatcatttcttcccaagtataccccgtccatgaccaaatatctttttctggcaattcacgtcggatacgctgaagaagtggcaacaaaatacctgtatttaagaacggctctccacctaataacgttaaaccttggacgtaaggttgttctaaatctgtcataatttgatcttcaagctcttttgtataagggattccggctcgaaaggaccatgtagcagtattataacaccctttacagtggaacatacatccagctacgtagagtgagtttctaacaccttcaccatctacaaaattaaaagctttataatcaatgatatggccatgacttaattcttcgcttttccactccccaggctttggagtattccaacttgcttcttctgacatttctaacctctctattgatatgaaaagaaccagaactaactggtctttttattattatcttaaagtactattttaggttatccaataacgctctgtctgatgaagacaatcttctaaaacaccaccgttagctaatattactgacttgctggcatcattgtctacatggcatgtcacaagtatttcattaatattttttagatgtgcttgctcaattcctagcttcaactgttctttagcataacctttgccacgctggcgaggtcgtatggaataaccaatatgtccacctttttctaaaagagtatcatttagtcttaaacgtaaatttaagaaacctatagcattattgtcattgtcaaaagacacaaactgaatatatggaacaaaattatcaggaacgcctacccctaactccatatttaggttatgatctagccagtcttcaaaatgcatagttggttcataaaaaccaccgtccactgaactactttctttttgaaactctttatacatggctaaaatttcttctttatcttctaacactgggcgccgtaatttcatattgtttcctattccattatcttcaagttaagcattccaaaaggagcattcgctttattaatctggtcacaaataaaatgactcaataaactagactttggtgatataggattgacacctgtagtgatagcttgaataaaagcatcaatcattggttcaaaaccacgtttctctagagtgcttgcccaagaaccaaaaccgatagcacgacggtcaaagccatcaataacagaaagatttgacaaatcatctaatgaataggttacttctggcgactctatttcaattatttctcgacgagaccccgactgcaggttcatgcttgcttctattatctcactgtctgtttctagcgttactgatacttgtaatatcttattcccatcacgtttagtcacaaagtatcctcttttaacaacattatttgtcaaaaatagcgccgtatctaaaggatggataaacatatcaaaaagcttatattgaaaatccgctggtgcattgacagcatttttaaaggtgcgaatatggtttttatcttctacttttttcatttccataatacgtggtgcaaagcgacgattaaaacctgccattaaaaatgttttatgatccttcgccaaatcatacaatgctttagttgaagtataatcttctgtcaaaggcttatccataaaaactggaatacccttttttaaaaaaagctttgctatatcaaagtgagcactagtcgcgacatgaatgaagactccatccaaaggatgctcggctagactatctaaactgtcataagctgtagaagaaccaaaaagcatattaacttcttctaaaatctgtttttggcgtgtaaaaagatgccagtgcacacctgtcacttgacgcatataaggtagataagctttctgtgaaatacctcctaaaccgacaattccaagttgcaacatagcatcctccttctattttttctttgccttttccaaaaattgtttccttaaatcttttagacgtgatttttgattagcattctctccagtagagtgcttctcatggaacttctgtacttgtgcttgccctttgtaatctaattggtatttccccatatcttaataactccttctattttatcttcttattttaacatataatagaccagaggttttaatagaggttttaattaattaccttgatttttaatacttgatccgttcatatgttttacacgagcagagatttccttatgacgaccattaaccatcggacgagcctgtggattacctaaataaccacatgtacgtttgacaacatctactgtcttagggtcgctgttaccacaatttggacaagtaaaacctcgatctgtcggtgtaaaatccccttcaaattgacattggtaacacttatcaatcggtgtattagtacctagataacctacccgatcataagcatagtcccaaactgcttctaaagcttttggattctgttgcaaaacagggtattcacagtagtgaataaatcctcctgatgcacccgtttcaggatagattttctcaaaatctagtttttcaaaaggtgttggattcttacgcacatcataatggaatgaattagtgtagtattccttatcagtaatatcagttactataccaaatttttcagtatctaaacgacaaaaccggtcagtcaagctctccgatggtgtcgaataaactgaaaaatgataatcatactcatcagaccaatctgcacataactgcttcatcttacgaacgatgtctacagtaaatgctttagcttgatggttatcttcccagtcaccaccataaaaaacactcgccacctcatataaaccaatataaccaagagacaccgttgcacggcggtgattaaagagtcgatcaacattgtcatattttcctaaacgttctccaaatgctccatactggtaaagaatgggcgcatttgctgggatagcctctttgacacgttccacacgataaaccaaggcatctctagcaatactcatacgttcattaaatatctcccagaatttatccatatcaccgttagactccatggcaacacgcggtagattaactgttacaactccaagattcatacgaccagatgttacatcctgaccatttgcatctcgccacccttgtaggaaagaacgacagcccataggggctttaaaagagcccgttaagtcaataattttatcataagaaaggacatctggatacatccgttttgtcgcacactctaatgctaattgtttaatatcataattggggctatcttcttctaaattaagaccttttttaagcgtaaaaattaattttggaaaaatagcagtacgatgctcgcttcctaaaccttgaatccgaattttcaaaatcgctttttgaatttctcgttcaaaccaattagttcctaatccaaaaccaagcgaagtaaatggcgtttgcccatttgaagtaaataaagtattaatttcatactccaaagattgcatggcatcatatatatctttttgtgttttagcgcgcgcatagtcttcttgtttatcttcaataacccattcttttgcatcttttaaatgtttttgataatttaactgtgcataaggagctaaaaactcatcaatgcgatctgctgtacagccaccatattgacttgaagcaacgttcgcaataatctgtgaaatctgagcagtcgctgtctgaatagattttggactctcaacttctgcattaccaatcttaaaaccatttgcaagcattcccttaaaatcgattaaacagcaatttgtcatgggagtgtatgggctgtaatctaaatcatgataatggatatcacccttttgatgtgcatttgctacatgagaaggtaacattttcagaccaattgatttccctacaatacctgctgttaaatcacgttgggtattaaacacatcagagtctttattagcattctcattaacaacagtttgatccttattaattaattttccaatagaaaaattgatatctgtagcctgtgaacgctcaaaatcgcgttgggtacgataattgatatattcttgtgcaatagcgtactcattagcttccaataatttatgttcaacgatattttgtatttcatatatcttgatgttatctttaaaacgattgtagatctcagcgatgacatgatctgcaatcatctcaagtttagcctcaactaaaggagacattttgataactttattactagcttttaatagagccgtgtagattttatacttatcaaagctgaccaaacgcccgtcacgtttaatcactttgatatcagattctgtcataaatcgttctctttccaataccatcatgtgaaatatcctccagtgacaattatagcatgcaaagaaaaaaaatcaatatattgtgtcaagttttttgctcagacacaatatattgattttttaatctatttgaaacgatatagaacaaaatgagtgatatttgatagaggaacttcttggtagtgcttcttaatatcagatttcagttcatttggtaacttctcatttttatttaagataaagtatttagccccatgctgaagcagctcgtccttcaaaattttctcattatttttttgcgctgtattaatatgtggcaaaacaaattgagaagcagattttaaccgagtctggctataaatgctagcaactttgtcccaaacataaatcttaccatctctatcaatttttgtagtcaaataatgtgaaatgtcacgcctttctttactaagagtaacattttgataagtattataaactagtaaccctatcgataaggaaactagtaagaggggcaaataatatgttttctttacaaaaaggtctacgataagagatttaccagagaaatactgacgtctatgtgaacgtctgtcaatcactttttggtaaagaatagtaattttattactcgttagcaaaagaccaaatggtaaagcaggtaaaaagtggtaaaggttaaaatctcttgaaaaaatggccattatagcgtaaataataaaaatacaggcaataaagttcaagccgatttgataagatgcttttttacgattttgaataaaatcccatagtccaaagagacaacctgaccctagaaggacaacaatttgaattgctaaactaagaaggaatgagtggtttgtcctagcgaaatacgtaaaggggtaaaaaatagctttgtcaatataagaagagataatctgtagattaaacataaagtaaccaacagtataagcaattaaaatcataccaaaaacaacgcataaaaactgataaaatcctcgtagtgactgcttttgcttaatattggttgctgttaagagaacaaaagagcaaagccaaaaaatcagtgtttggggatctataaatagtgagaatgctgctaaaatgccataaaatataaatgcttcatcaacgatattatcgacacaaaatttaattaaaaaccatagcgaaatgagcataaaaggtaatgcccactgtattgggtacataccaccgaatcctaagacaatattcattatatagaaaatcaacgtcatgcctatcgagacaatttcactttgtgccacataataaactaatttataaaaataaattccagatacatagtaagcaataaactgtacaataagtaaccagatactagaccctaaaaggtaacttagagcaatcgttacatagtataaaaatcctcctgtagcaaaaacatcactataagggatctgtcctttggtcatcatcaaacctgtatagagattctgagtctgcaaaccatttgcaaaataagtcaataaaggatttgcaattgctaagagagttgacaaaacactatatagtaaaattgaaaatcgactagatttcttcattctgatagccgttcgtttactcattgatgggctatttttatagctcactccaattggtttttctaggttttctaccactatttttctcctcatatttacatactaccagtatatcagaaaaccttatttagtcaatttagccaacacttgaccgtaacgaataatatccctaaagtagtggtattttctagacatatattgtttgagaaattcttgttcttctagtgttagctgagtatctgacattaacatcacctccttttactacatcatcactattattattcgaaaaaaaaacgactgaacaattgctcaatcgcttcgatattattcttcatctagaaagctgttgaaaacttcctcaatcatgtcccattctgcatctgaatcttctggtataggctgaaggtctccttcagttccatcggcattttctgtaaatgagtaagcttgaatctcaatttcaccttgttcgtcttcttccgcacctgcaggaacgaggagaacatagtttttgccaaactcttcacgcccatcaatagttaatagaatttcaaaaagtgtttcgttcccattctcatctacaagagtgattacttcatgttgatgttcatggttatgatcgtggttatgattatgtgccattgtttctcctttttatgccgaatgcttaaaacatgcggtctaaataattttgtaagattagttgagctgctaatttatcgataactttcttacgcttaccacgactaatatcagcttgctcaactagcatacgctctgcttgaacagtcgttaaacgttcatcttgatattcaactggaagattgaataattcagtgattttatcgccatatgcctgactagcctctacacgaggaccacttgtattattcatatttttaggtagaccaactacaaatttatcaactttgtactcttttactaactctgctaagcggtcaaaaccaaaatttccagattcttcatcgatcttaatgatttcaagaccttgtgcagtgaaaccgagtggatcactaattgcaacgccgacagttttcgagccgacgtcaagtcccattattctcattacaaatctattccatttccttgtaaataataacgaacgagctcttctacaatctcatcacgttcatatttacgaatttgattgcgagcatcattgtaacgaggtacataagcagggtccccactcaatacgtaaccaacaatttgattgatgggattgtaacctttttcttctaatgaacgataaacagctgttaatgtttcactaatttctactttgttactatcatctaatctaaaacgaacagtttcatctgtaaatcccatacctacaccttctttcctttaattctttcacttattataacttaaataaagtatttgtacaagaaattgataaacactatattagaaaatcaaaaagggagcacaagaaaccaagaagtgattctttgatttctttactccctaccttataggtgatttttacaggttatcgtgtgactctcacttatgcttatctaaagctcaaagtgctgcacgaagacgagcttctgcattttcaacgttacgaatagagcgaggtagaaaagcacgaatatcatcttccttataacctacttgaagacgtttgtcatcaattagaattggactctttaaaatacgtggattttcttgaataagatcaataacttcatttacactcaactcctcaatattacaattgagcgccttagcataacgatttttagaagaaacgatactttcaataccactttcagtttttgttaatatttctaaaatttcatcacgtgttagtgattctttacctaggttttgttctttatatggaagttgatgagcatttagccaagtttttgcttttttacaacttgtgcaacttgaaatagtataaatcttaatcatgtgccttctcactttctatcccatgatagttatagtttaacatagtcacaaaaatcaaacatgggacttaagacctattttttatcaatttactaataaaaataaatagattttagggatttttaagcttatttttagtataaaaataagttccaaccactgtcagaacttattttagttacatttattcaagttcaagatgtatagttgctattttattcctcaatttcaatagcattgtccaaatctaaaacaagatcatcagcttcatttttttcttcaacgagctcagactgaactggcgaatcatcttcagtcattccaaagtgcacgcgcactttatggtcaatttcatcaaaaattgctggattatctgctaaatattttttggcattttcagaaccttgtccaattttctcaccattatatgagtaccatgcacctgctttttggataatatccaaatcactagcaattttaattaactcacccgtgcgagaaataccttcaccatacataatttcgacaaaagcttcacggaatggtggagcaactttatttttaacaactttgatttttgtctctttaccaacattatgatctttatgctcaccagttcccttgatttgagtattaccacgaacatctagacgaaccgatgaataaaatttcaaagcacgaccaccaggtgttgtttcagggttaccaaacataacgcctactttttcccttaactggttgataaaaattgcgattgtctttgtcttgttaatggatgctgacaatttacgcattgcttgactcatcatacgagcttgcaaaccaacgtggctgtcaccaatatcaccatcaatctcagcacgaggaacaagggctgcaactgaatcgacaacaactaaatcaactgcgcctgaatcaatcaatttacctgcaatttcaagaccttgctcacctgagtcaggttgagacaaaagtaactcatcaatattaactccaagagccgcagcataggctgggtcaagagcgtgctcagcatcaataaaggcagcaatcccaccttccttttgggcttgagctacggcatgaagggcaaccgttgttttaccagatgactctggtccataaatttcgacgatacgtcctttaggatatccacctgctcctaaagcgatatctaaagcaagagaacctgaactcattacttgaaccttttgttcagctcgctcacctaagcgcatcactgcgcccttaccaaaatctttttcaatatttttcaaagcatcatctaaggcttttcgacgttcatcaccgaatttcttagtaatttcttctgcttttttcgtttttttagccaatgtcttctccttatatttctatgaatctaggttgattcaaatttagaaatcgttctactaattataacaaatattatatctttaataaagccctacgcaccaagtcaaaagcatgtaaagtactgatatgacggacatctgagcgactcttccctccaatcgatactttaatagaagaaacgccttcaggggttgcaatcccaataaaaactgtacctgcagggtatccttccaactcatcaggaccagcaactcccgttaaaccgataccaaaatctgcttttaaaagttggcgagcttgctgagccattgcctcagctgtaaaatgactgacaactccatattcttgcaattttttcttagggatgccgagaagttgtgattttgcttccatactataggtcgtaaaaccaccattaaaaacttgcgaagcaccagaaaattctgctaactgagattgaaataaccctgctgttaagctctctgcggcagtaatcgttttattttgtactttcaataattctaaaacagtacgtgccatactattattatcaccataaccatataataaatcttttaatttacggttatctaatgtcttaagagcaagtatttctttttctaagctatctaatttaaagtcggcctcatcctgattttcagctttcgttgataaccttaaagttacctcaccaacctttgcatatggtgctatagttgggtctgtctgattcttaattatgtcttctaagattgtgactaactgactctcaccgataccaaagaatctcaatacacgtgaatataattttgtgccattatttgacaaaataggtactacctgctccataaccattggctttaattcactaggcggacctggtaaaaccatatattggactcccttagatgtaacgataccaccaacagctagaccagtaaggttttgtagaggtattgagccttcaaccaattgagcttgtcgttcattatttggcgttctagcaaactgaggacgacttgcaaaaaaaacgatccaattttcgactagctaataaatctactgttaatgatttacctaaaaatttagcaaaagtttgcttcgttaagtcatcctctgtagggccaagtccaccacataggataaccaattgactgcgctgactagctatatctaaaagcgataataaacgttcctcattgtctcctacagctgtctggaaataaatatcaattcccaattctgccattttctccgacaaaaattgtgcgtttgtattaacgatctgtcctgttaaaatttctgttcctacagcgataatttcagccctcacaacttcaccctcttatctattcgaaataatgactacattttagcaaaaaaagtagcaaaagtgctacttaaaacatatcacattgatattacttgaaatcacatatattttcatggtcattaaccatacccgcggcctgaataaaagaatagaggcaagttggaccaacaaatttaaaaccgcgtttttttaaatccttagataagcgttcggataaggtagtacttgcaggcacatcgttgtagttgttaactgagttaacctgtactttattatctacaaaagaccaaatgtagcgatcaaaacttccgaattctttctgaattaatataattgacctagcattttgtcgtgttgagaaaagttttagacgatgacgaataaccctaggattttgtaagattatctctaaatccgcatctgacattgcagctaccttttcaatattatagtgatgaaaaacttgtctgaactcctgacgtttatttaatactgtttcccaagataaacccgattgataagtttctaaacatagtaactcaaagagtacatgatcgtcatgaacagctctcccccactctttatcatggtaagctacatataatggattatctaaattcacccaagaacatcgtttcatgtgaaacctcattacttctaaattatttcatcaacatcttcaaactagatttgatgtattgctccacagtctcgttcgtaccttcaaaaaaggcttttacttttttcaattcagtcgccttataccccaacgctaacaaagcttccatagcttcttcaagattgctattctgctcagagctaaccttacgactagtcgcactctcaccagaagcttctacaaacttccctgacaaatcaaggatcatctgttgtgctgttttttttcctatctttggaaatttagtcaaatacttaatatcactattatcaatggcacttacgagaccttcattgtcatcgactgcaataattgctaaagcggtcgttggaccaattcctgatactgaaattaaattaagaaaaatttctttttcattttccgtatgaaagccaaataaaagatgtgcatcatcgcgaatgacttgatgtaagtagatggtaacttcttgattaacgtaacctgaaaaagagtagggatttgccacatatatcatgtatcccaatccagctgtttccacaacaataaatttagccgttattttactcaattttcctttaatataatcgtacattctattttcctatctcaatatttttcattttggtagcatataagattaaaaccagacctgctaacataaaaatggtcaatgttatttgaacacctatttttcctgtaaaatagctgagcgaaaccatggcacctgctaatacacttgcaacaggttgtgcgatagctaaaaatccagaatatgatccaatttttccctccaccatcatctccgcccttagaacctgactagctggaacataaatcatttcgccaaaggtgaaaaacgtcatggcaatcaaaatagctccaaaagtgtttagagaaatattaaaaagcattccaaaaccacaaatcaagctccctaatattagttgacgtttcaaaggccaattctctatgaatttatttatagttgtcattagtaagacaattaatagagtgtttgtaaagactgctaaactaagcattttagcacctgtgattgtatgtcctaaaatggacactacttcaaaattttgcttaagattgaccgagaaataattatcaacctggagccagacaacactggaaccaattgctcctaaagtataaacaacaaacgctttatccactaaaacctgactataatttttaaaagttcctaaaactcctttatcatgcttgaaggttccctcctgtggttttgtctcatcaaacttgaagtagaccacgaaacaacaaatcgctgaaataataagaagaactattaataattcaaaaaaatggtgatcatagaaaatcccagcaattccagaacctagcattacagcgatgttaaccaaccaataacctatagtgtaaacaaagcgacgattctgttcgttcgtcaaatcaatggtcatagcttcataggcagggaaataaaattggtgagctatttcaatgataaggatacctacaaaggtcaagtgtggcgtaatatgatttggaacatttgcagctatagttatagcccaaccaatggttgccagcagtgaacctataatcacaacttttttcctccccatagcatctgacaaatggcctccatataaggtcgctacaaaccctgatagttgagttatgatgatcaagattcctgtaactagatttccaaaatattgaacataatacattgccataaaaggaaaaatagctgaaccaaccgtaatggaaataaaacgcaataattctcttaactgtagctgttttggcaaagcaaaaaactctttcactttttctcccttcttccctaacaagtaattatcaatattttcctaaatccctgaggcttgtatgattttcttggattcgtttaaacattttctccatatcagcttttgtaaaattaactaaaacaggtcttccatgagggcaattataaggatttttacattgcgctaactgatctaataaatgacgtgctgagtaatcgtctagcgtatggtttgctttaatagatcgcttgcaagacatcataatagccaactctgcgcgatattttttcactgatacttcattagtgagcaacaacatatcacacatttcataaatgccagactctacctcttcttctttcatccaaattggatgttcccttaaaatgaaagtattattaccatacggttccaagaaaataccaacatcttgtaataatgacattttttcttgtaattgaagaaaatctgaacttgaaaattcaaatagaaatggtactaacaattgttgaagactattatcaacctcacctatcttttcacggtaatactcgtattttacacgctcttgagctgcatgttgatcaataatatacaacccaccattcccttgagcaaataagtaggtcccatgcatttgaccaaaaaattcgagctctggaaaagtcgaactttcttccgaatctaatttttcaacaagtttgttaagtgactgtttactactaaggtaatcctgagaatgaatgaagttctcactatcagcttgatctctactagcatactttatattaggagactgcgttgctccttgattaacagagttttttacatcattgtcaactgaaccgtcacttttgtcaaggtttgtaaagttagcaataggttcagatacagtatctgcacctataaaaaagtcatttttagccctatcgtaatacaaaccaggctgttttagtgagaagcttgtttgtataggcttatctacacttcgggtactagttttagctaaattctctaaagcatccggaatcaagtcatattgtttaagactctcagaaattgctgtgcttattaaactcattaattctcgttccttagaaattctcacctcttgcttagtcggatgaacgttgacatctgctagataaggatctatctgaatatcaatgacagcaattggaaatcttccaaccatcaactttgaaccataaccatctagaattgagcggttcaaaagaaaatttttaatgtaacgaccgttaattaatagggtaatatagtttcggttagctcgtgtcaattcaggcaaacttacataacccgaaatttcaaaatctaaatctgcatttgaaatctcaatcattttttttgcagtatttaaaccataaatacctgcaatcgcctgtctcaaatcgccagtcccactagttttagtcatttctttaccatcatttatcagtgtaaaagcaacttccggatgcgctagactgagtctattaacaatatcaataatatgagctagttcagactgtaaactcttcatgtatttcaatctggcaggcgtgttaaagaataaattttcaactaaaatttttgttccacgaggacttgaaacaacttcctgtttttcaatgtttccccctttagcaacaagtaacgtcccttgtttcccttgctctgtagctgtttttatcgtcattaaactaatcgaagcgattgatggtagagcttcaccacgaaaacctaaggtccgaatacgaaaaaggtcactctggcttttgattttggatgtagcgtgacgtcgtaaactgagaacggcatcctcactagtcatcccttcaccgttatccgttatttgaatctttttaagaccagattcttcaacctctatggtaatttggctacttcctgcatctatggcattttcaactaattctttaacgacgctactaggcctttcaacaacctcaccagcagcaatctggttagctaatatatccggtaattcaataattttagacaagttcatccctcctttttttatgattttttgtaactttttttgtgatatcttagccattataccatattcaaaatattaatttgacaataacacaatttttagttgacatcactcctattacctgttagacttagggagcgtaataagttttgaagttgtatttttgtttaacatttttaccttttttattttttacagtaacatttttagaaaggtaataaacaaatgacacaaggtacagtgaaatggtttaactcagaaaaaggttttggctttatttctagcgaaactggaacagacgtcttcgctcatttttcagagattaaagttgatggcttcaaaactcttgaagaaggacaaaaagtaacatttgatattcaagatggtcaacgtggaccacaagcaacaaatatcaatcttgttaaataattaaaaaagagcctaaatgaattatttagtctcttttttgttgcctaaaggctattttataataatttctttaagtcaaatatagcattcatagcttgcattggagttagattcattatatctatcgcttctaactcctcaataaccctacctgcatttgaaggttcttcaaaaagcgataattgtccttgttgcttctcagaatctagttcctcatttaagtcagcagtaacagcttcttgggagggcgatacgatcaactgtactgcatcagcttccaactgtgataaaatatcagttgccctatccaataagtcaattggtaaaccagctatttttgcgacgtgtatcccataagacttatccgcaggtccagattcaattttatgtaagaaggtaacttctccatctctctctaaagtagccacgtgtacattgacaagccttgtcaactgttcagataaatctgtcaactcatggtaatgagtcgcaaacattgtttttgccctaacacggtcatgaatatattctataatcgattgagctaatgccataccatcataagtggctgtccctcgacctaattcatcaaaaagaatcaaagatttatcactggctcgttttacagcttgattcgcttccatcatttctaccataaaggttgattgcccagaaattaagtcgtcagcagcaccaatcctagtaaatattgcatcaaatacaggcaaatcaacttcgtctgccgatacaaaacctcccatttgtgccataataactgtcaaagctaactggcgcatataggtcgacttaccactcatatttggtcctgtaatcaactggatatctgtctgactatcaaaatagatgctattgggaatatattcttgcactcccatcactttttcaacagttgcatgacgcccattcttaatcttaatctgatgttgatcattaaatttgggacgaacatagtgataattttctgcaactactgccaaactctgtagaacatcaacggttgcaatcgtctttgctaactcttgaagacgtttaatataagattctacttgggcacgaacacgcataaaaatatcatattctaaatttgaagattgctcgcgagcttcgagcatttcaccttcaattttggctagttcagctgttccatagcgttcagaattttttaatgtcgctttacggaaaaaatgctccggtactagtgataaattggaattggtaacatggaagtaataaccgtcttttttattataatcaattttaagagtaccgataccacttgctgctctttccttagcttcaatatcagcaatccaacctgtaccttcacgcatcactgttcgataattatccaattgcttatcaaatccagacttgataatgtttccctcagtgatagtagcctgtgcttctggggctatcgccgtattaattaaactttctaattcaggcatagtgtcaattttgttgacaatgatgtcaagctcaggttgattgaaggactgtaaaatcattttaatccgaggaatttgtgataaggtctgtccgagttgcaatagatctttagggttggcttttccgaaagatactcgacttgctaggcgttcaatatcatatacaccctttaaactttctgtgagatcgtttctctcaaaaaaataatcaagaaacacttgaataatatcttgacgttccttgattcgattcatacttaccaaaggcctgtcaatccaagttctcagcattcgagttcccatcgctgttttagtctcatctaacaaccagtaaagacttccatgcttcttgcttgttctagcattctccagtaaatctagactatttttcgttgcatatgacatttgtaaatagtcctttatttcataatgaactactttctgtaaatgactaagttcacgcttttgtgttctatgcacatattgtaaaagtttttccgcagcagatatttccaaatcagttaactgctcatcaatcaaatgaatatcattaagtcgttcgtcttcgtatgataaaagcaagttcatctgcttcgtcagtaggtgatttttttcgtccgtcaattgatatcctactacaatctcacgagcttttaaatttagtatttcactacggacggactcaaaatctgttaaaagggttgcctgaaactctccagttgagacatccatatatgctagaccaaatgtttgttgatcttgcgaatcaatcgctactaagaaattattagcactatccggcttcgttgactccacaaccgttcctggggtaacaacttgcactacctcacgcttgaccactcccacagcttttttaggatcttccatctgctcagcaatggctactttgtaacctaattcaactaaaacgtcaatatactgttgagctgagtgatagggaactcctgccattgggattggcttttctgcgttcttatttcgactagtcaagctaatttccaggatttgtgctgcttttaccgcatcatcataaaataattcataaaaatcacccattctaaaaagcaaaaaagcatctggataattctcttttatatccagatactgttgcattcccggtgatatcgttggcttggccatttctcactcctaactaacggggctggctgccatgctcagctcctcaatcattatatttataaacctactgatagttctttttcaaaaactttggcaatatcttcattttgacaaatcaccaacaaggtgtctgctcctgccattgttcctaaaatctctggcagccctttctcatcaataaagtttgctaaaacgctagcctcccctaaattagtatttaaaactaacataaaacttgctcgcgatactttcaaaatatatgagcgtaaggctgggctaaatcgatttgaagtagctgttgataaactataatatagcttaccttctgggctacgtaattttaaaagaccaatctcacgcaagtctcttgatagagtcgcttgcgtgacatcgattccttcattttttaaatgtaatttaatttcttcttgtgtgccaatctgccctgattggatcaaacgtttaatacgtttttggcgttctattttattcatgttattcaatcctttttagttagaattatgcttaccaaattatatcaaaaaaaattgtctttttcacttagtagtgatatcgtaatcattctgtaaaaaagctataaagtaggctagttctttacagaatgcattatgaatttaatcaacaagttctcgtctatttttcataattatgttaaaatagggtgactatattactaattaaaataggagataccatggatacaaaacatctaattgcgagtgaaattcaaaaagttgttccagatatggaacaatcgaccattctttctttattagaaaccccaaaaaattcgagcatgggagatttagctttcccagcattctctttggctaaaactctacgcaaagcacctcaaataattgctagtgacattgctgaacaaattaaaagcgaccaatttgaaaaggtggaagctgttggaccttacgttaactttttccttgataaagccgcaatctcaagtcaagttttaaaacaagtcttatctgatggttctgcctatgctactcaaaatattggtgaaggacgaaatgttgccattgacatgtctagtccaaatattgctaagccattctcaattggacaccttcgttcaacagttattggtgatagtttagctaatatttttgataaaattggctatcatcctgttaaaattaatcaccttggcgactggggtaaacaatttggaatgttaatcgttgcctataaaaaatggggcaatgaagaggctgtccgtgctcatcccatcgatgaacttttaaaactttatgtccgtattaatgctgaagccgagacagaccctagcgttgatgaagaggcacgtgagtggtttcgtaaacttgaagctaacgatcctgaagcaactgaattatggcaatggttccgtgacgagtcattattagaattcaaccgtctttacgatcaaatgaatgttacatttgatagctataacggcgaggcattctacaacgacaaaatggatgaagtgcttgaactgctagaatctaaaaacctcctagtcgaatctaaaggtgcacaagttgttaacctagaaaaatacggtattgaacatcctgccctcattaaaaaatccgatggagcaactctctacattacacgtgacttagctgctgcactttaccgtaaacgtacctacgattttgcaaaatcaatctacgttgtaggaaacgaacagtctgcacactttaagcaactaaaagctgtgcttaaagaaatggactacgattggtccgatgatatgactcatgttccttttggccttgtaacaaaaggaggagcaaaattatcaactcgtaaaggaaatgtaattctacttgaacctactgttgcagaagctattaatcgtgcggcatctcagattgaagctaaaaaccctaacctagcagataaagataaagttgctcaagcagttggtgtaggtgctattaaattttacgatttgaaaactgatcgtacaaatggttatgactttgacttagaagcaatggtatcatttgaaggtgaaactgggccatatgtacaatatgcacatgctcgtattcaatcaatcttacgtaaagctaactttagcccatctaatagcgataattacagtctcaacgatgttgaaagctgggaaatcatcaaactcatccaagattttcctcgtattattgtacgtgcggcagataattttgagccctctattattgcaaaattcgctattaatttagctcagtgcttcaataaatattacgcccacacacgtattttagatgaagacgctgaaatcagtagtcgtctagcactttgctatgcaactgctacagtattaaaagaatctcttcgcctcctaggagttgatgctccgaatgaaatgtaagaaatgacactactaagactgtcaaatttatgacagtcttaattttttatattataataatagcacaacaagttacaggagaatgccatgccatcagaaaaagaaatattagatgctcttagtaaagtttatagcgaagaagtaatacaagcagatgattattttcgtcaagctattttcgagctcgctagtcaacttgaaaaagaggggatgaactcactcctagctacaaaaattgactcacttatcaatcaatacgtcttaacacatcaatttgatgctcctaaaagcatatttgatcttagtcgcttggtaaaaacaaaagctagccattacaagggaactgctatctcagctattatgcttggtagtttcttaagtggaggaccaaaataaaaatacaggccagacagcctgtatttttatttatcgtaatttcttcgtcgaattttaaaatctgagctaataacttcatctacatttataacagaaataaaagcatctgggtctaaatcagccatgatttctttcacatcacgcacttcacttgggttaagagctacgtacaagacatcatgctctctacctgagtaggcaccttggccccgtaaaaaagttacacccctattaatttcatgcaaaatggttgctgctgcagattctgattctttggtaataatgatcattccacgaacagtgtagcccccattttcaacatttgttaacacttgactaaatacaaagctagctactaacgtatatagcatctgttgtaaattaatataaacaagtgaagacgttagaactatagcatcaataaacaataaggtttgccctaattttattccagatttttcctctacaatacgaccaataatatctgcaccacctgtagttgcaccatatctaaatactaaaccactaccagttcctgctaaaattccagcagctactgcaactaacatcatatcgtttttcaaagggactgttacagggatttgttgccaaaaccacatgaaaaaagacattaacactgtaccatatatagttaacaataaggattttttccctaaaatcctagcccctaatataaataacgggatattaaggagaagtgatgaaagtgctggattaactccgaaaagtgcatggataatcaaagtgacaccggaaatacctccttcagccaaatgattagccatattaaatttgacaaagccgaaagtatagagagccacaccaaaggcaattaaaatagtttcttttatctttgtttttaaatccagtttcaacataggcttaatccttccttattcaaaaaagctaaagttgtttaaacaacttagcttaataacatcataatgtttccttagtggtggctgaccaaaagtcatatatacagttaatcatcatcaacgaatcgtccaataatatgaacattttctgcaacggaaacaaaggcttttggatccgcttttagcattaaatatttaaaatcactaaattcttcacgtgttaatatagttattaaaactgcttttttctcatgattataagtaccttcagcatcattgatacaggttacaccacgatgtaaatcacgatggatacgtttaatgacgcaataaggcttactggtaacaatcatcgcttgcatctttttttgctttgtaaaaatggcatctgtaactctacttgatacaaaaatggtcaccatcgagtacaaagcgtacttccaaccaaataaaagacctgcaaataataaaataataccattaataataaaagaaatactacctacatctctgcctgttttctttctaattgtcaaactgataatatctgttcccccactagaaattctagacttaaagctaaaaccaacaccagctcccataattaaaccaccaaagatagcattgattaagggatcagttgtaagggtgatttgaggcattagttgaatgaagatagagcttacagttactgtgataaacgtaaaaatagtaaatttatgtccaatcttacgccaagataatatcagcaaagggatattaatggcataaaaagctaaagcaactggtatttcaaaagaaaaccagtgtttactgacagctgaaataacctgagctaaaccagttgctccacttgaataaacatgtccaggttgaaaaaagaaattgacagcaacactggatagaataccatacagcaatgaagccgaaattttctctgcatatttttctcgtgagatactttttaaagtgtgtaagagaccaaattttttagcccatacactgataatatattttacctttttttctaaaggggttcgtctagttttcataactttctacagtaagtgataattcttctaattgttgttctgaaacgagactaggagcttgagtcattggatcactagccttattgtttttagggaatgcaataacttctcgaatattgtccttgcctgctaacaacataacaaagcggtcaaggcctattgccaatccaccatgtggtgggaagccgtaatccatagcttcaagtaagaaaccaaactgttcctgagctgattcagcgctaaatcctaaagccttgaacatacgctcttgtgtatctttttggttaatacgtaggctaccaccgcctaactcatatccattcaaaacaatatcataggcaactgcacgtactttagccaaatccccttccaactcatgcgctgtctccgctgttggcaaggtgaatggatgatgagccgacatatatcgtccctcttcttctgaccactcaaacattggccaatcaacaacccataggaaattaaatttagaataatcaatgagttcaagttcttttgcaatgcgtgtacgaagcgctcctaaagtctcgttagctacttcaagactatctgctacaaatagaattaagtcattattctctagctgtaaagcttctgtcaacctaccttcaatagctgtcaagaacttagcaaccggacctgaaatagtattatctgcatattttagccatgctaaacctttggcaccgtattgttttgcaatttctgttaatttatcaatattttttcgagagtacttgtccgccttatctttgacaacaatcgctttaactactgaagcttctgagaacaccttgaagtcaacttctttgacaatttctgtcaagtcttgtaaaagcatatcaaaccttgtatcaggcttatcagacccgtagttattcattgcatcatcatatgccatccttgggaatggtaaagaaacctctaaacctttagtgtctttcattactttagcaatcataccctcaacaatgtcttgaatttcttgatcactaaggaatgatgtctctaagtcaacttgtgtaaactcaggttgacggtctccacgtaaatcctcatcacggaaacatttgacaatttgataataacgatcaaatcccgcattcatcaatagctgttttgtaatttgagggctttgtggaagggcataaaaatgtccttggttgacacgtgatggaaccaaatagtctcgtgccccctctggagttgattttgttagcatcggagtttcgacatcaataaactctaagttgtcaaggtaattacggattgagtgtgttactttcgcacgtaatttgaaattttcaagcatttccggacgacgaagatccaagtaacggtaacgcatgcgtgtatcatcatttgcctcaataccatctttaatttcaaatggtgttgttttcgaggtattaagaatcgataattcttgcacttttaattcaacttctcctgttggtaaattatcattagcttgttctcgtgctgtcactacaccgctaacctctataacaaattcactacggagactttctgcggttgccataactgaggctgatacttcttcaggattaataactaattgcatgattccctcgcgatcgcgaagatcaataaaaataaggcctccaaggtcacgacgacgaccaacccatccttttaaagtaatcgatgttcctatgtgctcactacgaacacgcccagcatacatactacgtttcatctgttttctccatttaaaatattcattccaacctattataacaaaaagcacctaaaaaccccacccattaaggagagtttttaggaactgttttacaatcctaattgtttaagcacagatgaaaaatctgttttaatgttttcaaaactaactttaacttcttgacgtgtttgattattttttaaaccgacctctttcgaatctacttcactgctacctaatgtcataatcactttagcattaaaagtatctgcagacttaaattgtgctttgattttacgacccaaataatcacgctctactttaaaaccctgatgacgtattgattgtgccaaatctaaggcagctagattagcctctgatcctaatacagctatatacagatctatagtattttctattggtaaagaaatcccttgcttatctaatattaagagcaagcgttctaatcctaatccaaaaccaaatgctggtgtttctggtccaccaaaataggatactaagccgtcataacggcctccagcacagatcgttaattcattatcttcaatctcagtgataaactcaaaaatagtatgattataataatcaagaccacgaaccatattagtatcaatgatgtatggaatatttagagcatcaagcatatgacacacagcatcaaagtgggcttggcttgactcatctaaataatctaaaatagaaggagcattttcaactgctagtttgtcttctggctccttagagtctagtacgcgcaatggattttcattcaaacgacgttgactatccttagacaattgttcacgtatgggtgttaagtaatcaataagagcttggcgataggcctgacgactttctggattccctaaactattaagatgaagtttaacgtttttgatacctaaatcttcaaatagatgatgtcccattgcgattgtttcaacatcagttgctggattatttgatccaaagcactcaacgcctacttgatgaaattctcgtaaacgaccagcctgtgggcgctcatatcggaacattgatccaatataatacattttggttggtttttgaacttctggtgcaaatagtttattttcaacataagaacgtacaacaggtgctgttccttctggacgaagcgtaatgtgacgatctcctttatcatgaaaatcatacatctcttttgtaacgatatccgttgtatccccaactgagcgactaataacctcgtaatgttcaaacattggtgtacgaatttcatcataatgatattgtttaaagagattgcgtataacattttcaacgtattgccactttgctgattctccaggtaagatatcctgagtcccttttggtttttgaagtttcataagtttacctcttcgattagttttctctttaaacattctaccattttttcttatattttaaacaagcatatatcatttgctttagtttgatagtattttcaccgtgaaattgtaaaaataaaaagttttgtcaagtaactttactttacaaaaaagatatgttatcatagtgaagttgatgaaaatcaaaacttacacatcgaaaggaagaataagaaaatggcaaaacctgcacgtcacacttcaaaagcgaagagaaacaaacgtcgtacacactacaaattgacagctccatctgtacaattcgacgaaactactggagattactcacgttcacaccgtgtatcactcaaaggatactacaaaggacgtaaaatcgctaaagctaacgaagctaaataatagaagggagataccatgcgcgtaaatattacacttgaacataaagaatctggtgaacgcttgtaccttacttcaaaaaacaaacgtaacactccagaccgtcttcaattgaaaaaatactcaccaaaacttcgtaaacacgttgttttcactgaagttaaataagacatcatacagaaagcctatgaaatcaacgtttctaggcttttttgcttgcttaaaatgtggttttgtctgatttttgtctgattaaaagtatattatctattcaaacatctcctatatccgtcatacttccaagtttttatggaatcactttaaagcaacttttttccacttgcgaatcttagttctaaatgttccgaaaggagctaccgtattaatatgaataaacttataaacttcccagactgcattcttagtcgcactatcagcccaatttctcatatgaggtttaaataggacttcgtcgctcattgaatcaatcatgttacctatagcatctacattatcattgagttgagccgtaagttctttgatggttagactagcgtaggtctcagtaaaatgctgatatagctctccaagttgattccatttaaacgtctcagttggtgttttaacttctaagccactctgttcatctgactcccattttagtatcagggtagtccagccaacctgataggctagattctccgctggtgtcctatcaacctcatcaattcttaaatctttcaacttctcaggaatgtcattgaattcagcaatatattttttatatgattttagtacttcttccttaagttcgtttttatctgaatatgttctcatttctttcctctttaatttagtcaagttcattgtatcatattcttttctctttttcttaggaagtacagcttttataattctatatatcaaatgaattttattcaatcaacttttctagcttttcaactgcccctctcatggtatctttttgcttcttaatcacatggagatagacacgctcaatctccttggaatcctccgagtgtccgacaaattctcgaatagtagggaggtcaataccttcgctagccataatagagataaagctatggcggaacatatgagggatgacatgaatcggtctgccaaagtctagaaagctatcgatatccttatagggcttgcctgctttcttgttatactttgctgactgactagagccacctctcaggaattgtgagagttcgttgtgataaagcggagagccttgtcgattacctgccctaatataggttctagtaaagagataccctaagtcttggtaagtcggactgaattgagcttgaaatttatttctgtcaatatagtgacgtagaatcttctcaacctcagggctcattggaatcgtgcggacactttccttggtcttaaggtctgctcggtagcgttccttttcgtcaagattgagtgcttccatcatatcatccgatttattcttacttgccctctgccaatgaacttttatccactttttctcaaaatcaagcatgtcttcatttaagcctaaaacctcacttggtcgcatgcctgttagaaaaatcattctcaatacatctgcgataagttggttatcaggtcgattagtccagctctctatcaggcggagaacatggttaacctcacttgcttctagatacttctctgctatatcttcacgcttcttgtcctgctcctcactctttgtcagaactcgccttttaaccttattgctggcaatcgggtcttgtgtaagagttatctgtccattttcaactgaccagtcaaaaatcatcttaaggtagatatgcagatttctcgccatgtgcatagaagaagcattgataagattttgaatttcatctgtcataaaggcaaatttcgtgatggacattctggtatcaaagttcggctcaatatagcgattatagatagtaacccttgttttaagggtattattggctggcttgaccctttcatgccatgctttaaaggctttaccgtaaaaatttccatctttatcaaatggcttggcgatttcttctagggttaaaagtttcttggctttcttaggcttaatgcccattagctcggcgatatagtcatcaactaatttattcagttcttgcgtgacctgagtaattaattgtgtgtttttaatatcgctgaccaagagacgttctttcccagaaggtaactttttgctcggtgttgccttggtggtaaaccaccctttactagcacctgtagaaaggtatttcttatgagattttttagtaatagggtgggtgaatcgcatagcgaatttcaccaagacattacccgccttataagggtctggtcgccaagaactgatgataagtactcttgaaccattatctctcatagggactacctacgccatctttgcgacatactgattggcaattttgtagtcaaaccacgccacaaagacttctgagtggataaagacattgccgtgtgttcctttgataccgaaagcgtaagggctgtctttcatctgacgaatgtaactattaagtgttgcaacggtcatgccatgccagagctcatctagaaagacggatttgcggtaccagttacgggttaagtcaaaatcatgttctgtttttaatgttgccattgaattctccttctgttttagttataatcaagttagttatttttggaaaggcgatttgtagcttgctacaggtcgtcttttcttatgccccaataggctgagcttagttgctcttgtttgtactgctgaatgtcagtctcgtctgtttcggttagcttagaaatccccaattcaagtaagtgctggatatagctatctgccttttcttgcccgtgagattccgccttagcgacatagagttttccgagtgttcgtgagacttgtttctctgtccacttctcagaacgttttagggtaggttttgtccgttttacgcttaagaccgtcttttcttgtgtctctagatagtcattccaccattttaccgtctttcttcgccaacggttagaatccttgtccctcgggctgacaaaacggtagtgtccgttaataacttcaaagtaaatctctttgagcggtcgcccctctttaatctgtttggctagtaaatttgctttttcctgccagcacctcagctctgctcttgtccatgataagggcgtatttggcaattcttggtctagcttttgttctaacaatttgttatagacacaccattgctgagtacctctaacaccaatcgtaaccatttcaccgaccttttcaccattttcaagaaggctcttttcatggtaatcaaaggttttagcggttgatatgcagagttgctttttacaataactgtaaatgagtgggacggatagactgtcatcaaagatatcgttggcaatatctagtctcgtaacgttactatgacattcagaaatgcgtttcatcaaggttacccagttattgacattgttttccatatattcttcatactgacggcacccctgccctctcagttcgataaagactcccatctttgattgccagtccttattgaagtaaacctttatctctgagaaggaataatgccgttgatacttgtttatcccccattcattgaggacaaacttgtctttaggaagaatgaggattttctcaatgacatcatctggagccaagcctttaatcgttacggctaaatagtctaacatcactgagttatccatgtctaggctccaataaatttaatatcggttgccactagctttaagccaccccaattccctccaccattattgttggctcgccaaccaagatggacttctggattgacaagttctaccacaagggagtttaacccatccttttcaacggatttagccaacttgtcaagattgtctacaatctccaagcgaatgcccttaaggtcatcagaagaatagcccaagtctttcaaggcttgaattttgtctgtatcttgtacagagcaagtgattttagccacttcatctgtcgcaatgctttcgccattgacatttttatagactggtgcaacccgtgaagaaaggatagtcactttctttggaatgtcaaattgtgatttatctaatttcaaatcaccaacttttatggtttcgtctgttaagttaaattttgtcatgtgtttttctcctgttcataaaagctacgcctacatgaaatctgtcataaatcgttgatatcatgggctttataaagatttttttcgtgaaatttgcttcaaatcgctgaaccccttgcttatcaagggttttgaccacatttcgtgtatgtgtgcaccccctaatagggaacggggtgcaatttcaatttcgatttcagccgtttgccaccttccccacctgctctgggctaccgtattgaccactcgcccagcggtggggtggcgaaccgtcttcatcgtttgaagaaaccaattctcttagatgttttatcccctgtctctttctctaagttctgaattctgacaagaagcacttctaacttctgtttcaactcagttaggtttctttggtaatcctcttgaatttccataaaagaaacttctagctcgtctacaagctctctaatgggtttctgatggtcttttcccttggaactcccataaacgcttagaattgccctctcaagccctaatgaggacttcttatccgcgaccgcttgaaagtaggcaaggtcatcatctgtaaagagatagattttagaataagatttccgacccgttctcactctactttctttaaattgagtaccagtcaagctttcaatttttaatcgccactttttcagtgttgaaactgagttaagaccgtcaaccctatccacaacttcttgataatcatattcattcattagcttacctgtgttttctgattgagaaagtcggtcacaatctgcaaggctctagattcaatcaatcgttcaaatcccgtactcttgataaggtgatagagttctctgtcatctaaatctttgcagtcctctggtttgatgaaaactttctcttgtgtctctggcgagtaggcaacccactccaccatttgtagttcaatacttgtttgattcataattaccctcttttctgacgtttgcatccaactagcatttatccgaaatatctggtataattacagtaattagatttactgtccttgaacgatgtaccagattgttcaaggattttttctaccttcctttcttttttgattgttaagttagctcctttctatcaataatatacgattttatatacgattgctgtaaattttttgaacaatcctaatgctcattaaaaattatatacgaaaacatatacgatgtcaagtattaaccacaaaaaaatgtacgattttataaactactatgttataatggtctgagaggtaacttatgtttgaaatacttaaacctgataaaaaggctgttgggaaaagattgaggcaagtcaaggatgagttaaatttgtcttttacagattttggaaatcgtcttggactaaaaaaatcaaccatcaacgcatatgtaagaggagataacttagcgcctcttgaagttttagaaaaagtatcaaaaatctatggaaaacctgtaggttggttttactatggagaattggaagaatatattgaactttaccttagaaaacttggttatggtacattcctagatgaatatcctgagacaccgttaaagataaaggatgagctttttaggattaaagcaaatccaaaacaattaatcacaactaacgggggagtaaccattggaacatttgagaatcctaattgggaaaatgactttggttacccaaatgaaggctacctagatgatatcttttttgaaatgctttgtgaaactctaaagaactcaattagacaggaagctcaaacctacctaagtcagcaagaaggacttgacgatactaaaatcaaagaactctctaattactttgccaaccaaatctacatctcatatgattttgtcggaaatttagaaaatctttctaaagataaaatcaagcaagaagttaaagaaagctatgaacgtctgcttaaagattcacctcaagcaggtgtagaagttagctatgattccaattacctacttggttttctaataaatacacttgcggatagtcaaacaacaaggcaattactttcagatatgtcacaagcaacagtcggtatgcctttttcacaatttcatgagggacacgaattagttgaggttatccaatctgtcagaccacggctgatagaactttacaataacacgacctttgatgattggactgactgggcggagaaatgattttagaaaggaagatgcaaatggataacaaattcaaaaatatcccaaaacggcatttaccacaaaaactcccatttgactacacgtcaatatatactgacccacaaatcattaaattaactactagggcaaatattgcaatcggtacttacgaaggatttctagagtctatcattaaccctatgctactaatctcccctttgcttagccaagaagccgttctctcttcaaaacttgaagggacccatgccaccttgaaagacttacttaattatgaagctggtaataaagtagatattgagcgtgatgaattgcatgaaatcattaactaccgaaaggctctcttttatgctctagaaaacatttccaccatcaacaacatcgattctaaaggattaccgttatccaatagaattattaaagaaatgcacaaaattcttctagataatgttagaggtagtagtaaaaatcctggtaattttaagagaagtcaaaactatatcggtagtgtatcctcgatttcatacactcctgtccccgcggaaaaaacaccagaatacatgtctaatttggagcaatatatccattatgatgacttagacttattggttcagtcagcaattatccatgctcaatttgaaatgattcacccttttgaagacggtaatggacgaattggacgattgcttataccactattcctgtactatcaggaactactttcttatccaacattttatatgagttcgtattttgaaagagataggtctctttacatatcacacctatcaaacatttcaaaagacaacaactggaaagactggtttgagtattacctagaaggagtgatattgtccgcagaagagagtacaaaaaaagctcaggacatactaagcctatataacattatgaaggaacaagtcatccctaaacttaattctgtttcaggtatccagcttcttgactttatattctcggctccaatctttaaggcagaacaagttagtgaacacctaaaaatttctaagagaactacctatactttactaaataagttaattgatgaaggttatctttcaacagataatgctcaaaggaatagaacctactattgtcctcaacttctttcaatcgttcaataaggtatctcttaatgaagtaatgttcacctctgcttcacttatttcttttttagtgaagcaaaagtcatctttacttctcttatctatttcttaatgaagcgaaacctgttttggcttcacttgttttttattatgtgaagcagagttggatttcgcttcacttagcgactggtaagtgacttatcatttatactttatttttatactgaataaaaggaattttacccatgcccaagaataggataaacaatttcatcaatataggaggcttaatcttagtaatctcttttctactattagtccttgatatagttaatcttccaacgaaatttggttttaatataaagactttaaatattgaaatttggaatatttacgctacgcttttaggaagcgggttaactctgtatggtgtaattataacaattaacagtcagtatgagtcacagatagaggatactaaacggattgtaaagcctatgattaatgtgtcacctgttgacgagtatagctacaaggataagtatattcaatttgactttatattccccaaagcatatccaaaccttttaagaaaggataatattgacactccaaatgtcaccatctctctggaaaatcttggaactagagaattgtataatttatatataggaaattttgaagctacttattttgatgatggtggctattattatcaacttaatccaattttatattcaaaccataaggtacaacttaatcttatgttctatgaaaaaaatggttatcttaaagaatttaatcaggaagataaatttcatttgctcatttctcctatcaaattttcaatctattttcaggattgcttgaataattggtacgaacaatcgtttaaattacgtattttccaccaagttcaagcagacaggtcagatgaagaaaattcactaacagttagtattgaaagagtagagatatattctgcccctaaagaaatttctcccgattcacttccgtggataactaatccaagtaagttatgccagtttgggtgaatcactaataaagcgaccacactcttatccaatttattagcagtgaactaaattttgtctgatttttgtctgattaaaactgatgcaagggcaaaatcactctatttcatcaataattgaaagatttaaaagcccgtaaaatcaacgtttctgaacgtaacaaatattgctaaatcacacattacgcttactgaagttaaataattgattataaaaaagcctatgaaatcaatatttctgggctttttatttttaaaaataaaatctgacaaaaaagtataaatttacctcttaccttcaggtagttagtcattcttttaaaactcacttttttataactgaaaatattgttcttaattttaaaaattcattttagattcattttacgactatatactcagaagtaacaaacctaatccaaggtttgaaaaaagaaagaaggaagtcagtatgacaaactataaaaacaactttaaaaaattcatgagcaataaattatacgtagggttagcttccattacgctacttggtattgggggagctataggagtaagtggagctgcattagcgcataaccatcactcagaacacatgtcttttgaacataagcatgaaggacacgataaacatcacgatcatagagaaaaatactcactaaaaacattaaagaatatctcgacaaaaatcgattataagactgccttagaaactgccaaaaaagaagctcgctcaggctttatttcacaaattgaattaaataccaaaggtgatacacctttttatgaaatcaaagttattgataataaaatagctaaaaaatataaaattgatgctaattctgggaagatcctttcaacaacatcagataatcaactcaattcaaaagatgcccaattaaaacaaccaagtaaagatattcagactgcattacaagctattcaagcaaaatataaaaatgcaaaaataaaagaaatttctcttgcgaataacaaatcaaataagctagtttataaagtaaaactacttgatggaaatactcctaagattgcccaatttgatagtgataaagcatcatttataaaggcaaataagcttaatacaactcataaaaatcacgactaatactagtgtattaaagggaataggacctcagtactccattcccttttgtgatataatggaaaaaagccatacggaggccaaaaaatgaaaatccttgttgttgaagatgagtttgacttgaaccgtagtattgtaaaacttttaaaaaagcaacactacagtgttgacagtgcttcaaatggtgaagaagccttacaatttgtttcagtggcagaatatgatgtgattatcttagatgtaatgatgccaaaaatggacggcttcacctttttaaaactgcttcgcaacaaaggaagtcaagtatctattcttatgttgactgctcgagatgccgttgaagatcgtatcgcaggtctagattttggtgcggatgattaccttgtaaaaccatttgaatttggagaactcatggcccgaattcgagctatgttacgacgtgcaaatagacaagtatcttctgatgatattcaaattcaagatataacaatcaatttatctacaaagcaagtttggagaaacgacaatttgattgatttaacagctaaggaatacgaagtccttgagtatttggcacgtcacagagaccaagtcctctctcgtcatcaaattcgtgaacacgtttgggattatgattattatggagagtccaatattattgatgtccttatcaaaaaccttcgtcgaaaactagataacaatcgagatggatcactaataaaaactaaacgaggtttaggatatgttattccaaagtaaaataaattaccctaaaaagtctagcatcatcactcaaattaccctctggtacagctcttttatttttatccttgttatcggtgtattaattggttcattttttatttcaaaaagcattgctgaaaacaaatctaaaaaaaatttagaagctaaagctgtgcaaatgagtcaagcgttagctaaaggtcatcggtatgaggcttttgaagatggaatattttattcagtctatgaccaaaatggaaaagttatctattctggttttccaaaaggatttaaaagggatttagaccatcaacataaacataaaaagaaattatctctattttccatggagaatcgtacctttcagtatgttgatattccaatttctgggaaaaatcagtggttacgtgctatccgtactgttgacagactggataagcaattaactgaattgttatttagtttgggtatcgttcttcctcttatgttgattataataactgttggtggctatttaattttaaagcgcacttttagaccgattcaagaaattactgaaaccgctcaatttattacccaaaatgaagactatactaagcgaattatcactaaaaataacgaaaatgaattaactgagctagcagctgttatcaatactatgttggcttctattgaatcatcatttgttcgggaaaaacaatttaacaatgatgtttctcatgaactacggactcctgtaacagttatactttctgaaagtgaatacggaaaaaactacgcagaaaatttaagtgaagcaaaagaatcctttgaggttatacaccgtcagtcactatcaatgaaaaaattagttgagcaacttctagaattgactaaggcagaaaatccattatcaattcagttagaacctcttaatttctcaattatgatgaagcaactagtatccgattcgagtagattattagataatacccctatacaccttgactctcaaatcgaagatgacctttggattataggtcaacaaacactactcaaacggctttttgataatctattttcaaatgctattaaatttacaaacaatcatatttctattagtctaagacagtccgataatcaaattgtcttctctattaaagataatggtctaggtatctcagttgatgaccaaagtaaaatttggaaccgtttctatcaagtggactctgctcgaaccaaggatagtcagtctggaattggtttagggctatctttagtaaaacaaatcgctacaatacaccgtgctaaaatatgggttgattctaaacctgatgatggcagtcagtttacgctcacctttccaaaattgaagaaagactagagaaaggaaataaaaaaaacgatagattacacctatcgttttttttatttaacttaaactcaatttattatatctcttcagatatttttgagactaatagctgaaatctttaaagtattaaaacttgtagaactaacaaaccgccaccaaatattaggaggaataaaacaaccggccacacaaattttagccaatgggagtacttcatatctaacatctgcaaggttgccataactagtccagtaggtgctaaaaacaacattgcatactgcccaaattgataagccattactactactgaacgaggaatcccaacagtatctgcaagaggtgctagaattggcattgaaagtactgctaaacccgacgaggatggaacaacaaatcctaacacaaagtagataaacatcataacaatgataaagacagagccactaacatgtgaagctaattttgaagctgtgtaaagcatcgtatctgatatataaccttggctcaaaataatattgataccacgcgctaaaccaatgattaatgaaaccccaacaaggcttgatgcaccattaacaaactcatcaacaacatccctttctccaataccatttgccccagttgctgttaaaaacataataataattgtaatagctaaaaaggaagaagccatggttggaaaccaccatccctgtgacattactccccaaaccatcaaaggaaatgaaataacaaataaacttaaaataattttttgtctaatagtaaagagtgagggtgtatggttagttgtcatgccccatttagcattaaattctactctatcttcataggaatatgaaaactctggattcgcttttatttttttagcataccaatgtagatacaccacaacaaaaatagcacctgcaatacaccctgctgtacgccatgataagccttctgtgaaactaataccagctgcatttgaagcaataacagaagaaaacggattaattgttgaaaatgatgtcccaacagaacttgctaagaaaatagcacctacacaaatgatagaatcataacccatggctaaaaagattggaactaaaataggataaaaagcaactgcttcttcttcaataccacatagagtaccgcctaaaaccatcaataaggaaactaaaaatatcaataaaaactctctacctttggttttctttgttaaagctagaagaccagactcaaaagcgccactctttctaactactcctatcatgcctccaagtaccatgataaataccataatatcaacagcttcaatggttccatttaccatactagtcgtcacggagccaatgcctgctggattttgcttcaaacgtttgtaagtatttggaactgaaactggcttactaatagcaccagaagtaaattctttaattttaattttgacattcatcttatccaactgtgtttgcgttgctggaacatgaactgtcttaccatttggatctgttactactagtttggatgatgctgtatcaaattgtaattttgaataggacccagcaggtatccaccatgtagccaaaaccgaaaagattgttaaaatgaataatattgtaaaggcacctggcattcgaaaacctttactccttttgttttcactgtttgtcattttttctggcatgacacgcctcctctataataaaaatagattgacttcatcagaaaaagtgcaaagatgaaggttaaataatcatttctttgcacttatctgagattacttagttatacgtgttcctaatttcccatctaatgcatcttctaaaccatttaatgaggtgattaaggctgttcctttcggattgtgatctaagaaactcatacaggctattactttaggtaacatacttccttttgcaaactcaccttggttaacgtaatcaatcatttgattctcattaacctctgttaaagctttttgattttctttaccaaattgagtataaacataatcaactgcagtgagaataatcaattgatccgcagctagttctcctgctaacagtgcactagatttgtctttatcaataacagctgcaataccttcataacctcccttattaatgacagggatgcctccacctccacctgcgataactagggtatcattttcaataagtgttttaatgctattaatttcgatgatttttttaggttcaggtgaagcaacaacacgacgataccctcgtccagcgtcttctacgaaagtataccctttctctatagcaatcttttctgatgtctccttatcataaaaggtgcctataggcttggtaggtgcgctaaatgcttggtctgattcatccacctcaatttgggtaataattgtagcaacttccttatttattccctcttgacgtaattcatttaaaaggctctgttggagatgatagcctatgtatccttggctcattgctccacattctggaaaaggaaaattagttccttgaccactctcagccgcaaaattcattcctaaattaatggcaccaacttgtggtccattaccatgacttacaacaatttcgtgtcccttttttatcaaggccaccaatgattttgcagtatgttttactaatcttaattgttcttctggagaatttcctaaggcatttcctcctagtgcaacaacaatttttgccatgaaaattcctcctaatcacctaaagttgctaccataactgctttaatagtatgcatacgattttcagcttcttggaaaacaactgagtgagggccttcaaaaacttcatctgatacttccatttccttcaaaccatatttttcataaatgtcgtatccaactttagtatctatattatgaaatgagggcaagcaatgctcgaaaataacgtttggattttctgtcatattaagcatttcttgggtaatacgatagggttctaaaagagctattctttctttccaaacttcatccggttctcccattgaaacccaaacatctgtatataggacgtctgaatctctgacgccttctgcaatatcagcagtgatttcaatagaagcaccagtagttttcgcaatttcttgacatttagagagtagttcaggatctggctctaattctttaggacaaaccaaatgataagtcatgcctacaatagaagcaccgatcatcaaggcattagcgacattgttacgtccatcacccacatacgtaaagcgaatatctttatagggcttatgtaagcattccttagcggtcagaaaatcggctagtacttgcgttggatgatcagcatcggttaaaccattccacacaggaactcctgaaaattcggctaaagtctcaactgtttcttgagaaaatccacgatactcaataccatcatacataccacctagcacacgcgcagtgtcttttgaggtctcttttttacccatctgactgcctgttggacctaaataagtaacatgagctccttgatcgtgagcagcaacttcaaaagcgcaacgtgtccgtgtagaatctttttcaaaaatcaaagcgatatttttaccaacaagtttttgttgttcaattcctgcgtatttagcacgttttaaatcttctgaaagttttaaaagaaattcaacttctgctgtactaaaatccaataaagtaagaaaactacggttacgtaaatttttcattgcttattgcctcctttttttttatactcttattgtagatatcgctttcaaaaataatcaaaattcatcaaaaatcttcaaaaaaactttaaggacatttatatgctagatatattatcagaaaaacatctagaaagaaggcagcgtattattatctctgcaatagctatcgccttagctgctcaaatcaatatctcaatacttgctgatgggtttattatgaccttatctttgttcattttgcctgtctttttatattttaatgacgacattaatccaattcttctctgtctaggaattacttttgcttctcctatcttcagaggaatcatattaagtatcgctggcgaggctgagattcatcaaataattgaattcgttttaactgatatggcgttttatatttgttatggcatcaccttttatactatttattggcatcgttcctaccgtaataaaggtacttttttcttttctatcattatttgtgattattttgccaaccttgtagaaattagttttctcataaagtttaacaattatactataactatattcgctactttatttgccatagcacttttgcgagcttttattagttgcgctgtggcttatacttatagttatctatcacttctcttacaaaaagacgatcacgaacgtcgatactattattttatgtggtcaacttcagccgttaaaagcgaggtttattttatgcaaaaaaatatcattgaaattgaaaacatcatgaaaaatgcttatttattagataaagagttatccaaatatcatctacctaaagaataccaacacctctctctagatatttcgcgggacgttcacgaagttaagaaagattaccaaaatattattaaaggcttaggaacctattttagtgtaaaaaatgaatcaactatggcattgaaagatatctttcaaattgttttatcttatactaggagtattattcaatttcggcatcaagatatcattattctcgaaaataataaatgtaatttgataatatcaaactattactatttactaaccattatttccaatatcgttttaaatgcagtagaagctattgataaacaaaaaaagggtacaatcagtgttcacacagaagaattagaagattttattaaaattgagattagtgataacggaccaggaatacctgataaaatgaaacacatgattttcaaacctggattttcgactaaatttgatgctaatggtgatatctatcgaggaatcgggctatcccacgtgcgtattttaatggaagagcaatatcaaggaacgataactgtttgtcctaatcagccaaatggaacaacatttacactgttattccgtaaaaatcgatttaagttaggagataatacgtgaaattctatattattgatgatgaccccactatcactatgattttacaagatattattgaagaagatttcaataatacagtagtcagagtgaataatgtctccagtaaagcatacaacgaattgctgattgcagatgttgatatcgtattgattgatttattaatgccaatattagacggtgtaacattagtccaaaaaatctataaacagcgttccgatttaaaatttattatgatttcccaagtcaaagataatgatttacgacaagaagcatataaagcaggaatcgaattttttattaataaacccattaatattattgaagtaaaaagcgtcgtgaaacgtgtcactgatactatcgaaatgcaaaaaaaattaaatacaatccaaaatctcctagaaaatacgccatcatatcaaaagcctataacgactagtaacctcactaaaatccgttcaatactcagttatttaggtattacttcagagacagcctacacagatattcttaacatctgtgaacttttattaaaacaagaattaaattttgcccaatttgattttcaaaaagaactttctatcgatgaacaccaacaaaaaatcattttacaacgtattcgtcgtgccgttaaaaaagctatgataaatatggctcatctgtacattgatgattttgaaaatgaattaacactgcaatatgctaatgcattgtttggatttcagaatatccataatgaggcacaacttattcaaggaaaaagcatgtatggtggtaaaatttcacttaaacattttttcgatgaacttattttacagagtaaaacgttttaagacttgtttaagcatggccttatatactataaccatcctaaaacttttcttttcataaatctccaacaaacaccttgtctaccgcaaggtgtttgtttttgcttctagtttatcgtttctgacaatttaaatgtcagatagttgtttgaatgtctactttatgctaatataaccctaatatcatacgacctacactcgttacgcactagaaagtaaattacatgatttcatttgaaaatgttagtaaatcatatggtgatcataccatcattgataatattagttgccatattcaaagaggagaattctttgtccttgtgggggccagtggcagtggtaaaactaccatcctcaagatgattaatcgtctcatcgaaccaagccaaggcgctattactttagatggggaaaacattacatcacttgatttgcgacaattacgcttagaaactggttatgtcttgcaacaaattgcacttttccctaatttaacagttggagaaaatatagaacttatccctgaaatgaagggctggtcaaaaggtgaccaaaaaaaagccgctagcgaccttcttgataaggtgggtttacctgctaaggactactttaatcgctatcctcatgagctctctggtggggaacaacaacgcataggtatcctacgagcaatcgttgctaaacctaaggtactacttatggatgagccattttctgctttagaccctatctcaagacgtcaattacaagatatcaccaaacaattacagtctgaattgggtattacattagtgtttgtcacccatgacatgaaggaagctatgcgtcttgcagatagaatttgtgttattaaggaaggtaagatagtgcaattggatagaccagaaataattcaaaataatccctctgaccaatttgttagaaccctatttgaagaggagaactgagtatgacaacactaatcactacctttcaagagcgttttggagattggactcaaagtcttattgaacacctccagctatcactactaacacttattttagcaactttaattgctattccactcggtatcatcattagtcattataaaaaaatcagtcatgttgtccttcagataactgggatatttcaaacaattccttctttagccttgcttggtttatttataccttttatgggaattggaactgtaccagctgtcgttgcactaattatttacgctctatttccaattttacaaaatactgtaacagtactgatgcaaattgatgctaatctcattgaggcagcaaccgcttttggaatgacacgttgggaaaggcttaaaaagtttgagttagctttaagtatgcctgttatcatctcaggcattagaactgcctctgttatgattattggtacagctacattagctagtcttatcggagctggtggccttggatcatttattttgttagggattgatcgcaacaatccttctctaattctcataggggcaatctcttctgctgtcttagctattatatttagtggtttaattggattactagaaaaggctagattacgaaccatagccgtttctggtatacttttactagcaggcttaggactatcctatgctccaaaatggatgcctggaacaaatactgcaacgataactgttgcagggaagttaggaactgaaccagatattttaattaatatgtacaaagaacttattgaggatcagacagatatcaaagttaagcttaaacctaatttcggaaaaacaactttcttatatcaagccctaaaatctggtgatattgatctttacccagagtttacaggtactattacatcaagtttacttaaaaatcctcctaaagtaagtaataaccctaaacaggtttacaacttagccaaaaacggtattttaaaacaagataagttgtcacttttgtcacctatggcttatcaaaacacctacgctgtagctgttaaaaaagattacgctgaagctaatcaactcaaaaatatcagcgacctaaaaaaattagataaactaaaagctggtttcactttagaatttaaggatagagaggatgggagtattggtttacagaaacattatggtttaaaccttgatatctcaaccttagaacctgctttacgataccaagctatcaatagtaaagatgtcaatattattgacgcttactctaccgatagtgaattaatccagtatcaacttcaaattctcaaagacgataagcatctatttccgccatatcaaggagcaccgctactaaggcaagatacgattaaaaaataccctcaagtaaaaaaagctctcaataaacttgctggtcatatcactgaaaaagaaatgcaagaaatgaactaccaagtagctgtaaagcataaatcagcagctacagtagctaaacaatatttaaaagcacatcatattataaagtagattcaagcaatcaatggtattaaatgatttaaaaagagcatgtcgcatgacatgctctttttaattgccaaataaagcttatttaacaatcttaattttactatcttccattaatagggcacaaatagcacaaattaaccaggacgaacgagaacaagaaatataacgttccgaccacaatggtgtaaacttcttcttatacttgtgtaaaccattaaatgagtagaaatgactaccgaaatgatagacaagatacgccattctctctttagcaaaacttgtttcaacgcgaccaactcctgataaaggtgccatccccaaatcaaaatagtggtatcccttctcttgataataagagaataatgataaaaagaggaaatccataacgccattcggaattttctgtttatcgtgacgcattaaatcaatagagataatactcttttcatagtttggcataatattagcaaaagcaacaacttcgtgttcagcattttttaccaaagctattggggcttgttggaaataatctttattaaaatatcctagtgagaaacctttttcaggacgtccttctaaccaagtattagaaatctcttccaaactatttagtagctcttgactatgtggcgattgtacaacttcgaaatagaaaccatccttttcaactctatttagggcatttctgaaaggtttgtacttattccctttaagagtaaacgtttctaaattaactaaagcatcctcaccaactttcataaagtcaaaaccatactcatgtaaaagtagtgtcaacttctgtccaatactgtaaaaaacaaggtcatagtctagcttatcagcatcatcaataaacgattcaatagcttcacgaatataagtgtcatcaccggctggttcccccataataagacatttattattgacaattacaaattggaacgcaacgcaatcttctccatttttttggtaccagtagagccttttatcatttaaaaaggctaaaccgctatccgaagaaccaccgtaagcttgaagtagttttttataacgatccacattgaacacatcaccaatctgacaagattttccttgtaaaatcttaaccaaacataaataaacgagagtaagaatcaacgtagccaatgctatcggctcccatgctatgatataatgcaggcgttcaatactaccacctgtaatatgagccctgatagggaatagtagtcctgcaatataaaatagaactcccattaaactaacgataatgattccatccttaatacgctcttcccagctataaataaattgttttttatagagagttggcttaatgactaataagcctaacaatagtaaaataaaccagaaagatagtcgccaactaatatgacctaaattaagataaaacaatgtcaaagtaatccagataatagcaattggaaaagcatttttcactttttgatcaatagttctagctaagagaataaaacaaacccccagcaataaacctggaaactgccataacatttgttcttgtaatgggtccaagcctagcttctgcaaccacataatataagtaatattttcaaaaaatgctgttgaaaatattaagaatgcacctaaaatacgcatcaaatggctcaccatggtttgtagaacagttgatactaactctttcgggacattttcataacgttgatttatttgactacctaaataatggataaagaaatagatacctgcaaagaatggaataatatagtaggctaaacgataaagtaataaccatgcaaccacagtttctttaggtagtccctcggcagcaaaccctgtaaatagaactaattcaaaacttcctaatccaccgggaataagggatacaatcccgacggcacaaccaatacaaaatagtggtaaaattttataaactggtagatgaatgcccattaaataaccgataattataaatgctgcggccgcacatccccattcaaaaaaagaaacaacacctaattttatacgagtactagatggcatatctccgaaataatggcttcctttatgaccagaaatccaataaataacaggaaaatacatactagcaccaattaataccaaataatagtaatcaacactagctttggcatgaaaaatatggctcatgattaaggcaatcacactaataaatgacagaccagaaataagatagggtaaaaaacgagtcacttctcttaggtcactcttctcttgaccttttttaccataaaaagccatgcgcaacccaatatcgattaagccaccgaatcctgacaagttattaaaagtgttgatacaccaactagtctgtaaaatataccttttgcttttatctgtacgtaaaagtccattcagtacaaagtcatatccggttgtcggtaagacagcgataacccccacaaggataattaagaaaagattcattggagataattgcccaaaaacactctttagttgctcaacagaaatagttcgtttcaaatgaatcatttcaacaataataagcactaaaacagatataaaaaatacaattttaatcacagaagtcagtgatttgactttttcaattagctttttcaacaatttctcctttcaacgtatcgttgataaacttttttgcaataatattaaaaacatgggaatcttgcttaataatgtgatgcccaaagccaactaaagaataaaactccccccttggaaaataagaagcaagtttcttagaatgatttaacttaattatgtccttatttccaaccaaaaccattacaggagttgacacatgctgtaaatcagctggactaatcttcaaatcctccaacataagcgaaataacttgagctttttgcctcatatacggaaagagtttccctaaatagtgaaggaatttataggcaatccttactaaaagaatatcccaccatcgctgaccatgaatagtcaggttccctgaattaagcaaaagccctctaaccatacctggaaacatcgtttgaaaaactaaagctaaattggcaccatcgctatggcctaccaatataactttatcaatctctaaatgaactaagatatcctttaagtcaactgctatttgcctgaaactaatggtatttagctttgcatgacttttgccatgccctctactatccataacaataacttggtaatacttagaaaaatatgctatttgcttatcaaaatagcgactacttaagctattgccatgtaaaaaaacaatcggttgaccttgaccaacgacacgataataaatatctgaaccatctttagtatgtaaccagttctcagtcataatcaaagtcacctctctttgaattcgtagttatattatactatttttaaagacaaattacttaaactacctgtattatgagaaaaaaatgattactaaaagccgttcaactaaatcgaacggctaagtagtattaaaataagaatgttaaaagagctaatataggtaaaccaccctgttttaataagatttttttatcaactgtcaaagcaccataaatagcaactagcaatacattgattaaaaaaacagctacaatttcttgattctgtgaaatatataacccataaaggaggaataggccaatcaagccgttgtatacaccttgattcttaaaaagtttaataacgggtaaatatgacaactcttctttagacatactaaaaatcttcccagtcatatttgactgggtggctaacgtctccaaatacataatataaaaatgttccaaagcagttaatgttgcaataattattgttaaagtagacatatcttctcctcctaaatactttgacataccatatcatactgttagtctatcactagatactttctattaatcttcttgtttacgataaataagaagagcaagtatcatcgatgatactaaaaagattactagcattctccattgatggttaacgtctcccgtcaacgagatggtctctcttaatcctgaaacagagtaagtcatcggtaaaaatggttgaattgtttgaaagaacttaggactcaattctattgggtaagttcctgcgcttgaaccaagctggaataataatattaataacgacaagaaggaaccatacctattatcccatcccactaaagcagttactaatgccatcaaagtccatgctgtcaataggataataaagtaggtttttccagggtaatctggtttaagacctatgaattgaactgcaaaaaataagatagttgctgctagagttgcaatgaatccattgattaataatttatttttagcccaactaaaacgattagctggctctttgccagataaagctttcgcaaaaataacattggctgataaagctaccaccatcaacgcaactgaaatcatgtatggtgccattccaacaccattcgtatcaacgctatcataatcttcatgcttgatagtgactgggctagatactgcattggcattatctttatttacagaaaccatggacaactggtccccagctttccccaaagaacttgataattgagaaacaccacctgacaactctgtcaacccatctgtcaactgatgtcctcccccagcaagcttattagaaccatctgcaattctatcagaaccactagctaattgccccgctccgtctctcaattgatccgatttactatctaaagtttgagctccctgacttgctttttgtgttcctgaaatcaattgattggatttactatctaaagttactgcacctttgcgtaattgccctacagcattcgtataatccgtgattccttttgtcaaggtttgactaccttgatataactgcttagtagccgttggcaatttttgaattttatctaaatctgagatagcttttaatactaaattgttagctgttcctgacaaagtttgaagattttgtgatccattattagaaggggctgaactagatgcttcactaagcacagttttcatattttctatatttgaagaaatatttgctgcaattgtctcagctgaagtaggtgttccagtaaccgctgaggtgatttgagattgttgttcaggggttaaacttttaaaagctgacgttgattgtaccgcagtcatttgcttttgtttatcagcagcagccgtattcatcaaagcctttgtacttgattcaatagttgataaaaaattaaataacttactattagtatcgctatcagtagttgctgtcgattgtaaatttgtaataatctgatttagattctttaatccatctgaaaggttctgcaaagtacgttcttgctctggttttagttgagttgcttgtgacaattgttgtaaaccatccgtcaacttttctgatccttccaccaatgcttgagacttatcatctaatttttgactaccttcactcaacttatgcacacctgttgtgtaagcagtaacaccatctgataatgtttctaacccgttagatagggtccccacaccatctgtataaaggtttattccactatttagtttattagctcctccagaaaaagtttgactagagcttgctaaaacatctaaattacttgtcaaggtttggctcccatcctgtagcttattagaaccatttaataattcttgactcccatcagcagctttattgatacctgttttcatagaacccatatttttaaaaactgattcagtataagtccctgtaatagattctgctacctcatcttttagtttattagctgctgtctcactcatttttgaagctacaaaactacgccccttagtagttttataagtaatatttaacctttctggtttttctgtcatgagagttgtcgcttttctagaaagatctttaggaaaggtaataaccatataatagtgacccttttctaattctttttctgctcttttagctgttgtaaaatggaaatctaagctatcatttttagacaaattgtcctccatatctttgccaattgaaatagtttttccatttaatttagccgatttatcttggttaacgactgccacaggtaaatttttagtattcccataaggatcccacattgagcttagaaagataacattatatagcgttggaatcagtgcaaccccagccatcgtaatccataattttgggctttttatgattgcttttaattcgtctaacattttttctcctattttggacatattgttcatttttttgataaaatatattatacagtgatgatagataatttcaagataaaaatctcgtttttggacactgtgtttaaaaatgtacaaaaatattaaggggtaattaatatggtaaacgatacgaggagagaaaaaacaaaaagagctattgaagcagctatgattacgttattaaaagatcagagcttcgatgaaatttcaacgattaatctaactaaaacagctggaatcagtcgttctagtttttatactcattataaagataaatatgaaatgattgatcaataccaacagtcactcttcaataaagtcgaatatatttttgatcgcaatcaatttaaaaaagaagatgccttgctcgaaatttttcaattcttagatagagaatcattatttgctgctctcttaacccaaaatggaacaaaagaaattcagacctacatccttaataaattacaattaatgctttctaaagaattacctgtggtcaatccagatgcaacaaagtctgatatcaaccgtttgtattatagtgtctatctcagtcatgctatttttggagtctatcaaatgtggataacacgaggaaaaaaagaaagccctcaacaaattacacaagtgctactcagtttattacctcaaacttaaaaccagccttccttataggctggtcatttttagttaggtttattttatcctcattataggatagcaacactaataaggactgacattataaatgacgatacatttgagaagacatatctaaaaattggcctacaagctcgttatgttctcctataaaatcaaagagctgatcctcactcagtacaccgcatttgagattattttctgtttgttctgatagtctaaaccagtcttcgctaccataaaattctcttaatttcacgtaatcttcatagtgcttttgaaaatcatctatagcttctactaatgcattgattctaggtttgaagctatcatacttctcttccatttcttctatttttaatctatcatttagattcataataaaatctccttagttatataagattcgacgagataagttatcattctcaagtatttgtaacgttaactctactatatcctttttacaaagtaaaaaattactcattacaaactgacagtgttgatttttattctaatgttagtttaaaatctttttggttcattaaatataatgactcactaaaaagtatatagcaaaaaaagcctataaaataggcttttaaagtatgtaatgtaataattaaagcattttgttgtagaattcaacgacaagtgcttcattgatttctgggttaatttcatcgcgttctggaaggcgagtcaatgaaccttcaagtttttcagcatcaaatgatacgaaagctggacgtcctaaagtagcttcaacagcttcaaggattgcaggtactttcattgatttttcacgaactgaaataacttgtcctggagtaacgcggtatgatgggatatcaacacgtttaccatcaacaaggatatgaccatggttaacaaattgacgagcttggcgacgagttgttgcaagtcctaaacgataaacaacgttatcaagacgacgctctaaaagaaccataaagttgaaaccaagagttccttcttttgctttagtagcttgtacgaacaagttacggaattgtttttcaccaagtccgtatgaaaaacgaagtttttgtttctcagctaactgcaagccatattctgaaagcttgctacggttattaggaccgtgctgaccaggtacgtagttacgacgtgccaattctttacctgtgcctgtaagtgataaaccaaggcgacgtgattgtttccatgatggaccagtataacgtgacatctaaatgtcctcctctaaaataattgaggaaataacgatttaaaaaatcctgattcgtgcaggggattttcgcctaaacagcaaagggtactagattagttaaccacctgttgacgagcttcatatttttctgctgttatttcacacaagctatattatatcatgaaaataatattgaatcaagtttttatgtctcttaaaccttaaatacaaatagacatctaataagtatttccaattataataagaaagattcttaattctaaccaccaatagagaattagtaaatttttttatagaaacaaaaaacctcagtcgaggttttcatactattctgctgactcgtcatcaaaataacgaattaaagttttctcagttaaaatatctgaataagtgtaagactctacataagtattatcaattgctcctggtacagctgcagtatccttatactctacgataaacaaagatgggtaaacttcaattaggcgcccaattttatttttttccctcttacgaccattttcgagagtaagttcgaccatctgtccctcatgtgacttgatatcttcttttatttttttcatttttgcaacatctgcaaatgcatcactcatattaacatctcctattcttcaaattgagctatactagaaaatttattatattccttttgaaacattaattttactgtcccacgcgcaccagcacggttcttttctaaaataacctcaacagtattatcttctacaatttcctctgcttcttcgccctctctacgataataatcatctcgatataagaaagcaacaatgtcagcatcttgttcaatcgatccagattcacgaatatcagataagaccggtcgtttatcctgcctttgctcaaccccacgagagagctggcttaatgcgataacaggaacctttaattctttagctaaaatcttcaactgccttgaaatttcagaaacttcttgctgacgattttctggtctagttcctgaaattaattggaggtagtcaatgacgattaaacctaaaccatcatcaacttcttgagataacttcctagagcgtgctctaatttctgtaattttaatcccgggcgtatcatcaatataaattggcgcatccgccaaagctccttgagcaatcgttacattattccaatcttgatccgtcaactgaccagttcgtaaactatgagaatcaaccattccctctgctgccaacatacggtcaactaaactctcagcccccatttcaagtgaaaaaatagctacaggtctattttgtttagttccaacattttgagcaatatttaaaacaaaggctgttttacctactgcaggacgggccgctaagatgattaattgatctggatgtaaacctgtagtaatcctgtctaaatctctaaatccagttggtaaacctgtgacatctgaggtttgctgtgaacgtaattctaagttttcgtaattaacttttaaaacatcagatatctttctaaacccgctacgattactgtgttcgttaatatcaactaaagccttctcagcggtggcaataatttcatcagaatcatttccttcataggccatgttgacagtatctgtcaacttagaaatgatatctcgcaacatggctttctcagaaactattttggcataaaactccgcattagcacttgttggaacactattaactaattcaacaatatagcccaacccaccaatgttttgaagatcaccttggtcatctaaaatatttctaacagtagcagcatcaattgcatcatttctatcagctaaggtaatcatcgctctgaagataactttgtgtgaatatttataaaaatcatctggacttataaattctctcaccataatcagtttctctggtgagataaagatagatcctagaacggcctgttctgccaacaggtcttgaggttgtactcttagctcagatacttctaccaaacttcattcctcctgacttgtcaacctttatcatctctcagtttacgcttctttgatatcaagcttaatctgtgaagaaacctgtttatgtaattttactggtacttcaaccttaccaatcgctctaatagtatgatctaaatcaatatgacgtttgtcaattttaatgccgtattgtttttgtaactcttcagcaatctttttggctgtgatagaaccaaacgtacgaccatctggacctaccttttcaataaattgcactcgggtagtttcggattctaattgtgttttcagctcctttgcctgtgctaaaatttctgcttgtgctttttcttcggacttttgttttccttttaattcaccgatagcttgtgtcgttgcttctttagctagattcttttttaataagaagttttgagcataaccagtaggtacttccttaacctcacctttttttcctttccccttaacatcttgtaaaaaaataactttcatctcaattaatcccttctattttcgactgtactattttctcttaaatcttcgtcaattatttccagtaacatacgtctaacttgctttacagacttgtcttgtatttgacaagcagcaaaactaaaatgtccgccaccaccaagtttttccataatacgctggacattgatattatttctactgcgcgctgaaataccaatatttgaactgtttttagtaataacaaaagtagcctcaatacctgccattgtcaacatggtgtcagctgctttactagctataacatgcgagtaaactttatgttcttctccggtagcaacaatgatgttatcataaatacgctcaccttttaaaatcaattcattaattaaacgatattcatcaaaatctgtagctgatattttttgaatagccatactattactacctaaaccgcgtaaatagcttgccacatcaaaagttctactcgttacattagatgcaaaatttcttgtatcaagcatgataccagccattaaaatacttgcttgactgcggcttaatttatctttagcttgttgaaattgaatcaattctgtaactaattcgctggcactacttgcgccactttctataaatgaaagaacagcattttttggaaaatcttcatctcttctatgatgatctaccacaataacatctgcaaacttgttaaagaattccttagataaggttaaagctgttttagaatggtctaccatgactaataaagaattttgagtaattaattcaaaagctctctcaacacttacgagacgtgtttcgccgtcttcttgcaagtaatcaattgctctttcaatatcagaattcatgtcatttgggtcataaactacataactggcattaacaatattactagcaaaaaattgcatccctacagatgcacctagtgcatccatgtccaatttcctgtgtcccacaataaagacactatcaactactttcaaacggtcagaaatagcagtcatcatagctctggtacgtgttcgtgaacgtttaatagttgaaacagcaccaccaccaaagtaaagtgcttttttactactatcattttcacgtactactatttgatctcctccgcgaacgagtgctgtattaagattttctaaagcaatttgcccaatttgattatggttaccatcaccataagaaattcccatacttaatgttaatgataaatggttttcctgagcgcgttttcgaaactcatttaaaatatcaaatttatcttttatcaatgtatttaaaacgctatagtcggtaaaaatatagtatcgatccatattgacacgacgataaaaaatatttttagactgtgtaaaatcagaaataaaactagtcacgaaggcgttaatctttgacatatcagcctctaacatagtatccataatatcatcgtagttatcaatggaaataataccaataactggacgtagcattgaactatcatagtttcttctattccccatgaaattatcgaagaaatagaaaacacccgtctctgtatccaaataagctgaatatttgttatcaccgtattcaaatgattgcccagccgttccattacgtctactagtaatgatatctttaacagtagcagactgaaaatgaccattatccccagtaaaaatcaattctgcataagggttaaaccactcaatatcatttgtttcaagatcaaattgtataacaccaactggcatttgttcaagaagactcttaagagaaacttctgtttgatcattaagtaattcaatttgttcaacttcagatagttcataagttatcttttggtaatataataaggcaacaacaaaagataaagcaacaaaaatagccaataatagagccgtataggattgaaataacctaacacaaatagctaatagtccaaataaaatcaggcctattaaaactaaatggacggttgcaaaacgaaatcttttcattaaataacctcttaagacctaattataacacaaaacgcccctgataaacaggggcgaacactattatcaattgatatttttacgacctttttgtcttccttcaaggtaaaccattaaaatactaatatcggctggattaactcctgaaatacgactagcctgacctagcgtttctgggttaatttttttgaatttttgtctagcttctgttgcgatagaatcaatgtcgtcccagtcaatatgagggggaatacgtttttcttccattcgtttcatttttgcaacttgatctaaagcctttttaatatagccttcgtatttaatttcagtttccaaaagttcaataaccttactgtctaatggctcatcagcacaaccaacaaaatccgttgctactgcatatgtgatttgtgggcggcgcataaattctttggcagttaaagcatctgtcaaaggtttaaagcccaattcttgaatccgtttatttgtctcagaaactggctttaactttatagagtctaaacgttctaattcattttcaaattgcatttgacgctttttaaatatcgcataacgctcttcatctactaggccaatctcataaccgatttctgttaaacgcatatctgcattatcatgacgaagaatcagacgatattctgcgcgacttgtcaacagacgatatggttctagagtccctttggtaactaaatcatcaatcatgacaccaatgtaagcatcacttcgttttaaaataagttctggcttcccttgaactttaagagcagcgttgatcccagcaaccaacccttgaccagcagcttcttcataacctgaagtaccattagtctgtcctgcagtaaacaaaccagcaattacttttgtttcgagtgttgctcttaattgatgaggcaatacaatatcatactcaatagcatagcctgtacgcatcatttcagcattttcaagcccttttatagaacgtaataaatcaacttgaacatcctcaggaagactcgttgatagcccttgaacataaacttcttcagtgtatctaccttctggttctaagaagagttggtggcgctctttatcagcaaaacgcacaattttatcttcaattgacggacaatatctaggaccaactcccttaacgattccagaaaacataggagcacggtgtagattttgattgatgatgtcatgactcaaagtattcgtataggtcaaccagcacggtacctggtcagtaatataatcttcatccctagacataaatgaaaaatgatttggttgctcatccccaggttgtatctctgtcttttcataattaatagaggaggcttttacacgaggaggtgttccagttttgaaacgaccaatttctaatcctaggtctcttaaattatctgccaatgtcacagaagctaaactattattagggcccgaggagtacttaagatcacctaatataatctctcctcgaagagcagtacctgttgttataacaacagattttgctgaaaatttctgattagttgctgtacgaacccccacaacctttccatcttcaacaagtatttcgtcaatcatagcttgtcttaaggtaagattttcttgcttttctacagtttgcttcattgtttgtgcatagagggctttatcagcttgtgctcttaaggcacggacagcaggccccttacctgtattaagcattttcatttgtatataggttttatcaatgtttttacccatttcaccacctaaagcgtcaatctctctgacaacgatacctttagcagagccacctatagaaggattacaaggcataaatgctaacatttctaagttgatagtggctagaagtgtcttacatcccatacgactagcagctagactagcttccacacctgcatgacccgctccaacaacgataatatcatagttttctgcaaattatgtgtcattttattcctttccaatttcaaagtctaattcattaaaacacaaaaatagccaaaactctcgaaaattgtacgtcaaaaagacttacaaattccatgagctttgaccatcatagttattgttaaatttattttagcatttatcttttaaaagtcaaccagaggggataggctatgttaaatgaaaaccaatttttatgcctgttattagcatctctatcccgatagtcatcaaaataagtcccatcattttggtgattatagtcattgcattttttccaagaaatttagtaatttcgtttgcacttattaaaataacatacattatcacacataatatggcaaaagcaagtatagtaatgagtttgccagataaaccaccacttgataaccccatagcagttgcaatagtacccggacctgccaaaaggggcattgctaatggtgaaactgccacattcattggatcatccttatgctcctctaggtttttattggttggtgaatgtataccattaatcattttataacctataatgcctaccaatattccaccagatatttttagggcggctagggtaatcccaaataagttaaaaagtaagtggccacttaatacaaagattacaataatgacaaaagcaagtaatactccttttgctgcaatccgacgtgaaatcttctgatcatcatcagctactaaagccataaaagctggcaaattagaaatgggattcataatggcgaaaaaagccatgaaagctaaaataaattttgaaatcatacgattacctcacttaataattaagtgtcaattaaatgtattgacagattttatcatcacgataagcctgatcaatcatcccaccgcctaaacattcttgttcattataaaaaacaacagcttgacctggtgtgattgctcgttgtaaatcatcaaacacaacccttgcttgattaccttttacgtaaactgtaactttactgtcaggttgacgatatctgaacttagctgtacattctagcttaaattcattaggcatatcacgtgtaaagtggatttcagaagctgtcaagctagttgacatcaatgagtcatgatagaaaccttgacctacataaagaatgtttttacttaaatcctttccaactacaaaccaaggtttattatctccaccatgttgcccaccaataccaaggccccctctttgaccaatagtataatacattaaaccagcatgttcacccatgtcacgaccatcaacagtcatcatacgacctggttgagccggtaaatattgacccaggaaatccttgaaatttttttctccaataaaacaaataccagtagagtcttttttcttagcggtcgcaagtcctgcttcttcagctatacggcgaacttctggtttttgtaaatgaccaagtggaaataacgttttttgcaattgctcctgagataattgacttagaaaataagtttgatccttattattatctgctcctctaagcatatgaactattccgttctcatcacgtgttacttgtgcataatgacctgttgctacatagtcagcacctaatgtcatcgcataatctagaaatgctttaaatttaatttccttattacacataacatctggatttggcgtacgacctgctcgatattctgctaaaaaatattcgaaaaccctgtcccaatactctttttcaaagttgacagagtagtatggtatgccgatctgatcagcaacagcagcaacatctttataatcttcagtagccgtacaaacaccaaattcatctgtgtcatcccaatttttcataaaaacaccaataacatcataaccttgctcttttaaaagcagggcagttactgatgaatcaacacctccactcatgcctacaacgacacgaatgtttgaattatcagtcataagaattctcccatcaaaaagttttatttttaacttaggcttgaagggccaagttgttcttagatcaatcatattgactaagaaacactataaaagtgcttatatattatagcactatttgttgtcaagttgtatgtttttgttgtgataaatatttattacattgcagtttttttatctttttatgatattttttagaaataatctgttataatgagaatgtacaaaaatcacgaggaaaaactatgaaacatttaaaatttcaatcggtcttcgacattattggtcctgttatgattggaccatcaagtagtcatactgcaggagctgtccgcattggtaaagttgtccattctatttttggtgaacctagtgaagtaacctttcatttatacaattcttttgctaaaacttaccaaggacacggtactgataaagcattggttgcagggattctaggaatggatacagataatccagatattaaaaactctcttgaaattgctcatcaaaaaggaattaagatttactgggatatcctaaaagatagtaattcaccacatccaaatactgcgaaaataactgttaaaaatggggataggagcatgagtattacaggagtgtcaattggtggcggaaacatccaagttactgagttgaatggattctcagtttcattaacaatgaatactcctactttaattatcgttcatcaagatatacctggcatgattgctaaagtaactgatattttatctgactttaacattaatattgctcaaatgaatgtaacacgcgaaagtgcaggagaaaaagctatcatgattatagaagtagattcacgagattgtcaacaagctgtcaaaaagatagaagctattcctcatttacacaatgtcaacttctttgattaagagaaagggtaactatgttttatacaattgaagagctggtagagcaagctaatagccaacataagggtaacatagcagagctcatgatccaaacggaaattgaaatgactggtagaagtcgtgaagaaattcgttatattatgtcccgaaatcttgaagtcatgaaagcttctgttattgatggattaacccctagtaaatcaatcagtggtttaacaggcggtgatgctgtcaagatggatcaatatttacaatcaggaaaaactatttcagataccacaatcctagctgccgttaggaatgctatggctgttaatgagttaaatgctaagatgggactggtctgtgcaacaccaactgcaggtagtgcaggatgtttaccagctgtgatttctacagccattgaaaagcttaatttaacagaagaagagcaacttgattttctatttacagccggcgcatttggtctcgtcattggtaataatgcctctatctcaggtgcagaaggaggttgccaagctgaagttgggtcagctagtgctatggctgcggctgctttagttatggctgctggaggtactcctttccaagctagccaagctatagcatttgttattaaaaatatgcttggacttatctgtgaccctgttgcaggtttagttgaagtcccttgtgtgaagcggaatgctcttggatcaagttttgcacttgttgctgctgatatggccttggctggtattgaatcgcaaattccagtagatgaagttattgatgcaatgtatcaagttggatcaagtttaccgactgcttttcgtgagactgcagaaggaggacttgctgccacgccgacaggaagacgttatagtaaagaaatttttggggaataaagtttatcaattttctactctttccctgaaaataaataaaaacgctacagctttactgtagcgtttttatttatttgttttagcaatctgtaattattgttgacaacagtgtaaagttaatttatagctattcactagtaaccccaagctgataaaccttgagcacgataagctttaatagctgaattaacttgatcctgaactgtagctgttgaaccccaacctggcatcgtttggaaaagtcctgaagctcctgaggcattagcaacattaggattaccatttgattcacgggcaataatatgttcccaagtagactgagggactcctgttgcagcagccatttgtgctgcagctgctgagccaatagcccctgcagtatttccattactcaatacttggccactcgtctggtgttgagcaggtctataagttgtctcagtaacagcataagcttgttgtgcctgactggtagcaggggtgttttctgttacaactgcttgttctacagctgcctcttcactcgcagtaacttgttgctgagaattagcttctgtagattgagaacttgattttggggcttcattagatgcctgagaaggttttggagcctgttttacatcttctacttttgatttagatgtcgccttagtcatttttgattttttggctacgcgaactttatctgcttttgacaaagattcagtagtaacttgtgaacttttaaagatgaccattacagccaaaatacatgaaaaaagggctactaaagtgatagctccataagctaaatgatgtttttttacattcaattttgataattttcttcttttattcatgttacctatattatactttatttgttaccttgcaattgaatagatgttaaaaatattacaaagagatttaattttaagtaaatctctttgttttatcaacttttattaataccagccgttactattccaaaatgatagcgctgccgaccaagatccgtaacgagaaaccacataattgtccgctactttttcttgattttcaggagataagtcgccatttaggtaagattgagacagttgatatcttccataatattgtccattctgtgcagtataactaccatttgattcacgacgagctatttcttcttttgcggctgaatcacttgaactcaaatttgatgaagaattcattgaattttcaattgttggttgagattttgcttctgcttgactagctgtagaattatccaattttaaaacatcacctatactgatgacatcagcgttactgatactattgagagacactaactcttgtaccgtagttttatgatttttagcaatagctgataaggtatcacctgatttcacggtataagatgctgcgcttactgaaagtggtaaagctaatgaagcacccactaaaagacctgccactcctaatttaaatggttttgattttttaaccgaggttattgacataatatatgctctctttcattaattgatacgcgtactatcataccttgtaaatattactaattgttttgccttagatgaaatttattacaaataaattgtaaattaataaagaaaaggcctccaaaaaacaatttttagttttctttaagtaaagttgttgagcttttcacattatataaatgaaaaggctaagaccataaactgatcttaaccttttaattttttaatagaaacaaactcaaacccaataataacataagtaatatactaaaagtatcccgaacagtccacttcaataaacggtacttactacgattggctccgccttgataacctcttgcttccatagcaattgccaacgcatctgctcttttaaaactagaagcaaataatggaatcaaaatagggataatagacttaaccttatgaattaggtttccctctccaaaatcaactccacgagctctttgagcattcatgatacgtgttgtatcatccattaaagtaggaacgaaacgtaagctaagggataacatcaaaccaatctcgtgtgctggtactctcagtacttccaatggttttaacaaagattcaacagcatctgctaaacttaacggagtagtagttaaggtaagtaatgtcgaaaagaagataattaaaacaaatctcataaaaataagtgctgcttgttgtaacccaaggctagtgatgctaaaaatccaaaacgagaagataacctgcccgccttgtgcaaacagcatctggaagagggttgtaaataaaataataccaaccatcggtttaataccattgaaaaaataggaaaattttatctgagataaacccacaataaccaacgtaaaaatgaatacgatcacatttgtcactacattatttgcccaaaaaacaataatgataaaaagcaacatggctagtaacttacttcgaggatctaatttatgaatgagagaattacctggtatgtaacgtcccaaaatcaatttatccatgcttaatagcctccacaaattcgttaatagtaattggtaaactaggtaaatttaatcccttatgagatagtctttgagcaaacttggtgattttgggaactcctaattgtttactttctaaaagttctacttcttgaaaaatctgttttggttgtcctgataaggttactttccctgcttctaaaacatacacatagtcagcataatccgctacatcgtccattaagtgagtcactaagacgatagtcattccttttttatgaagatttttaaaaagagtcattaattcttttcttcccttaggatcaagtccagctgttggctcatccagtactagtactttgggttccatcgctaaaataccagctatagcaacccgcctcatctgccctccagaaagttcaaatggatttttatcgaataaatcctcactgataccaactaaccttaatttttcttcagccagcctttcagcttcaatctgagaaataccaaaattttgtggtccaaaagcaacatcctttaaaactgtctcttcaaaaagctgactttctggaaattgaaaaactaaaccaactttttgccttataaatttgatttctttgttcttgtcccctgctttaatagaaaaatcatcgacaattacctcaccttttgtaggaatatgtaaaccattcaaaagttgcataatagttgattttccagaacctgtgtgcccaatgaacgcggtataggaagcatcttcaattttcagattgacgtcaaaaagggcacgcccttcaaaaggagtgccggcttgataggtataacttacatttttaaattcaattcccataattgttcttctaattccttctctgtaagatactctgtccctatatcaagaccattagcagccagttctgccattaacctacttgtaaagggaacatctaaacctaaactaatcaaacgatttccacgaccaaataacgcttttggagtggatgtcgactcaactttaccatttttcataacgatgacacgatcactcaatgcaacttcatctaagtcgtgtgtaattgaaataacagtaagattatatttttgacgaatagctcgtatcgttcttatcagttccaatcgtccctcaggatcaagcatactagtcgcctcatccaagatgataacttgtggacgcatagctacagctcctgcaatggctacacgctgcttttgtcctccagataaacgtgcaggctccctcattttaaattcagacattcctaccaaatcaagtgcttggtccactctttctttcatgtctttcaaaggaatacctttattttccaaaccaaaggcgacgtcatcttcaacagttgcccctacaaattggttatcaggattttgaaataccatgccaatcttgtgacgtaactcccagacattatcttcggttaactcttgtccatcaatgataatctggccagactccgcctctaaaagtccatctattaaacgaacagtagtggatttcccagaaccattatgaccaataatagatagccattctccttgtttcacatgaaacgatacattctccaattgataatgtgtttgattactatcatatttaaaaaagagattattaacggtaataatatttgtcattatttaaaagtatccttaaataagaagcctgcacctttaaaatagtcgtagcctgaatacaaggtaaagaatagagcaatgtataacatgatgttaccaagtgtcatccaatgtactaacaaaaaaataactgcaaacatttgagtagccgtctttattttccctggcatagctgcagcaagtactgttccacctgtttcaactaaaagtaaacgcaaacctgtaactgctaactctctacaaatgataatagctgaaacccaagctggtgctaagtctagtccaactaacatgataaaagcactcataactagcattttatcagctaatgggtctgcaaatttcccaaaatttgttactacttgccatttacgtgctagataaccatctaggtaatcggtcaaacttgcaatagcaaatacaatagctgcaacaatatgccaagttgtacttgttgttactgaagttaatactataaataacggaatcattaaaattctgactacagttaatagattcggaatattttctttcttcatcataaattctccttttggaaacatagtattcctatattatgttatttcaaaactagtaaaagacttttgacataccaactttatagatgtctaagcttccttattatatcaaaatttcagattatttacgaagattttggaaaaataacgaagtcagatgtgtcagcattatctaagaaatccttaccaatcgtaatgacatcttccaaatctaattcttcaacgatagatggcaaatccaaatacatcgtttttccatcatataaataggtgacgaattgcattgcgagattttcaatagaatctaagcttcttaaaaaatcgccatagagctctctcttaacgttttttaagtggctttcggtaagatcagatgattgcaaagcattttttagcaataacctcaactgagttgaaaaagcaattggctctgtcgtatctaaagaaataataacgcactcaaaatctggatgaacttcaatttctatatcaaaagaatcatcaatttgaccagattcgtaccagtcttggttaattgtagaagtccatcctaaaagcattgcaaaaaatagctgtaatccgattttctcttttaggtaagaaccatgtatcatatgatttgattttcgataaccaatagctaatttaggttttgtcactgtcatatggcaagagttgttttttataacaggctcaaggctaatagaatctcggtcaatattctgtgagtaacttgtgaaatgagaatttttttgaaggtaagttataatttcttgtggactaaattgtccaacaagaactaaattcatattagacaactgataaaagtctttgtgattttcttgtaaatcggttaaggttatttgagagattgattggtaatctccagcgatatcaaatgctaatggagagttggggtaaaggttcgataacactccttgataaagcctatattctgggtcatcttgatacatttcaatttcttgtttgataatatctttttctttagtaattgactcttctgtaaagtttgttgtcaatacaaagtcaagtagtatatctaagcagtttgtaatgtgacttatagttgaaaaataaaaactagttttatcaaaagttgtaaaggcgttactctcggcgccatatttagtaaattgagttgcagcgtcttgtcctttatccagttcaaataatttatgttctaagaagtgagcaattcctgccggataatgttctacacaaccattcctcgtatattttgtatggagtgatccaaaatttgctgtcaatactccaacagtttccttaaatgatggctttggaataaggtatacatttagtccgctctctaatgttaacttatatacttcctcctgaaggttctgataagttattttattaactgtcatcctagtttccttccaaaaaataaaaagcttgtaattttaattttgttgctacgctgacaatatctgattttgttacatcgtctactttgtcaatgaatagtgctgaagtatgaaactgatctaaataatgttcatgataaatgtggtcaactatgaccttaggattatcagaagctaaaacatagttcattttcaatatatcttttgtttgtttcaataatgtagaagaaaacctgcccatcttaatattattgaattgcttattaataagcttcaaaaaacgctcacgattctctttatcaatacctgcatatatcgtaaagagacctgtaaagctgtcaaattgactacctatagtataggctaaaccttgcttttctcgaatttctgtaaacaacaaggagtgggcaaaagcaccaaataaaccgttaaatactattaaagcaaaataatcttcatctttataagttattggaagatgataagccaattgcataatagattgattaacgtccttatcttctacttgacttctcgttatattttcataagtctgcgtataatcaaaagctaatactttgtgacgtggctcaaatgccatacgattaaaagcctgaatcattcgatagtcatcaaaatcccctacgacaaaaatatctaattgatcttccttaagcatcttctgaaattcttgataagctgtaaatgaattttctgattccactaaagatgctgtaccatacttaggtaaacgaagtgtcttattattgtagaataaagattttagtgctaagtcactgctataaaaattatcttcaatatcagcctctaaatattgaataaggtttttcttctcagtatcaaaaatagatgtttgatactgttctaaagaaattaaaggagaaaacagcatatcctccaagaatgtaataatttgttcaacgatattttcttgttctaaagtaaaggtatttttaacaaatacaatatcaatatcaacaatgtgaacaagacccttagtagaaatcttagttgataaactagcgccatataaggaagctaacttttctcgaaattcttgtaccttaggatacttagcatttgcagtaactaacatttgagcaacgagcgatctacgtgctactgttttattattaaaatcacctgaaaatcgaaaagtaagatgattagtcttaaattgttggtttttaattaaatgtagagaaacgccttcaactattttcattcaatatcctttgtgttctgtattgttagctaagattatatcatttttaaaggcgttaaaaaagattaaacatccaagatatgattaattctaaatttcaatcttcttcaaaattgacaaagtcgtcaaccaatatttactcccattttttataccttgtctccatatcataagttcaactcaaaaaataattttatgctataatgatgtgatatctaaaattggagattaaaaagtcatggattataaattatttgatgaatatattactttacaatcacttctaaaagagattggtatcattcaaagtggcggagccattaaaaaatttttagcggataatcgagtattgtttaacggtgaccttgaaaataggcgtggaaagaaactccgcctgggggatattattactattcctgatcaaaatatcgagatcattataaggaagccatcagatcaagaaattgaagaacgtaatatagaaatagctgaaaaacagcgtgtttcagcaatcgttaaagaaatgaataaaaacaccaacaaaggtaaatcaaaaactagcaaaaaaccagttcgctttccagggacataaaaatgtggataaaaaatatttctttaaaacattatcgtaattatgaagaagcacaagtagatttttcacccaacctcaatattttcattggccgcaatgctcaaggaaagacaaattttttagaagcaatctacttcttggctttgactcgaagtcaccgtacccgttctgataaagaacttgtacattttaaacaccatgatgtacaaattacaggtgaggtaatccgcaaaagtggccatcttaacttagatattcaattatctgaaaaaggaagaatcactaaagttaaccatcttaaacaggcaaaattatctgattatattggggctatgactgtcgtactttttgcccctgaagatcttcaattagttaaaggtgcacctagtctaagacgaaaatttttagatatagatattggacaaattaagccaacgtacttagctgaactttcaaattacaatcatgtattaaaacaaagaaacacttatctaaaaactactaataacgtcgacaaaacttttttaacagtccttgatgaacaattagctgattatggaagtcgtgtcattgaacaccgttttgattttatccaagccctaaatgatgaagcggacaaacatcactacattatcagtactgagttagaacatttatctattcactacaaatcgtcaatagagtttacagataagtcaagtattagggaacattttttaaaccaattatctaaaagccactcaagagacatctttaagaaaaacacaagcatcggacctcatcgtgatgatattactttctttattaatgatatcaatgctacttttgctagccaagggcaacaaagaagccttattttatcattgaaattagcagaaattgagctaataaaaaccgttaccaacgattatccgattctcttacttgacgacgtcatgagtgaacttgacaaccatcgtcaactaaaactcttagagggaatcaaagagaatgttcaaacatttattactacaacaagtttagaacatttaagtgctttacctgatcaactcaaaatctttaacgttagtgatggtactattagtattaatgaaaaaaaagcaacagattaatctgttgctttttaataagatttaacaataccaagtaatatagcacccataacaaaacaaaggatacccatgacaacccacttctgctctttcttcgtttttgtctcacctaaaaataaaataccaccaataatagagataattactccaagttgagaaaaactaaaagcaattgctagccctgctttagctgctgccaataacatgaagacattaccaacgccccacatgagacctgtaatcatatttttaacaacaacagcctcaaagttaacacgaaacttcatgaaacaaattgcacctagacacattccaacagccatgggtaaaataacggccatagcgtcgaacttcataatgttattaaataaaactgcgtatgagatgtaacctacagttgaataagcaattgtagcaaatccttttgaaaactcttgatgtgttgccaaagcttgttctgagacatcacgtttacttgagaaatagaagccgataactaataatgtcaacgctgtcaatcctaaaataaattggattggcttagtccattcatgaaagactaaagcaccaactaggcttccacctactaattgtgcaccacttgacagtggattagcaacagagactcccatatatttcattgcttggaattgaccattttggccgactgaccataggataccacctaagataccaaaaatccacaatgaggcagtcatctctggctgtttaaataaccatacgataatcgcaaatagcaatgctcctaaagtcattccaaatgtttgttgatttggacgtcctccaattttattactaacaaatccaatacttccccacgcaaacatgggaatcaatgcaataagtaaaccttccaattctttctccttacaatggaatattaagtattacctattttcaatcctagagaatctattgactaactttattagcaagatcagcaaatactatagctttatcaacactatctttttccaaagctataatgacttgttttatcaataaattgaccagtgatttagaataaggtaactgttctttagtcatattactaatcttatttaaaataacatcttcaggtaaaatatcttgaaaatagcagatgactttgaaataaaaatcattgtactgtgtcacaccattcagataagtaactaccaggttaatctcatcttgaggcagcctcatatttaaccctaaatttgaaataaaaagtttagccaatattttgagaacattgctttctattctatcacaggattgttgtttttggaaactgaaaattctcatgatatcttcattatctcgataagattccagtaaagttaattgctctaaatcagtattagaagttccagccttaacttttgaatctagaatggatacttcattgatagttaccccaacctccaacgtttgtaaagctttaataaatttatcaatacctatttgtgtctcaccattttcaaaacgtgatagagttgattttgataattgagcacttttggctagagaacttagggatatacctttgtcctctctcaactcttttaaaatttttccataatttttcatacaaaaactttactatatttgtttcttttatgcaacaaaaagcatcctcataggggatgctttttgcccttattttagtgtactgaataatttggtgcctcatttgtaatttgaacatcatggggatggctttctttcaagccagctcctgacatttcaacaaattgagcattatcatgaagttcttttatgttcgctgcacctacatatcccataccagagcgaatgccaccaagcatttggaaaacaatatcggctactgaacctttgtatgctacacgaccttcaataccttctggaaccaatttgttagcctcgtttacagaaccttggaaataacgatcgcttgaaccttttttcattgctgcaattgagcccataccacggtatgtcttgaacttacgcccttggaaaatttctgtttctcctggcgcttcatctgttcctgcaaacattgaacctagcataactgcatttccacctgctgcaagtgcttttacaatatcacctgaatatttaataccaccatcagcaatgatagtcttaccgtactcacgcgcaacagccgctgcatcgtaaatagctgtaatctgaggaacacctaccccagcaacgacacgagtcgtacaaattgaacctggaccaataccaactttaacgacatccacacctgcatcataaagtgcacgcgctccttctgctgtagcaatatttcccgcaatcaatgtgcgattagggaagtgagcacgaatttcagcaattttacggagcacaccagctgaatgtccatgtgctgtatcaatgacaatagcatctgcacctgcttcaaacaaagcttctgcacgttcaaaagtatcagaggttacacctactgcacctgcaactaagagacgtccaaattcatcttttgctgccttaggaaattcaataactttttcgatatccttaatagtaataagtcctgaaagacgtccctcatcatctactaaaggtagcttttcaatacgatgctcatgaagaatacgctctgcagtttcaagatctgtaccaataggagctgttacaagattttgacttgtcatgtgctctgagattagttgtttataatcagaaatgaaacgcatatcacggttagtaataattccaactaatttacgattctcgagtgtctctacaataggaactccactaatgcgatagttttgcatcaattcctcagcttcagagacagtattatctggtgtcaagaagaatgggtcaataataacaccattttctgagcgtttaactttacgaacttcttctgcttgatcaactattgacatatttttatgaatgataccaagcccaccagcacgtgcaatagcaatagccatcttactatctgtaactgtatccattgcagctgtaatgattggaatgtttaatgtcaaattatcagccaactttgtcttcatatcaacttcatttggtaaaacatggctttcagcaggaataagcagaacatcatcaaaagtaaaaccttttttcaaaaacttagtatcccaatttgacatcaaaaaatcctcttttcttagatagtagatataaaaaatcccattaaaattatattgttactatcatatcacgctaaaatcatttgtcaatataaaaagagcatagaattaatagcttctagctctttaaagtaatgaaaaaatcttcttaattttctatttttttgagaagaagaaaggcggcgtatactgacttaatttctcaaaacacttttgagcttcttcactattattacaaataatcaaacaagtatcatcaccacagacagttgctaagatctcaggtaataaaatcgaatctaatatggagccaaaagattgagctaagccaggtagtgtcttcaaaacgatttggttttgaactggaaacagcatgactagggcatcttccatgtaaaaacgtaaccgttcttcccaacgcttctgagatatactatgaatctcataataagtttctgtagcattatcactgctttcgttaaccttaattaaattaagttccttcatatctcgagataatgttgcttgcgtcactgaaacgccatttttttctagtaattcccttaactcatgttgtgtacgcaccttagtctcagagactaaggaacgaattaattggtgtcttgtttcttttttattcatataaactccttattcaatgaatttcttgaaataatttttattattatagagaagcttctttcctttcatttcaacgatatctttttggcgtaattcctttaaaacatgactaactgtctcgcgagtagttccgctcatattggcaatttcaatcgttgtaataggaaaaggtaaatgtcccctttctgtaggaacttgcaaaagtagagttgcaagcgattggataactctcatactggcacttgaagtcaccatattacgaagtcgtatttcatgaactcgtaatagcttagaatatttccgacaaagatgcttcatttgattgatattttgaagagagtattcttcgtataaagccattggcagagaaaaatactcaatatccgtaatagccactgctgaaaaatggtaatcatcatccaaaaagagacctccataaggaaaaaccgtaccttgtctaacataatctgtataaatgaaagaaccagaagcgtctgattgttcaatttttacatgtcctgactggattaaaaacagtttttcacggtaatcaccttcaaaaaataaggtatgattttttagagctgtacgatgtttaatgtggctcacaatatggtcaaattgttcaatagtaaagtgtttaaaatcatctagttgtctgaaataaaaatattgttcttttgtaatcacctgattttctagacctttctaatcattagatgcgaacattttttgtataatgaaaattttttaatgtataaaattttcttgtcacgataaatcctccttcattatagcaaaaaaattcgtagaaagaacgtttttcgttgaattttgaaaacgcttttgagaaaatgtaattgttctgatatcttttaaaaaaattgagaggccttcatgactaaatttattgttgattcatcgtactggaatttgtttccaacttctaaaattggagtaatcttaatcaaagattatcacatggacagaaaccttgaaacagaacttaaacagttactgtctgatagtcattctttagcaaaaaaatatttgcaagagaaagaattcagtcaaaacagagttatccaaacttatcgcaaagcatatcaaacctttaaaactaaaaaaggtgcacgttcaagtatcgaagcattattgaagcgagttaattcaggaaacgaaattactagtataaatcctctagttgatatctataatgccgctagccttaggtttggattacctattggtgctgaggatagtgatacatttagaggtgatttaaaactaactattaccaatggtggtgatgaattttacttgattggcgaagattttaacagaccaactctttcaggtgagcttgcctatgttgatgatgttggagcagtttgccgctgttttaattggcgtgatggaaaacgtactatgattaccgataatactcagaatgcttttttagttatcgaattaattgataatggaagagaaattatttttaaagaagcgttggactttatcgccaccaatacaaatcgttttctaaaagctaaaacacagaccatcatattagataaagaacacagtgaaataacgctataacattaaaacgaaaagtaaaaattttacttttcgttatttttttaggttaataatttctcactttccaacgataaaagaaagaaattgtatagaaatcgctttcatttctataaatttaaatttttttggatataatcgtgacattcttaacacttttaatgcgaataacttccctattttatattcaaaagaaagtagaatgtaaatgtagatatagagataaatcctgtttcaatacaaatctctaactaagaaaggagtaaaatatgactcaaacacatccaattcatgttttctcagaaattggaaaacttaaaaaagttatgctacaccgtccaggtaaagaaatagaaaatctgatgcctgattatttagagagactcttgtttgatgatatcccatttttggaagatgcacaaaaagaacacgatgcgtttgcacaagcacttcgcaacgaaggagtcgaagtactttaccttgaaaatcttgctgccgagtcgttaacaaaccaagaaattcgtgaacagtttatcgatgagtacattggcgaagcaaatgttcgcggtcgtgctactaaaaaagctattcgagaattattactcaatatcaaagataataaagaacttatcgaaaaaactatggcaggtatccaaaagtctgagctacctgaaatcccatcttctgaaaaaggtctaactgatcttgtcgaatctaattatccatttgccatagatccgatgccaaatctttactttacacgtgatccatttgcaactattgggaatggagtttcattaaatcatatgttctctgaaacacgtaatcgcgaaactttatacggtaaatatatctttacacatcacccagagtacggtggaaaagtccctatggtctatgaacgtgaagaaacaactcgtattgaaggtggagatgagcttgtcctttctaaagatgtccttgccgttggtatctctcaacgtactgatgctgcctctattgaaaaactcttagtcaatatttttaaacaaaatttaggttttaaaaaggttttagcatttgaatttgcaaataatcgtaaatttatgcaccttgacacagtctttacaatggttgactatgacaagtttacaattcacccagaaattgaaggcgatcttcgcgtttactctgtaacttacgaaaaccaagatcttcatattgaagaagaaaaaggtgatttggcagatcttctagcgaaaaacctaggagttgagaaagtggaattgattcgttgtgggggtgacaacttagtcgctgctggacgtgaacaatggaatgatggttcaaatacattaactatagcaccaggtgtcgttatcgtttacaacagaaatacaatcacaaatgcaatcttagagtccaaaggattgaaattaattaagattaatggaagtgaattagttcgtgggcgtggtggaccacgctgcatgtcaatgccatttgaacgtgaagacctttaaaatttatgaagctattagtcaatcacttgccttaccaaagagctgcaagcctatatattcgcttttctgttttcgttatcgaaagaaatataaaaatggaagaagaattcgatgataatgacgagcaagatactatttatgctgttctttatgatgggaaacagccagtttcaacaggacgctttcttcctgaaactcaaacagaagctcgtttgactcgaattgcgactttaaaaggttatcgtggtaacggctatggtaccaaaattattatagcactagaaaattatgcaaaagaaaatggttatcactatctaactatacatgctgaattgacagcaaaagatttctaccagacacttgggtatcaagctactgggaatatttatatggaagacggggaagcctgtcaaacactcgaaaaatatttaatttaaaggagacattaacatatgacacaagtatttcaaggacgtagtttcttagcagaaaaagatttttctcgtgaggaatttgaatatcttattgatttttcagctcatttaaaagaccttaaaaaacgtggtgttcctcatcattatcttgaaggtaaaaatattgctctcttatttgaaaaaacatctactcgtactcgcgcagcctttacaactgcagcaattgacctaggcgctcatccggaataccttggtgcaaatgatattcaacttggtaaaaaagaatcaacagaagatactgctaaggttttaggacgtatgtttgatggtattgaattccgtggttttagccaaagaatggttgaagagcttgctgaattttctggagtacctgtctggaatggtttaacagatgaatggcatccaacacaaatgctagctgactaccttactatcaaagaaaacttcggtaaacttgaaggtattactcttgtttactgtggtgacggacgtaacaatgttgccaactcgcttttagtggctgggactttgatgggggtcaatgtacacatcttttctccaaaagaacttttccctgctgaagagattgttaaattggctgaagaatatgccaaagagtccggggctcacgttctcgttactgataatgtagacgaagctgtaaagggagcagatgtcttttacactgatgtctgggtatcgatgggagaagaagataagttcaaagaacgcgttgaacttcttcaaccatatcaagtaaacatggaactgattaaaaaagctaataatgataatcttatcttcttacactgcttacctgcattccatgatacaaataccgtttacggcaaagacgtcgctgaaaaatttggcgtcaaggaaatggaagttactgatgaagtcttccgtagcaaatatgctcgtcatttcgaccaagctgaaaatcgtatgcacactattaaagctgtaatggctgcaacccttggaaatcttttcattccaaaagtttaaattaaacgactatagggagttgacatatagtcaattccctattttaggaaatgaggtataaaatggaaaaagaaaaaaaattaggtcttttaccactaacaatgcttgtcattggctctcttatcggtggcggaatctttgatttaatgcaaaatatgagttccagagccggtttggtaccaatgcttattgcttgggtaattactgctatcgggatggggactttcgttttaagttttcaaaatttatctgaaaaaaggccggacctaacagctggaatctttagttacgctaaagaggggtttggaaactttatgggatttaactctgcatggggttattggttatcagcttggcttggaaatgttgcctacgctgcactcttattcagttcactcggttatttctttaaattctttggtaatggaaataatatcatctcaattattggagcaagtatagttatttgggttgtccatttcttaattttaagaggtgttaatacagctgcatttattaataccatagttacctttgcaaaattagtacctgttattattttcttaatttcagcgttattagctttcaaatttaacatttttagtcttgatatctggggaaatggattacatcaatcaattttcaaccaagtcaattcaactatgaaaaccgctgtttgggtatttattggtattgagggcgccgttgtcttctcaggtcgtgctaaaaaacactctgatattggtaaagcaagtatcctagcattattcactatgatttcactttatgtattgatttctgttttatcacttggtatcatgtcacgtccagaacttgcaaacttaaaaacaccagctatggcttacgttctagaaaaggctgttggtcactggggcgctatcttagttaaccttggtgttatcatttcagtatttggcgctattcttgcttggactttatttgcagcagaattaccatatcaagctgctaaagaaggtgcttttcctaaattctttgcaaaagaaaataaaaacaaagctccaatcaattcactcttagtcactaatctttgtgtacaagcattcttaatcacgttcttattcacacaaagtgcttatcgttttggtttcgcattagcatcatctgctatcttaattccttatgcttttacagcactatatcaattacaattcacactccgtgaggataagtcaactccaggacatcaaaagaatttaattatcggtatcctcgctacaatctatgctgtttaccttatctacgctggtggttttgattacttacttttgacaatgattgcttacactctaggtatgattctctatattaaaatgagaaaagatgacaagcttcctatctttgtgggatatgaaaaaattagtgccattgtcattctagcgctttgcttattatgtattattgaaattatgactggacaaattgacattgctgcaatcctagcaggttagtcattagaaagagggataaattggtaaaagaacatcaaaaaatcgtagttgccttaggtggcaacgctattctatcaacagatgcttcagcaaaagcacaacaagaagcattaatcaacacatcaaaatcactggtcaaactgattaaagaaggccatgatgtcattgttactcatggaaatggtccccaagttggtaacttattgctacagcaagcagcttcagattctgaaaagaatccagcaatgcctttggatacttgtgttgccatgacagaaggaagtattggtttttggttacaaaatgctcttaacaatgaattacaagaacaaggcattgacaaagaggttgcaacagtggtaactcaagttattgtagatgaaaaagatcaagctttcactaatccaacaaaacctattggcccattcttatctgaagaagatgccaagaaacaagcccaagaaacaggttcaaaatttaaagaagatgctggccgtggatggcgtaaagtcgttccttcaccaaaaccggttggtatcaaagaagcttctgttattagacggttagtggactctggtgtggttgttattagcgcaggtggcggaggtgtaccagttattgaagatgctaatacaaaggcattaaaaggggttgaagctgttattgacaaagactttgccagtcaaactttatcagaacttgttgatgctgacttattcatcgtcttaactggcgttgacaacgtttttgttaattttaataaacctaatcaagaaaaattagaagaagttactgtttcacaaatgaaacaatatatcactgaaaatcaatttgcccctggaagtatgctaccaaaggtcgaagctgcgattgcttttgttgaaaataaacctgaatcacgagctattattacttcacttgaaaatattgataatgttttagcccaaaatgcagggacacaaattgttgcaaattaaacaatgtagattaccattacatacactccttattaatgtcactccttaggcattcctataataaaagagagctagatatatctagctctcttttattataggacatatattatttaaaatagttcaaacccatggctgatttaacctcatccaaagtagaggctgcaacagcttgagctttctcactacctttttgtaacatttgataaacttgtcccatatctttagcatattcgaggcgacgttctctaataggtgataattcacgctctaagatatcaagtagataacgttttgttttaacatccccaagtccacctttttgatagtgttctttcatagcagtaatctctttttggtcttcatctcttccaaaaacatcaaggtaatgaaataccatattaccttcgatttgtcctggttcttctactttaatgtggtttggatcagtatacatactcataacttttttcttaactgtatccatatcatctgctaaaaagattccattatttaatgacttagacatttttgcattaccatctaaccctggcagacgacctgctgcatcattttctggatagattccctctggttcaactaaaacctgacaattataagcatgattgaaagatctaactatttcacgtgtttgttcaatcattggtttttggtcagtccctacaggaacaaggttagctttaaaagcggttatatcagctgcttgtgcaacaggataaactaagaatcctgctggaatagactcaccaaaacctttttgagcaatttctgtttttacagttggattacgttctaaacgtgcaagtgaaaccaagttcatataatacatacttaattctgctaactcaggaatttgactttgaatgaataaagtcgacttgtttggatctaacccaacagctaaataatcaagtgcaacattaccaattgattcaacaatagtttgcggatctttagcatggtctgtcagtgcttgttggtctgctaaaaagacaaataaagtatagctaccctcattttgaagtagaactctattttttaagctacctacataatgtccaatatgcaactttcctgtcggtctatcacctgttaagataattggttttgtcatgtttactccttaatataccaaagatatcatttcatatagttatcttatcatgtcacaagccctattgcaattcatccctacaagaaacattcaccttattaagatgattaaacattatgtaacgttaaatcgttcttaataatttcaatcgtataatgaatcataataattaaaagcgttatcgtcacacctaaaatagctctatatgcaaaaatatcgtaaactattgcagctaccaatgctccaataataaatgctagaactaccagtgaataattgatagctcgtcttttttgcatagccgttctctgacgattaacaatatactcataccaaaattgtagcattttccgataattaccagaagtcattaagatagtatatggttccgattcaatgcgacttcctgaaaatgtcaacattaaaatacctgtgctaaaggctaataaagctacccagatattgtggtttacattttcaacaaaaggaataaacatcgtagaaagtaaaaggggacataatgcatatagacgccaaaaagctgttactgcacgttctttaatcacaataccaaccaaaaaaccaattgaaaaaaagaaaatagaaaataatttagtgataaaaaagtgaaaatcattttgtccgagatttgccaccatcaagataatattacctgtctgtgttgcaacaagggagtgaaactgcatgtgactataaacgtcaataaaaccaccaataaaacccaataatacagccatttttcttccatcttgtggcattataatatcatctctgcgcattatagcaaattctccttcttgtattatcatgttttctattatataccaataaaataggcattcaactcaaaaatatcgagaaatttcttttctaaatttacttgactaccaagtctcgctgttagataataggtaataataagttttgataaaataaaaatgttatgactgagttgtcaatattatttattgacagctttctctttttatcatgttattattactaaagttaaggagcttatcatgtctaaaaaaattaagaattttatactattaaatattggatctctaattgttgcatttggtttcaacgctttctttcttcataatcatattgtcacgggggggattagtggtttggcagttagttttcatgaagtatttggttgggattctgctttttttattatgattatcaatattccattgctccttctttgctactttggcttaggtaaacaaacctttttaaaaactgtctatggttcttggatttttcctgtttttattaagttaacacaaagtgtaccaactttgacccacaacccactcctcgcagcactttttggaggtgttattgtaggatgtggtttggggattgttttttggagcgactcttcaactggtggaacggggattatcattcaattcttaggaaaatatactcctataagccttggacaaggggttatattgattgatggacttgttacaattgttggtttcctagcttttgacagtgatacggttatgttttctattattgggttgataactattagttatattattaatgctatccaaactggatttacaaccttaagcactgtcttaatcgtttctcaagagcaccaaaaaattaagacatatatcaatactgtcgcagatagaggagtaacagaaattcccgttaaagggggatattctggaactaatcaaatcatgcttatgacaactattgctggttatgagtttgctaaattacaagaggcaatagcagaaattgacgaaacagccttcataacagtaactccaacatcacaagcttctggacgtggatttagtcttcaaaaaaatcatggacgtcttgatgaagacattcttatgccaatgtaatcgattgataattaaagctttttctagtagaatagcagatagaatatacacaagaggtaacaaaattgcttacagtttcagatgtttcactacgttttagtgatcgcaaattatttgatgaagttaacattaactttacagcaggaaatacctatggtcttatcggagcaaatggcgctggtaaatcaactttccttaaaattttagctggtgatattgaaccaacaacaggacatattgcacttggcccagatgaacgcctttctgtacttcgccaaaatcattttgattatgaagatgagcgcgtcattgatgtcgttatcatgggtaatgaaacactttatagtatcatgaaagaaaaggatgctatctacatgaaagaagatttttctgatgaagatggtgttcgcgctgcggaattagaaggagaatttgctgaactcggtggatgggaggctgaaagtgaggcttctcaattactccaaaatctaaatatttcagaagagcttcattatcaaaatatgagtgaactagctaatggagacaaagttaaagttctccttgcaaaagctctctttggtaaaccagatgtacttctccttgacgagcctaccaatggacttgatatccagtctattacttggttagaagatttcttgattgactttgaaaatacagttattgtagtttcccacgaccgtcatttcttgaataaagtatgtacacatatggctgaccttgattttggaaaaattaaactgttcgtcggtaactatgatttctggaaagaatcatcagaattagcagctcgtttacaagctgatcgtaatgctaaagcagaagaaaaaattaaacaacttcaagaattcgttgcacgattttcagcgaatgcttcaaaatcaaaacaagcaacttctcgtaaaaaaatgcttgataaaattgaacttgaagagattgtaccatcaagccgtaaatacccattcgttaactttaaagccgaacgcgaaatgggaaatgatttattgaccgttgaaaatctctctgtcactattgatggggaaaaaatccttgataatatcagtttcattcttcgtcctggtgataaaactgcacttattggacaaaatgatatccaaactactgcacttattcgagcattgatgggggatatcgaatatgaaggaacaatcaaatggggagtaacaactagtcgttcttaccttccaaaagacaattcacgagattttgcttctggcgagtcaatcttagaatggcttcgtcaatttgctagtaaagaagaagacgataataccttcttacgtggtttcctaggtcgtatgcttttctctggagatgaggttaacaaatctgttaatgtcttatctgggggtgaaaaagtacgcgttatgctttcgaaattaatgctattaaaatctaatgttcttgttcttgatgatccaacaaaccacttagatttggaatctatttcaagtctcaacgatggactaaaagatttcaaagaatctattatttttgcaagtcatgaccacgagtttattcaaactttagcgaaccatattattgttctttctaaaaacggagttatcgatcgtatcgatgaaacttacgatgaatttcttgaaaataccgaagtacaagctaaggtcgctcaactctggaaataatcctttggcatatctctaacctaataaacgtgtcaagattgaaaatcttaaaactatattaatcatttaaataaaaaggttggaacaaatagtgtccagcctttttatcttaggagatatatatgacaattaaccactataagcttcgtataccttactatacaataagctttctacttcccttcataatcatagtctgtatcctctttactaagaatatttattggggaagtccaacaaccatattagcaagcgatggctttcatcaatatgttatctttaatcaagcattaagaaatattcttcatggttcaaacagcttattctatacctttacaagcggtttaggtttaaatttttatgctctgagtagttactatttgggaagttttttatccccaatagtttatttctttaacctaaaaaatatgcctgatgctatctaccttttaacaatatgtaaaatagggttgataggtttgtcaatgtttgtcactctttgtaaacgtcattgtaaagttaatcgtgtcttacttttagtaatttctacttgctatagcttaatgagtttctcaattagccaaattgaaattaatatgtggctagatgtatttattctaattccccttgttgttttaggagttgatcagctactatgggaaagaaaacctatactttatttcctctctctgacagccttattcatccaaaactattattttggttttatgactgccatctttactagcctttacttcatcgtacaaataacccgtaatactgatagtaaggttgcatttaaacaatttcttcattttacctttttatctcttttagctggtatgactagtagcattatgattttgccaacttattttgatttaactactcatggtgaaaagttgacaaaggtatcgaagatgtttacagaaaattcttggtacatggatttgtttgctaaaaatatgattggagcctatgatacaacaaaatttggctctattcctatgatttatgtaggtttacttcctttactcctttctttactttactttacaataaaggaagttcctcgaaggactagattagcatatggatttttaataatatttgttattgctagtttttatataacacctctagatttattttggcaagggatgcatgctccaaatatgtttctccatcgctactcttgggtactttcagtacttatctgtctgctagctgctgaatgccttgagtatttagacaacatttcttggaaaaagattttaggggtcaatttaattttagtaagtggtttcataatcacgtttttatttaaaaagcattatcattaccttaatcttgaattacttcttttaaccttaactttcctctcagcttatattattctaactattagttttgtcagtaagcaaatccctaaattagttttttatccctttcttattggttttgttgtattagagatgacattaaacaccttttaccaactaaatagtcttaacgatgaatggatatttccatctaggcaaggatatgctaaatataatcacagcattagcaaacttgtcagaaagactgagagaaataactctacattcttccgtacagagcgctggttaggacaaaccggcaacgactctatgaaatataattataatggtatttcacaattttcatctattagaaatcgttcttcaagtcaagtgcttgatagacttggctttaaatcagatggtacaaatttaaatttacgttatcaaaataatactttgatcgcagatagtctatttggtgtgaagtataaccttacagaatatccttttgataaatttggttttatcaaaaaagctcaagataaacaaaccattctttacaaaaatcagtttgccagtcaattagctatactaacgaatcaagtatatcaagataaaccatttactgtgaatactttggataatcagacaactcttttaaatcaattaagtggtttgaaagagacgtattttgagcatcttattccaaatagcgtttctgggcaaaccactcttaataaacaagtatttgttaaaaagaataaacaagggaatactgaaattacctataacataactatccctaaaaacagtcagttatatgttagtatgccgtttataaattttaataatgaggaaaataaaattgttcaaatctccgttaataatggaccatttgtacctaatactcttgataatgcttattcattttttaatattggttcctttgctgaaaacagtcgtatcaaagtaaaatttcaatttccacacaatgatcaagtttctttcccaattcctcacttttatgggctcaagttagaagcttatcaaaaagctatgactgttattaataaacgaaaagtaaaagtaagaactgatcacaataaagttattgctaattatacaagtcctaatagaagttctcttttcttcactattccctatgataggggttggaaagcttatcaaaataataaagaaataaaaattttcaaagctcagaaaggttttatgaaaataaatattcctaaaggaaaaggcaaagtaacattaatttttatcccttacggctttaaatttggggtaggcctatctattactggaatagtattatttactgtctattattttaaatttggaaaaaataaaataggatgagagtattctcatcctattttattaacaaaaaaacgccgacaaatcaacgtttagatgtgtcttatcactccggcagcaggactcgaacctgcgacatcatgattaacagtcatgcgctactaccaactgagctatgccggataaataaaaaactgcaaagcagttatcaatagtccgtacgggattcgaacccgtgttaccgccgtgaaaaggcggtgtcttaaccccttgaccaacggaccataggttaggtgtttccttagtactcttaatattatatcagaaaaaaaaggtttgtctatacttttgttcaataatttttacaaaaaaattgaacctacttatgagcaaaaaaatatatttccaactcataaatagtacatatgaaaacttgacagcctgcctaatattttggtagaataacagagttgatggttccatagctcagctggatagagcattcgccttctaagcgaacggtcgcaggttcgaatcctgctggaatcagatattgaaagcctagatagattatctaggctttttatttgtttttagcagttgtttcataaatggaacgattatttgtggtaaggagtgccttgacgaatcataaaagcacgataaatttgttccatcaagactaatttcataagttgatgaggtaaggttaacagtccaaaactcattaaataatcagcacgttttttcactttttgagataaacccaaactaccaccaataacaaaagtaatagtagagtagccggatatcattttttgatcgattagatggctaaatgattcagatggcaattgtttcccttctatagctaaaccaatgacataatccctctcacctattttactcaaaatacgttccccttctatatctaaaattctttgattttcagatatactagctttatcaggtgtcttttcatcagctagctcaattgtctcaattttagaaaagcgattcagacgtttctgatactctgcaacaccttctttaaggtatttctctttcaattttccaactgtaattatttttaatttcatagctacattataacataatccacaatattttcacaatttatccacatgtttatccttacatatccccttattttataggtattctataactataatcaaggttatccacaagttgtggatatttcctttttttagcttttaaggtataattaagaagcttgtcataagattagtataaaaatttacggaggtagctatttgtgaaaaaaaaattagtctcatcacttctaaagtgttctctaatcattattgttagctttgctggtggagcatttgctagttttgtcatgaatcataatgacaatattccaaatggtggtgtcactaaaactagtaaagtaaattataataacataacgcctacaacaaaagctgttaaaaaggtacaaaatagtgttgtttctgttatcaattataaacaacaagagagtcgttctgacctatcagacttctatagtcatttttttggtaatcaggggggcaacactgataagggcttacaagtttacggtgaaggctctggagtcatctataaaaaagatggtaaaaatgcctatgttgtcactaataaccacgtcattgatggggctaaacaaattgaaattcaactagctgatggctcaaaagcagttgggaaacttgttgggtcagatacctactctgatttagccgtcgtcaaaattccatcagataaggtttcaaatattgcagaatttgctgattcatcaaaactcaacattggtgaaactgctatagcgatcggaagccctcttggaactgagtatgcaaattctgtaactcaaggtattgtatctagtttaaaaagaactgtaacaatgactaatgaagaaggacaaacagtttctacaaatgctatccagactgatgctgctatcaatcctggtaattcaggtggagcacttatcaatattgaaggacaggttattggaattaattctagtaaaatttcttctacatcaaatcaaacctcaggacaatcgtcaggaaatagcgttgaaggtatgggatttgccattccttcaaatgatgttgttaagattatcaatcaacttgagagtaacggacaagtagagagacctgctctaggtatttctatggctggattaagtaatttaccatccgatgttattagtaaactgaaaatcccaagtaatgttactaatggtattgtagtagcatctatccaatctggcatgccagctcaaggcaaactaaagaaatacgatgtcattactaaagttgacgataaagaagtagtatctccaagtgatttacaaagtttactctatggccaccaggtaggggattccataacagtaaccttttatcgtggtgaaaataaacaaacagtcactataaaacttactaaaactagtaaagatttagctaaacaacgagcaaataactaaatcaattctagttattttaactaagatatagtaaaattaaaggggttggtcagatagaccaatccctttagtaagtctatagaatctgaggtctaaaatggaatatttagaaacgatcaacatcaatcatattgctccaaatccgtatcaacctcgcctagaatttaatacaaaagaactagaagaattagccaactctattaaaattaatggccttatccaacccattattgtaagaccgtcagcagtctttggttacgaactggtagccggagaacgacggctaagagccgcaaagttagctaaattggaaagtatacctgcaattataaaatcctataataatgatgatagtatgcaattagctattgtcgaaaatttacaacgatctaatttgtcacctattgaagaggctaaagcctactctcaacttctacaaaagaaaagtatgacacatgaagagttagcaaaatatatgggaaaatctcgtccctatatatcaaatacgatacgactactaaatttaccgccactaattacttcagctattgaagaaggaaaactttcctctggtcatgcgcgtgcactactcagtctaccagatgctagtcaacagaaagattggtatcagagaatcctcactgaagatattagtgtaagacgactagagaagttattaaaacaagaaaagaaaacaaatcataagtcacttcaaaataaagatgtctttctaaaacatcaagaaaatgagttagctcaatttctaggtagcaaagtgaaacttactattaataaagatggtgctggcaatataaagattgctttcgctaaccaagaagaattaaacagaattatcaacactctaaaataagggtgttgattatttttttatttaatcaaacttatccacaaggtattttgctatttttctgttgattctctaatttccacagtctgtggaaaactttaattaacattgttgattttattcttcaacatctgtggaaaactttatttttttatggtacaatataacaataattatccacaagacaataaggaagaagctatgacggaaaacgaacaactattttggaatagagtactagagctatctcgttctcaaatagcaccagcagcttatgaattttttgttctagaggctagactcctcaaaattgaacatcaaactgcagttattactttagataacattgaaatgaaaaagctattctgggaacaaaatttggggcctgttatcctaacagctggttttgaaattttcaatgctgaaattacagctaactatgtctcaaacgatttacatttacaagaaactagtttttctaactaccagcaatctagcaatgaagtaaatactttaccaattagaaaaatcgactctaaccttaaagagaaatatacttttgctaattttgttcaaggagatgaaaatagatgggctgtttcagcatcaattgctgtagctgatagtcctggcacgacttataatcctctatttatctgggggggacctggtctaggaaagacgcatctactaaatgctattggaaatcaagtcttaagagataatccaaacgcgagggttttatacatcactgctgagaattttattaatgaatttgtcagtcatattcgtttagattcgatggaagaattaaaagaaaagtttcgcaacttagacttactcctgattgatgatattcagtcgcttgctaagaaaaccttaggggggacccaagaggagttcttcaatactttcaatgctttacatacaaacgataaacaaatcgtattgaccagtgaccgaaatccaaatcaattaaatgatctagaagaacgtctagtcacgcgctttagttggggactcccagtaaatatcacaccacctgattttgaaacacgagttgctattttaaccaataaaattcaagaatatccttatgattttcctcaagataccattgaatacttagcaggagaatttgattccaacgtacgtgaattagaaggagccttgaaaaatattagtctagttgctgactttaagcatgctaaaactattacagtagatatagctgcagaagctatcagagcacgtaaaaatgatggtcctattgttactgtcattcctatagaagaaattcaaatacaagttggtaaattctatggcgtaactgtaaaagagataaaagcaactaaaagaacacaagatattgtccttgcaagacaggtagccatgtacttagctcgtgagatgacagataacagtctcccaaaaataggtaaagaatttgggggacgagatcactcaactgttctccacgcttataataaaataaaaaatatggttgctcaagatgacaacttacgaattgagatagaaactatcaaaaataaaatcagataggctttgtggataagtatcagaaaaatacgagacttttccacaggttgtgaacaagttattttccttatgaatattaaagttataatacttattcacaactttaacaggacctactattactactaaatttatactaatatataaaggatatactatgattcatttttcaataaataaaaatttcttcttgcatgctctaacggtaaccaaacgagctattagtcataaaaatgcgattccaatcctttcaactgttaaaatagaagtgactagggatgctatcattttaacggggtcaaatggacaaatttcaattgaaaatactattcctgcttcaaatgaaaatgcaggtttactagtaacgaatccaggctctattttgttagaagctggtttctttattaatattatttcaagtttaccagatgtaactttagaatttacagagattgaacaacatcaaattgttcttactagtggaaaatcagagattactttgaaaggtaaggatgtcgatcaataccctcgtctgcaggaaatgacaacagatactccattaacattagaaactaaactgttaaaatcaattattaatgaaactgcttttgctgctagccaacaagaaagccgtccaatcttaacaggtgttcatttggttatcagtcaaaataaatactttaaggctgttgcgacagattcacaccgtatgagtcaacgcactttccaattagagaaatcggctaataattttgatttggttgttccaagtaaatcccttcgagaattttcggctgtttttacagatgatattgaaactgtagaggttttcttctcagatagtcaaatgttatttagaagtgaaaatatcagcttctatacacgtttgcttgaaggaaactaccctgatactgatcgcctcctaactaatcagtttgaaaccgaaattatctttaatacaaatgctttacgccatgctatggaacgtgcttatttaatttcgaatgcaactcagaacggtactgttcgtttagaaattcaaaatgagacagtctcagctcatgtaaactctccagaagttggtaaagttaatgaggaattggatactgttagtcttaaaggtgatagtttaaatattagctttaatccaacttacctaattgaatctttaaaagcagtaaaaagcgaaacagttacgattcgatttatttctccagtacgtccatttactttgacacctggtgaagatactgaagatttcatccaattaataactcctgttcgtactaactaaataagaaaactacccaagttattcttgggtagttttcttattctaagatatgctataatgatgagtaatatgactctatatataatagctaacccccatgctggtaataaaaatgcctccactattgttggtaaaattcaggagctttatcatactgaagatatttctgtgttctatacagaacagaaagatgatgaaaaaaaacaagtcattaatatactaaggtcttttaaagaaagtgatcatctaatgattataggaggagatggtaccttatcaaaagtaatgacttatctcccccaacatattccgtgcacttattatcctgttggttcgggaaatgattttgccagagctttgaaaattcctaacctcaaagaaacccttaccgctattcagacagaaagattaaaggaaattaattgctttatttatgataaagggctgattttgaatagtttagatttaggttttgcagcctatgtcgtttggaaagcatctaactctaaaataaaaaatattttgaatagatatcgtctaggaaaaataacttacattgttatagctatcaaatcattattacattcttctaaagtacaagtattagtggaaggagagacaggacagcagataaaactaaatgacctttattttttcgcattagcaaataacacttattttggaggtggcattactatttggcctaaagcaagtgctttaactgcagagttagatatggtttacgctaaagggcatacttttctaaaacgattaagtattttattatctttggtttttaaaaggcatactacctctaaaagtataaaacaccagactttcaaagctatgaccgtatattttcctaaaaatagtttgattgaaatagatggcgaaatagttgagttagatcagattagtttaaaatgtcaaaaaaggtatttatatatgtaaggagaaaagatgtatcaagttggatcacttgttgaaatgaaaaaacctcatgcttgtgtaattaaagaaactggtaaaaaggctaatcaatggaaggtactgagagtaggagctgatattaaaattcagtgtactaactgtcagcatgtgattatgatgagtcgttatgattttgagcgaaaattaaaaaaagtactgcaaccatgaaagtccttttaaacaaataattatagctatatttgcaaccaatactttcctaaataatgctagtatgccgttggaaaattagctattctaatgttatcgaaagaagaaaggtggtcattgacaatgacgaaagttgcagaacagttatttatttttcggtaagtcatatcaaaatgggaaaatggggataccacaccagatttggataatttaatcaggttagctgagatttttgacgtgagcttagatgaacatgttttagctaaaacaaatgaagttaaagttgaacgtatttatgaaaataaaccccttgatctacgaaaatacaataaaatttattggtttatttttcgaaatattattcgatctctactaattattttagctatattaactttcttataagctctaggtattccctttgtttcggagtggataatttaaatgaaggtgaaagagtggcataatgataagcaaatctgaaattttcttcttatcataccgctttttcttctattttttgatataatagtcttgattgaaatttgaatggagactcactaaatggctttaacagcaggtattgtaggcttaccaaatgttggtaaatcaactttatttaacgcaattacaaaagcaggagcagaagctgctaattatccttttgcgactattgatcccaatgttggtatggtagaagtaccagatgagcgtctacaaaaattgacagaattgattacgcctaaaaaaacagttccgacaacctttgaatttactgatattgcaggtattgttaaaggtgcttcgaagggggaaggtctaggtaataaatttttagctaatattcgtgaagtggatgctattgttcatgtggtacgtgcgtttgatgatgaaaatgttatgcgtgaacaaggtcgtgaggatgctttcgttgatcctatagcagatattgatactattaatcttgaattaatcttagctgatttagagtcaatcaataaacgttatgcgcgtgttgaaaaaatggcacgaactcaaaaagataaagaatcagtagcagagttcaatgttttacaaaagattaaacctgttttggaagatgggaaatcagctcgtaccattgagtttacagaagaggaagcaaaagttgttaaaggtctttttttattaacaactaaacctgttttatatgttgctaatgttgatgaggacaaagtagctgatcctgatgatatcgactatgttaatcaaattcgtgcatttgcagaaacagagaatgcagaagtagtcgtgatttctgctcgagctgaagaagaaatatctgaacttgatgatgaagataagttagaatttttagaagctattggattaacagaatctggtgttgataaattaacacgagctgcttatcatcttttaggccttggaacttactttactgctggtgaaaaagaggttcgcgcttggacgtttaagcgtggtataaaagctccacaagctgctagtattatccattcagattttgaaagaggttttattcgtgcagtaacgatgtcatatgatgaccttattcaatatggatctgaaaaagcagtaaaagaagctggccggttacgtgaagaaggaaaagagtatattgttcaagatggcgatatcatggaattccgtttcaatgtctagtaataaataatcgatttgttaacttttaggttaaggatattgttaatatccttaaccatttttgcgttttaatggagaagataatggtaaaaatgattgttggattaggaaatccaggaagtaaatataatgatacaaaacataatattggatttatggctgttgacagaattgtaaaagaccttgacgtcaactttacagaagataaaaattttaaagcagagataggtagtgattttatcaacggtgaaaaaatttattttatcaaaccgactacttttatgaataacagtggtattgctgtaaaagccctgcttacttactacaacatttctattaaggatatgattatcatatatgatgatttagacatggaagtcggtaaaatacgttttcgtcaaaaaggatctgctgggggacataatggtatcaagtctattattgctcatttaggtactcaagaatttgatcgtattaaagtaggtataggacgtccgaatggacgtatgacagttattaatcatgttctagggaaatttgataaaaatgatgaaattatgatattaaatacccttgataaggttgacaatgctgtcaattattatttacagacgaatgattttcaaaaaacaatgcagaaatacaacggtttaaaatgaatattatagaattatttagccaaaataaagtggtgcggacatggcactctggattagtaactaatagtcgccaattagttatggggttttcaggagcaagtaaagctattgccatagcatcagcctacgagaagttatctaaaaaaattatggtagtcactgccactcaaaccgattctgataaattatcaagtgatatatcaagtttaattggagaagataacgtttatcaattttttgctgatgacgttcctgcagcagagtttattttctcttcattagataaatcaatttcacgactcagtgccctgaggtttctaaaagatccagaaaaaaacggtgttttgattactagtatcagtggtttaaggttactattaccaaatccggaagttttctcgaaaagtcaatataagtttgaaatcggtcaagaatgttatttagataaattgtgtaagaacctagtcaatttaggttatcagaaagtttctcaagtatttagtcctggtgaatttagccaaagaggagatattttagatatttttgagatgacacaagaatatccttatcgcttggaattcttcggagatgaaatagatggcatcaggcagtttgatattgacactcaaaagtctcttaaacaattagagtcagtacagatttcgccagcagatgatattattttacaagatgcagatttcgagcgtgcaaagaaaaaacttgagggctatctagtaacagctagtgaggtacaacgcacctatttgagcgaggttttatctacaactgagaatcattttaagcactcagatattcgtcgttttctaagtatcttttatgaaaaagaatggggaatattagactatattcctgagggaactccactttttgttgatgattttcaaaaaattgtagatcgaaatgctaagttagatttagaaatagctagccttctgacggaagatttacaacaaggcaagtctcattctagtttgaactatttttcagatccttataagcaattaagacaataccaaccagcaaccttcttttcaaatttccacaaaggattaggaaatctgaaatttgataaacttcatcattttactcaatatggaatgcaagaattttttaatcaatttccattgttggtcgatgaaatcaatcgttataagaaatctggagcgacagtactgttgcaagtagattctcaaaaaggtttaaatctccttcaagaaaatttaaaagaatatgggttagatttaatcatttcagataaaaacgatatcgttcaaaaggagtcacaacttattgttgggcatctttcaaatggtttttattttgcagatgagaaaattgttctgattactgaacgtgagatttatcataggcgtgttaaaaggaaaattagacgcagtaatattagtaatgcagaacgtctaaaagattataatgaactttcagttggcgattatgttgttcataatgttcatggcgtaggaaaatttttaggtattgaaacaattgagatacaaggtattcatcgtgattatctgactattcaatatcaaaatgctgatcgtatctctatccccgtagaacaaattgaacttctaacaaaatatgtctctgcagatggcaaagagcctaaaattaatacgttaaatgatggtcgcttcaaaaaagcaaaacagagagttgcaaagcaagtagaagatattgctgatgatttgttgaaactttatgcagagcgtagtcaattacaaggatttgcattttctcctgacgataatatgcaaaatgactttgataatgattttgcatatgtagagacagaggatcaattgcggtctataaaagaaattaaacaggatatggaaggtaatcgtccgatggatcgattattggttggagacgttggttttggtaagacagaggttgctatgcgtgcggctttcaaagctgtcaatgaccataaacaagttgttgttttagtcccaacaacagttctagcccagcagcattttgaaaattttaaagaacgttttagcaattatcctgttacagttgatgtacttagtcgttttcgtagcaaaaaagaacaaacagatacactaaaaagattatctaagggccaagttgatattattattggaacacatcgacttctctctcaagatgttgtattttcggatttagggttaatagttattgatgaggaacagcgatttggtgtaaagcataaagaaaagttaaaagaattaaaaacaaaagttgatgtattaactttgacagcgaccccaatacctagaacattacatatgtcaatgcttggcattagagacttatcagtcattgaaacacctccaactaatcgttatcctgtgcagacttacgttttggagacaaatcctggtttagttagagaagctattattcgtgagatagacagaggaggacaggttttttatgtttacaataaagttgacactattgatcagaaagtttcagaacttcaggagttagtaccagaagctagtattggttttgttcatggtcaaatgtctgaaattcaattagaaaatacattaatagactttatcaatggagattacgatgttttagttgcaacgacaataattgagacaggagtcgatatttcaaatgttaataccctctttgttgaaaatgcagatcatatgggcttgtcaaccctttatcaattaagaggccgtgtgggtagaagtaatcgcattgcttatgcttaccttatgtacagacctgataaagttttaacagaaatttctgagaaaagactagatgcaatcaaagggtttacagaattgggatctggttttaaaatagcgatgcgtgatttatctatacgtggtgcaggaaatattttaggagcttcacaaagtggttttattgattcggttggattcgagatgtattcacagcttctagagcaagcgattgccaccaaacaagggaaatcattaattcgtcaaaaaggtaatgctgaattagccttacaaattgacgcctatttaccagcagaatatatatcagatgagcgccaaaaaatagaaatatataagcgtattcgtgaattagaaactagggctgattatgaagccttacaagatgagttaatagatcgttttggagaatatcctgatcaagttgcataccttttagaaataggacttttaaaagcttatctggaccttgcctttactgaattagtagaaagaaaaggtaatgaaataagcatcctatttgaaaaagcatctttgaagtattttttaactcaagattattttgaagcactatcaaaaactcaacttaaggctagaattagcgaaacaaatggtaagatggaagttgtttttaatatcaaacataagaaaaattatgaaattattgaagaacttctaaaatttgccgaatgttttatcgagattaagtcacgtaaaccagtagaagaataactaagtgaaaagttgcaaggaaatttggatactcttttagaaaatgtttggttcaagaagaatagtacgagcaacattatgtttcacgtcaaacatctcaacttttgaaagacataaatatttttagaggttattaaaatagaagttttttacttgatatttgagagaattaagagagctattagctctctttttgttacattatattgacaaatattatcagttcagatatttttcaaaaaaaatgctaaaatagtagagttaatttagatagaaggatgtgatcatcagtgagattagacaagtatctaaaagtgtcgcgtatcattaagcgtcgtcccgttgctaaagaagttgcagacaaaggacgtgtcaaggtgaatggcgtattagcaaagtcatcaactgacctaaagcttaatgaccaagttgaaattcgttttggtaataaattgttgaccgttaaagtattagaaatgaaagatagcactaagaaagaagatgctatcaaaatgtatgaaattattaatgaaacaaggatagaaacagatgagcaagcctaatgttgttcagttaaataatcaatatattaacgatgagaatctaaaaaaacgttacgaagctgaggagttacgccgaaaaaatcgtttaatgggttgggttcttatttttgtcatgcttttatttattttacccacttataatttagttaagagttacagaactttacaagaacgtcgtcaagaagttgtaaaattaacgaaagactatcagacattaactaatagaactgagaaccagaagttgctagcaaaacaactaaaaaatccagattacgttcaaaaatatgctcgagctaagtattatttctctaagaccggcgaaatgatttacccattaccagaccttttaccaaaataattatgaataatttaattgaaacaatagaacattttctagcctactcggatgacaaactagaagaattagctgataagaactatcaacttaggcaaacaattgtagaaaaagaaaagattgagagcagagaaaagtaatgaagaaagttttaaccttcttattatgtagcttatattttgtatcaatcccagctataagtaccgaggagccattaacgctttctcaaaatagacgatacgccttaactcagacagttgtggataaggaaatgtattttgatgctattccagagagaccaactacaaaaattgaaataagcagttttcaagatgaagctttaaccataacaggagagactttagttccaaatactttattgtcgattgtttctcttacaattaattcaaatggaattccagtatttactttgtccaatggacagttcataaaggctagtcgtgaagctatttttaatgatttagtttctaagcagcaatctgtctcattggattattggttaaaaccttcttttgtgacttatgaagcaccttacacaaatggtgttagtgaagttaaaaataatttaaaaccttattccagagtgcatttagtagaacaagcagaaacagaacatggtatttattataaaacggacagtggtttttggatatcagtagaagatctatcggttgctgataatcgtatggctaaggttcaagaagtattattggaaaaatataataaagataaatatggtatatacatcaaacaattaaatacacagacagtagctggtattaatattgataggtcaatgtactctgcaagtattgcaaaattagcaacactttatgctagccaagagcaagtaaaattaggaaaactgtcattggacagcaaatttgaatacaaagataatgttaatcaatttcctaatagctatgatccaagtggtagtgggaaattagagaaaaaagctgatcataaattatataccgttaaggagttacttgaagcaactgccaaggaatcagataatgttgcaacaaatatgctaggttattatgtcaataatcaatatgattcaatgtttcaaacacaagtagacacaatttctggtatgcactgggatatgaaaaaacgccagatttctccacaagctgcgggtaaaatgatggaagcaatttattatcaaaatggagatattgttaattacctatcaaagactgattttgataatacaagaatccctaaaaatataccagttaaagtagcacataaaattggagatgcttatgactacaaacatgatgcggctattgtttatgcagaacaaccttttattatgattatctttacggataaatcatcttacgatgatatcactaagattgctgacgacgtttaccaggttttaaaataatatgtataacactattttgaaagataccttatccaaagggttatttaccgctcatcagaaagttctaattgctgtttctggtggcattgattcaataaatttgttgcaatttttataccagtatcaaaaagagttatcgattagtattggtattgcacacataaatcatggacagcgaaaagaatcagaaaaagaagaagaatatatcagacagtggggacagatacatgatgtccctgtctttatctcttattttcaaggaatattttcagaagatagagcacgtaaccatcgctacaattttttttcaaaagttatgcgtgaagaaggttacacggctttagtaacagctcaccatgctgatgatcaagctgaaactgtatttatgagaattttaagaggaagcaggctacgctatttatcagggattaagcaagtgagtgcttttgcaaacggtcaattgattagaccatttcttccatataaaaaggagttattaccaaatatttttcattttgaagatgctagcaacgcttcgtctgattatttaagaaatcgaataagaaacgtctactttcctgctttggaaagagaaaataatcaattgaaagattctctcataactctctctgaggaaacagagtgtttattcacggctttaacagacctaacaaggagcatcgaagtaacaaactgctatgattttttaaggcaaactcattctgtccaagaatttttattgcaagattacattagcaaatttccagatttacaagtgagtaaagaacagttcagagtaatattaaaattgattagaactaaagccaatattgactatactattaaatcgggctattttcttcataaggattacgagagttttcatattacaaaaatccatcctaagacggatagttttaaggttgaaaaaagattagaattgcataatatacaaatattctcacaatatttattttcctatggaaaattcatttctcaagcagacattactattcctatttatgatacttctccgattattttaagaagaagaaaagaaggggataggatatttttaggaaatcacactaaaaaaattcgccgtctatttattgatgagaaaataactctaaaagagagagaagaagctgttattggggagcaaaataaagagttgatatttgtgattgttgcaggtagaacatatttgagaaaaccttctgaacatgatataatgaagggcaaactttatattgaaaatttagaaaaaaggtgacatcatgcttgaaaatgatataaaaaaagttttatattcagaagaagatattattctgaaaacgaaagaattaggagctaaattaactgcagattatgcaggtaagaatccattattagtaggtgtattaaaggggtcagtgccttttatggctgagctattaaagcatattgatacacatgttgaaattgattttatggttgtttcaagctatcatggtggtacaactagtagtggagaagttaaaattttaaaagatgttgatactaacattgaaggaagagatgtaatctttattgaagacatcattgatactggacgtacattaaaataccttcgagatatgtttaagtatcgccaagctaactctgtcaaagttgcaaccctttttgataagccagaagggcgattggtagatattgatgctgattacgtttgttacgatatcccaaatgaatttattgtgggattcggtttagactatgctgaaaactatcgtaacttaccttatgttggtgtgttaaaagaagaaatttactcaaaatagaaaaaaggtactctcttaaactatgaaaaataataaaaataatggttttctgaaaaattcctttatttacatattattgattattgcggttattacaacctttcaatactatttaaaaggaactagctctcaaaaccagcaaatttcttatacaaaacttgttaaacaattaaaagctggagaaattaagtctatctcataccagccaagtggtggtgttgttgaagttagtgggacatataagaaagccaaaacaattaaatcagctaatagttttacttttttaggtggtagtgttgctactaaagttacaggatttaattctgttatactaccaaatgactcttcaataaaatctcttgttagcgctgctgaagaaaataacactaatattcaggtcaaacatgaaagttcaagtgggacatggatttcttatattgccagttttttacctttagttatcatgattggtttcttcatgatgatgatgaaccaaggcggtggcggtggcgctcgtggtgccatgagctttggtaaaaataaagcaagatcatctagtaaagatgaggttaaagttcgattttcggatgttgctggagcagaggaagaaaagcaagaattaatagaagtcgttgacttccttaaagatcctaaacgatataaatctctaggtgcccgaattccagcaggggttctattagaaggacctccagggacaggtaaaaccctattagcaaaagctgttgccggtgaagcaggggttccattctttagtatttccggttcagattttgttgaaatgtttgtcggtgttggagctagtcgagtacgctctttgtttgaagatgctaaaaaagctgaacgtgctattattttcattgatgaaattgatgctgttggacgtcgacgtggagctggtatgggtggcggaaacgatgaacgtgaacaaacgctcaaccaacttttaattgaaatggatggttttgaaggaaacgaaagtattatcgttatcgctgctaccaaccgtagtgatgtgttagatcccgcattactgcgtccaggacgttttgatagaaaagttctagttggacaacctgatgtaaaaggtcgtgaagcaattctgagagtacatgctaaaaataaaccattagcagataatgttgacttaaaagtagtagctcaacaaaccccaggatttgttggtgctgatttggagaatgttctcaatgaagctgctttagttgctgcgcgacgaaataaaaaagttattgatgcttcagatattgatgaagcagaagaccgtgtaattgctggtccttctaaaaaagatcgtactatttctgaaagagaaagagctatggttgcttaccatgaagctgggcacacaattgtcggtttgattctttcaaatgcgcgagttgttcataaagttactatcgtaccacgtggtcgtgcaggtggatatatgattgctttacctaaagaagatcaaatgcttctttcaaaagatgatatgaaagagcaattagcaggtcttatgggaggacgtgtagcggaagaaattattttcaacgctcagacaacaggtgcctcaaatgacttcgaacaagccactgctatggcccgcgctatggtaactgaatatggtatgagcgagaaacttggaccagttcaatacgaaggcaaccacgcaatgatggctggtcaaatgtcacctgaaaaatcatattctgctcaaactgcacaacttattgatgatgaagttcgtcaccttcttaatgaagcacgtaataaggcagctgatattatcaacgaaaaccgtgatactcataaattaattgcagaagccctcttaaaatatgagactcttgatgctgctcagattaaatcgatttttgagacaggtaaaatgcctgagacagaaaatgatgaagataaagcaagagcgttatcatacgatgaaatcaaagaaaaaatgcaagaagaagataaaaaataagtcatcatatatttttaaagaactttataaatttcaaatacccttcaaatttagataaaatttgaagggtattttttatgaagatgaagtttaaatttgtgaattaagaagatgaaatatgaacatgacaacggtaaaaatgctatccattcaacaagtatagaaggttagttactataaataatattaactttttaaaaataaaagaaaaaatgcaaaaatagtattgacaggaagtagaaatatttagtataatgaataagttgtctcgagagagcagcttctagtaacgcgtagttaacaacttaaaaaaaagtagttgacaaagcagaataagtttgctagaatatagaagttgtctcaagagaggcaaagacctttgaaaactgaacaagacgaacgaatgtgcagggtggatttacattgtaaatccgtcaatgacaaaaaaacaataaatctgtcagcgagacagaaaagagcaaagctcaaacttttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggataaggaaacctgccatttgcgtcttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattgtagaaagtaacaagaaaataaaccgaaaacgctgtgaatatttaatgagttttctagttttaaagaaactaggttaataaggttaagttaataagggcgcacggtggatgccttggcactagaagccgaagaaggacgtgactaacgacgaaatgctttggggagctgtaagtaagcgctgatccagagatgtccgaatgggggaacccactagttaatgactagtatccatatctgttaaggatatgagaaggaagacgcagtgaactgaaacatctaagtagctgcaggaagagaaagcaaaagcgattgccttagtagcggcgagcgaaacggcaggagggcaaaccgaagtgtttacacttcggggttgtaggactgcgatataggattaatcattatagaagaattacctgggaaggtaagccaaagagagtaacagcctcgtatttaaaatgatagattaaccttagcagtatcctgagtacggcgagacacgcgaaatctcgtcggaatctgggaggaccatctcccaaccctaaatactctctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcgtcatagtatcatgttgtagacccgaaaccatgtgacctacccatgagcaggttgaaggtgaggtaaaactcactggaggaccgaaccagggcacgttgaaaagtgcttggatgacttgtgggtagcggagaaattccaaacgaacttggagatagctggttctctccgaaatagctttagggctagcgtcgatgttaagtctcttggaggtagagcactgtttgggtgaggggtccatcccggattaccaatctcagataaactccgaatgccaacgagatataatcggcagtcagactgcgagtgctaagatccgtagtcgaaagggaaacagcccagaccaccagctaaggtcccaaaatatatgttaagtggaaaaggatgtggggttgcacagacaactaggatgttagcttagaagcagctattcattcaaagagtgcgtaatagctcactagtcgagtgaccctgcgccgaaaatgtaccggggctaaaacatattaccgaagctgtggatgacacaaaagtgtcatggtaggagagcgttctatgtgtgaagaaggtgtaccgtgaggagcgctggaacgcatagaagtgagaatgccggtatgagtagcgcaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatatagtgatggagggacgcagtaggctaactaaaccagacgattggaagtgtctggtcaaacagtgaggtgtgatatgagtcaaatgcttatatctttaacattgagctgtgacgaggagcgaagtttagtagcgaagttagtgatgtcacactgccaagaaaagcttctagcgatacatatactctacccgtaccgcaaaccgacacaggtagtcgaggcgagtagcctcaggtgagcgagagaactctcgttaaggaactcggcaaaatggccccgtaacttcgggagaaggggcgctgattttagatcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctatgataacgggacgccagtttcgtttgaggcgttgttgggatactacccttgtgttatggctactctaacccagataggcaatccctatcggagacagtgtctgacgggcagtttgactggggcggtcgcctcctaaaaggtaacggaggcgcccaaaggttccctcagactggttggaaatcagtcgtagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataagcgctgaaagcatctaagtgcgaagcccacctcaagatgagatttcccatgattttatatcagtaagagccctgagagatgatcaggtagataggttaggagtgtaattgtggtgacacatttagcggactaatactaatagctcgaggacttatccaaaaagagatattgacaacgttacggtttcttgttagactatagatattcaattttgagtgaataaggctcaatagttaagtgataattgcctaggagatacacctgttctcatgccgaacacagaagttaagccctagaacgccggaagtagttgggggttgccccctgtgagataaggtagtcgcttagcaaagggagtttagctcagctgggagagcatctgccttacaagcagagggtcagcggttcgatcccgttaactcccataggtcccgtagtgtagcggttatcacgtcgccctgtcacggcgaagatcgcgggttcgattcccgtcgggaccgtagactcgttagctcagttggtagagcaattgacttttaatcaatgggtcactggttcgagcccagtacgggtcatttagaaatgcgggtgtggcggaattggcagacgcaccagatttaggatctggcgcttaacggcgtgggggttcaagtcccttcacccgcattagtagattgccggcttagctcagttggtagagcatctgatttgtaatcagagggtcgcgtgttcaagtcatgtagccggcattacaattttataggataaatagtgtctttagtgcgaacgtagttcagtggtagaacatcaccttgccaaggtgagggtcgcgggttcgaaccccgtcgttcgcttgttagaggccggggtggcggaactggcagacgcacaggacttaaaatcctgcgatggtaaacatcgtaccggttcgattccggtcctcggcatataatatttagcacccttagctcaactggatagagtacctgactacgaatcaggcggttagaggttcgactcctctagggtgcatatttttcgggaagtagctcagcttggtagagtacttggtttgggaccaaggtgtcgcaggttcgaatcctgtcttcccgatggatatatttttatgatatatcattagacctttgaaaactgaacaagacgaacgaatgtgcagggtggatttacattgtaaatccgtcaatgacaaaaaacaataaatctgtcagcgagacagaaaagagcaaagctcaaacttttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggataaggaaacctgccatttgcgtcttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattgtagaaagtaacaagaaaataaaccgaaaacgctgtgaatatttaatgagttttctagttttaaagaaactaggttaataaggttaagttaataagggcgcacggtggatgccttggcactagaagccgaagaaggacgtgactaacgacgaaatgctttggggagctgtaagtaagcgctgatccagagatgtccgaatgggggaacccactagttaatgactagtatccatatctgttaaggatatgagaaggaagacgcagtgaactgaaacatctaagtagctgcaggaagagaaagcaaaagcgattgccttagtagcggcgagcgaaacggcaggagggcaaaccgaagtgtttacacttcggggttgtaggactgcgatataggattaatcattatagaagaattacctgggaaggtaagccaaagagagtaacagcctcgtatttaaaatgatagattaaccttagcagtatcctgagtacggcgagacacgcgaaatctcgtcggaatctgggaggaccatctcccaaccctaaatactctctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcgtcatagtatcatgttgtagacccgaaaccatgtgacctacccatgagcaggttgaaggtgaggtaaaactcactggaggaccgaaccagggcacgttgaaaagtgcttggatgacttgtgggtagcggagaaattccaaacgaacttggagatagctggttctctccgaaatagctttagggctagcgtcgatgttaagtctcttggaggtagagcactgtttgggtgaggggtccatcccggattaccaatctcagataaactccgaatgccaacgagatataatcggcagtcagactgcgagtgctaagatccgtagtcgaaagggaaacagcccagaccaccagctaaggtcccaaaatatatgttaagtggaaaaggatgtggggttgcacagacaactaggatgttagcttagaagcagctattcattcaaagagtgcgtaatagctcactagtcgagtgaccctgcgccgaaaatgtaccggggctaaaacatattaccgaagctgtggatgacacaaaagtgtcatggtaggagagcgttctatgtgtgaagaaggtgtaccgtgaggagcgctggaacgcatagaagtgagaatgccggtatgagtagcgcaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatatagtgatggagggacgcagtaggctaactaaaccagacgattggaagtgtctggtcaaacagtgaggtgtgatatgagtcaaatgcttatatctttaacattgagctgtgacgaggagcgaagtttagtagcgaagttagtgatgtcacactgccaagaaaagcttctagcgatacatatactctacccgtaccgcaaaccgacacaggtagtcgaggcgagtagcctcaggtgagcgagagaactctcgttaaggaactcggcaaaatggccccgtaacttcgggagaaggggcgctgattttagatcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctatgataacgggacgccagtttcgtttgaggcgttgttgggatactacccttgtgttatggctactctaacccagataggcaatccctatcggagacagtgtctgacgggcagtttgactggggcggtcgcctcctaaaaggtaacggaggcgcccaaaggttccctcagactggttggaaatcagtcgtagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataagcgctgaaagcatctaagtgcgaagcccacctcaagatgagatttcccatgattttatatcagtaagagccctgagagatgatcaggtagataggttaggagtgtaattgtggtgacacatttagcggactaatactaatagctcgaggacttatccaaaaagagatattgacaacgttacggtttcttgttagactatagatattcaattttgagtgaataaggctcaatagttaagtgataattgcctaggagatacacctgttctcatgccgaacacagaagttaagccctagaacgccggaagtagttgggggttgccccctgtgagataaggtagtcgcttagcaaagggagtttagctcagctgggagagcatctgccttacaagcagagggtcagcggttcgatcccgttaactcccataggtcccgtagtgtagcggttatcacgtcgccctgtcacggcgaagatcgcgggttcgattcccgtcgggaccgtagactcgttagctcagttggtagagcaattgacttttaatcaatgggtcactggttcgagcccagtacgggtcatttagaaatgcgggtgtggcggaattggcagacgcaccagatttaggatctggcgcttaacggcgtgggggttcaagtcccttcacccgcattagtagattgccggcttagctcagttggtagagcatctgatttgtaatcagagggtcgcgtgttcaagtcatgtagccggcattacaattttataggataaatagtgtctttagtgcgaacgtagttcagtggtagaacatcaccttgccaaggtgagggtcgcgggttcgaaccccgtcgttcgcttgttagaggccggggtggcggaactggcagacgcacaggacttaaaatcctgcgatggtaaacatcgtaccggttcgattccggtcctcggcatataatatttagcacccttagctcaactggatagagtacctgactacgaatcaggcggttagaggttcgactcctctagggtgcatatttttcgggaagtagctcagcttggtagagtacttggtttgggaccaaggtgtcgcaggttcgaatcctgtcttcccgatggatatatttttatggcggtgtagctcagctggctagagcgtccggttcatacccgggaggtcgggggttcgatcccctccgccgctatttattttattgagactttggacctttagctcaactggttagagcactcggctcataaccgagcggtcgtaggttcgagtcctacaaggtccatattttttgttatatggaggattacccaagtccggctgaagggaacggtcttgaaaaccgtcaggcgtgtaaaagcgtgcgtgggttcgaatcccacatcctcctttaaagatatcgcgggatggagcagctaggtagctcgtcgggctcataacccgaaggtcgtaggttcaaatcctgctcccgcaataggctcggtagctcagttggtagagcaatggattgaagctccatgtgtcggcggttcgattccgtctcgcgccatttattatataagtttttagcgggtgtagtttagtggtaaaactacagccttccaagctgttgtcgcgagttcgattctcgtcacccgcttactttacataaaagtaaaaccaagcatttgcttgggcgcgtagctcaggtggttagagcgcacgcctgataagcgtgaggtcggtggttcgagtccactcgtgcccattaatattaatttggagaattactcaagaggctgaagaggacggtttgctaaatcgttaggtcgggtaactggcgcaagggttcgaatcccttattctccgtaaatattataattttaagagtaattatactctttttttatttctcttttagtttcactatggagtaattatattgatagagtgaatagaagaaggttatcgttttctagatttgattatg

SEQ ID NO: 10968 - DNA, 50 bp, Artificial Sequence
  Amplification primer (forwards)
ggggacaagtttgtacaaaaaagcaggctctcaatctcatattgtttcag

SEQ ID NO: 10969 - DNA, 52 bp, Artificial Sequence
  Amplification primer (forwards)
ggggacaagtttgtacaaaaaagcaggctctaattacattattacatttttg

SEQ ID NO: 10970 - DNA, 51 bp, Artificial Sequence
  Amplification primer (forwards)
ggggacaagtttgtacaaaaaagcaggctctgatactagttcaggaatatc

SEQ ID NO: 10971 - DNA, 52 bp, Artificial Sequence
  Amplification primer (forwards)
ggggacaagtttgtacaaaaaagcaggctctgatacaagtgataagaatact

SEQ ID NO: 10972 - DNA, 50 bp, Artificial Sequence
  Amplification primer (forwards)
ggggacaagtttgtacaaaaaagcaggctctatttttcttcatagtccac

SEQ ID NO: 10973 - DNA, 50 bp, Artificial Sequence
  Amplification primer (forwards)
ggggacaagtttgtacaaaaaagcaggctctgaatgggtgttattaactc

SEQ ID NO: 10974 - DNA, 51 bp, Artificial Sequence
  Amplification primer (forwards)
ggggacaagtttgtacaaaaaagcaggctctacaaattcttattttagcaa

SEQ ID NO: 10975 - DNA, 47 bp, Artificial Sequence
  Amplification primer (forwards)
ggggacaagtttgtacaaaaaagcaggctctgtatcagttcaggcgt

SEQ ID NO: 10976 - DNA, 47 bp, Artificial Sequence
  Amplification primer (forwards)
ggggacaagtttgtacaaaaaagcaggctctgctgctctaggacaac

SEQ ID NO: 10977 - DNA, 48 bp, Artificial Sequence
  Amplification primer (forwards)
ggggacaagtttgtacaaaaaagcaggctcttttgttgttgccttatt

SEQ ID NO: 10978 - DNA, 46 bp, Artificial Sequence
  Amplification primer (forwards)
ggggacaagtttgtacaaaaaagcaggctctccacctatggaacgt

SEQ ID NO: 10979 - DNA, 47 bp, Artificial Sequence
  Amplification primer (forwards)
ggggacaagtttgtacaaaaaagcaggctctcagaaagtctatcggg

SEQ ID NO: 10980 - DNA, 49 bp, Artificial Sequence
  Amplification primer (forwards)
ggggacaagtttgtacaaaaaagcaggctctagtgagaagaaagcaaat

SEQ ID NO: 10981 - DNA, 48 bp, Artificial Sequence
  Amplification primer (forwards)
ggggacaagtttgtacaaaaaagcaggctcttcttggaattattggag

SEQ ID NO: 10982 - DNA, 48 bp, Artificial Sequence
  Amplification primer (forwards)
ggggacaagtttgtacaaaaaagcaggctctgcaatgattgtaaccat

SEQ ID NO: 10983 - DNA, 48 bp, Artificial Sequence
  Amplification primer (forwards)
ggggacaagtttgtacaaaaaagcaggctctgcatcttataccgtgaa

SEQ ID NO: 10984 - DNA, 46 bp, Artificial Sequence
  Amplification primer (forwards)
ggggacaagtttgtacaaaaaagcaggctctgccgagaaggataaa

SEQ ID NO: 10985 - DNA, 51 bp, Artificial Sequence
  Amplification primer (forwards)
ggggacaagtttgtacaaaaaagcaggctctgtttataaagttattcaaaa

SEQ ID NO: 10986 - DNA, 48 bp, Artificial Sequence
  Amplification primer (forwards)
ggggacaagtttgtacaaaaaagcaggctctaagcctaacagtcaaca

SEQ ID NO: 10987 - DNA, 50 bp, Artificial Sequence
  Amplification primer (forwards)
ggggacaagtttgtacaaaaaagcaggctctgatgataactttgaaatgc

SEQ ID NO: 10988 - DNA, 47 bp, Artificial Sequence
  Amplification primer (forwards)
ggggacaagtttgtacaaaaaagcaggctctgcagtgattgcaagtc

SEQ ID NO: 10989 - DNA, 43 bp, Artificial Sequence
  Amplification primer (forwards)
ggggacaagtttgtacaaaaaagcaggctgtgctgcatcaaac

SEQ ID NO: 10990 - DNA, 43 bp, Artificial Sequence; identical to SEQ ID NO: 10989
  Amplification primer (forwards)

SEQ ID NO: 10991 - DNA, 46 bp, Artificial Sequence
  Amplification primer (forwards)
ggggacaagtttgtacaaaaaagcaggctgtactaaacaaagccag

SEQ ID NO: 10992 - DNA, 45 bp, Artificial Sequence
  Amplification primer (forwards)
ggggacaagtttgtacaaaaaagcaggctgtcaattaaccgatac

SEQ ID NO: 10993 - DNA, 44 bp, Artificial Sequence
  Amplification primer (forwards)
ggggacaagtttgtacaaaaaagcaggctgctcaaatgattcat

SEQ ID NO: 10994 - DNA, 52 bp, Artificial Sequence
  Amplification primer (forwards)
ggggacaagtttgtacaaaaaagcaggctctaaaagttcacaagttactact

SEQ ID NO: 10995 - DNA, 51 bp, Artificial Sequence
  Amplification primer (forwards)
ggggacaagtttgtacaaaaaagcaggctctagtcattattccataaaatt

SEQ ID NO: 10996 - DNA, 49 bp, Artificial Sequence
  Amplification primer (forwards)
ggggacaagtttgtacaaaaaagcaggctctaatcatatgctgattgag

SEQ ID NO: 10997 - DNA, 45 bp, Artificial Sequence
  Amplification primer (forwards)
ggggacaagtttgtacaaaaaagcaggctcagtttggatgttaac

SEQ ID NO: 10998 - DNA, 44 bp, Artificial Sequence
  Amplification primer (forwards)
ggggacaagtttgtacaaaaaagcaggctcaacaaatgcagatg

SEQ ID NO: 10999 - DNA, 48 bp, Artificial Sequence
  Amplification primer (forwards)
ggggacaagtttgtacaaaaaagcaggctgttttgtcattattgatag

SEQ ID NO: 11000 - DNA, 51 bp, Artificial Sequence
  Amplification primer (forwards)
ggggacaagtttgtacaaaaaagcaggctctctaacttggtttttattaga

SEQ ID NO: 11001 - DNA, 49 bp, Artificial Sequence
  Amplification primer (forwards)
ggggacaagtttgtacaaaaaagcaggctctggtttaaaagtgactgaa

SEQ ID NO: 11002 - DNA, 49 bp, Artificial Sequence
  Amplification primer (forwards)
ggggacaagtttgtacaaaaaagcaggctctcatcatttaggtaaggaa

SEQ ID NO: 11003 - DNA, 50 bp, Artificial Sequence
  Amplification primer (forwards)
ggggacaagtttgtacaaaaaagcaggctctgttagtaatcgctacaatc

SEQ ID NO: 11004 - DNA, 48 bp, Artificial Sequence
  Amplification primer (forwards)
ggggacaagtttgtacaaaaaagcaggctctaatcaagaagtttcagc

SEQ ID NO: 11005 - DNA, 47 bp, Artificial Sequence
  Amplification primer (forwards)
ggggacaagtttgtacaaaaaagcaggctctcgagttttagcggata

SEQ ID NO: 11006 - DNA, 51 bp, Artificial Sequence
  Amplification primer (forwards)
ggggacaagtttgtacaaaaaagcaggctctgtattattttaccaatcaca

SEQ ID NO: 11007 - DNA, 46 bp, Artificial Sequence
  Amplification primer (forwards)
ggggacaagtttgtacaaaaaagcaggcttaggagtggtagttcat

SEQ ID NO: 11008 - DNA, 48 bp, Artificial Sequence
  Amplification primer (forwards)
ggggacaagtttgtacaaaaaagcaggctttttattgttagtattagc

SEQ ID NO: 11009 - DNA, 49 bp, Artificial Sequence
  Amplification primer (forwards)
ggggacaagtttgtacaaaaaagcaggctctgtttatctagcggttaga

SEQ ID NO: 11010 - DNA, 50 bp, Artificial Sequence
  Amplification primer (forwards)
ggggacaagtttgtacaaaaaagcaggctataacagtttagttagaagtc

SEQ ID NO: 11011 - DNA, 47 bp, Artificial Sequence
  Amplification primer (forwards)
ggggacaagtttgtacaaaaaagcaggctttaaagggtttacatatt

SEQ ID NO: 11012 - DNA, 45 bp, Artificial Sequence
  Amplification primer (forwards)
ggggacaagtttgtacaaaaaagcaggctttaatacaattggtcg

SEQ ID NO: 11013 - DNA, 49 bp, Artificial Sequence
  Amplification primer (forwards)
ggggacaagtttgtacaaaaaagcaggctctatggaaaaaattaggatt

SEQ ID NO: 11014 - DNA, 49 bp, Artificial Sequence
  Amplification primer (forwards)
ggggacaagtttgtacaaaaaagcaggctctagagatgagcaagaaata

SEQ ID NO: 11015 - DNA, 51 bp, Artificial Sequence
  Amplification primer (forwards)
ggggacaagtttgtacaaaaaagcaggctctcaacagataggtctttataa

SEQ ID NO: 11016 - DNA, 49 bp, Artificial Sequence
  Amplification primer (forwards)
ggggacaagtttgtacaaaaaagcaggctttctctataattacttcaat

SEQ ID NO: 11017 - DNA, 50 bp, Artificial Sequence
  Amplification primer (forwards)
ggggacaagtttgtacaaaaaagcaggctctaataaggcattattagagg

SEQ ID NO: 11018 - DNA, 51 bp, Artificial Sequence
  Amplification primer (forwards)
ggggacaagtttgtacaaaaaagcaggctctacacatttagttgacttaac

SEQ ID NO: 11019 - DNA, 52 bp, Artificial Sequence
  Amplification primer (forwards)
ggggacaagtttgtacaaaaaagcaggctctagtaaacaacacatttatcta

SEQ ID NO: 11020 - DNA, 49 bp, Artificial Sequence
  Amplification primer (forwards)
ggggacaagtttgtacaaaaaagcaggctctcaagaaactcatcagttg

SEQ ID NO: 11021 - DNA, 49 bp, Artificial Sequence
  Amplification primer (forwards)
ggggacaagtttgtacaaaaaagcaggctctgcagaagacattgttaca

SEQ ID NO: 11022 - DNA, 48 bp, Artificial Sequence
  Amplification primer (forwards)
ggggacaagtttgtacaaaaaagcaggctataatttttcgactaatga

SEQ ID NO: 11023 - DNA, 49 bp, Artificial Sequence
  Amplification primer (forwards)
ggggacaagtttgtacaaaaaagcaggctctgacacagtgtcttatcct

SEQ ID NO: 11024 - DNA, 47 bp, Artificial Sequence
  Amplification primer (forwards)
ggggacaagtttgtacaaaaaagcaggctctgtggagcaagtggcca

SEQ ID NO: 11025 - DNA, 51 bp, Artificial Sequence
  Amplification primer (forwards)
ggggacaagtttgtacaaaaaagcaggctctcaagaactaagtaactttga

SEQ ID NO: 11026 - DNA, 48 bp, Artificial Sequence
  Amplification primer (forwards)
ggggacaagtttgtacaaaaaagcaggctctactgaaacgtttgaagg

SEQ ID NO: 11027 - DNA, 48 bp, Artificial Sequence
  Amplification primer (forwards)
ggggacaagtttgtacaaaaaagcaggctctgatgaagcaacaactaa

SEQ ID NO: 11028 - DNA, 52 bp, Artificial Sequence
  Amplification primer (forwards)
ggggacaagtttgtacaaaaaagcaggctctaataaagataatcaaaaaact

SEQ ID NO: 11029 - DNA, 46 bp, Artificial Sequence
  Amplification primer (forwards)
ggggacaagtttgtacaaaaaagcaggctgtttcttttttattcca

SEQ ID NO: 11030 - DNA, 48 bp, Artificial Sequence
  Amplification primer (forwards)
ggggacaagtttgtacaaaaaagcaggctattactttgatggtagttt

SEQ ID NO: 11031 - DNA, 48 bp, Artificial Sequence
  Amplification primer (forwards)
ggggacaagtttgtacaaaaaagcaggctctgttcaatcattagcaaa

SEQ ID NO: 11032 - DNA, 49 bp, Artificial Sequence
  Amplification primer (forwards)
ggggacaagtttgtacaaaaaagcaggctttaaaggtaataagaagttg

SEQ ID NO: 11033 - DNA, 50 bp, Artificial Sequence
  Amplification primer (forwards)
ggggacaagtttgtacaaaaaagcaggctctagtcaagttgactctgtta

SEQ ID NO: 11034 - DNA, 47 bp, Artificial Sequence
  Amplification primer (forwards)
ggggacaagtttgtacaaaaaagcaggctctcaaaaccaggtgactg

SEQ ID NO: 11035 - DNA, 48 bp, Artificial Sequence
  Amplification primer (forwards)
ggggacaagtttgtacaaaaaagcaggcttaagattttataacaacga

SEQ ID NO: 11036 - DNA, 47 bp, Artificial Sequence
  Amplification primer (forwards)
ggggacaagtttgtacaaaaaagcaggctctaatgttttaggggaaa

SEQ ID NO: 11037 - DNA, 44 bp, Artificial Sequence
  Amplification primer (forwards)
ggggacaagtttgtacaaaaaagcaggctcccaaaagacttttg

SEQ ID NO: 11038 - DNA, 44 bp, Artificial Sequence; identical to SEQ ID NO: 11037
  Amplification primer (forwards)

SEQ ID NO: 11039 - DNA, 48 bp, Artificial Sequence
  Amplification primer (forwards)
ggggacaagtttgtacaaaaaagcaggctctaaagttttagcctttga

SEQ ID NO: 11040 - DNA, 44 bp, Artificial Sequence
  Amplification primer (forwards)
ggggacaagtttgtacaaaaaagcaggctctgaaatggctttag

SEQ ID NO: 11041 - DNA, 53 bp, Artificial Sequence
  Amplification primer (forwards)
ggggacaagtttgtacaaaaaagcaggctctactaacttattgagtagaatca

SEQ ID NO: 11042 - DNA, 46 bp, Artificial Sequence
  Amplification primer (forwards)
ggggacaagtttgtacaaaaaagcaggctgtagctcaaaatctcat

SEQ ID NO: 11043 - DNA, 52 bp, Artificial Sequence
  Amplification primer (forwards)
ggggacaagtttgtacaaaaaagcaggctctagtttatctattaaagatgcc

SEQ ID NO: 11044 - DNA, 47 bp, Artificial Sequence
  Amplification primer (forwards)
ggggacaagtttgtacaaaaaagcaggctctatcaaagaggcggtaa

SEQ ID NO: 11045 - DNA, 50 bp, Artificial Sequence
  Amplification primer (forwards)
ggggacaagtttgtacaaaaaagcaggctctaaagaggataaaaagctag

SEQ ID NO: 11046 - DNA, 50 bp, Artificial Sequence
  Amplification primer (forwards)
ggggacaagtttgtacaaaaaagcaggctctagtgtttcaggtagtagtg

SEQ ID NO: 11047 - DNA, 50 bp, Artificial Sequence
  Amplification primer (forwards)
ggggacaagtttgtacaaaaaagcaggctctaaaaaattaaaacactcaa

SEQ ID NO: 11048 - DNA, 50 bp, Artificial Sequence
  Amplification primer (forwards)
ggggacaagtttgtacaaaaaagcaggctctgatgaagttacaacttcag

SEQ ID NO: 11049 - DNA, 48 bp, Artificial Sequence
  Amplification primer (forwards)
ggggacaagtttgtacaaaaaagcaggcttattccaaagtaaaataaa

SEQ ID NO: 11050 - DNA, 56 bp, Artificial Sequence
  Amplification primer (forwards)
ggggacaagtttgtacaaaaaagcaggctctcataaccatcactcagaacacatgt

SEQ ID NO: 11051 - DNA, 48 bp, Artificial Sequence
  Amplification primer (forwards)
ggggacaagtttgtacaaaaaagcaggctctcccaagaataggataaa

SEQ ID NO: 11052 - DNA, 50 bp, Artificial Sequence
  Amplification primer (forwards)
ggggacaagtttgtacaaaaaagcaggctctagtcagtatgagtcacaga

SEQ ID NO: 11053 - DNA, 48 bp, Artificial Sequence
  Amplification primer (forwards)
ggggacaagtttgtacaaaaaagcaggctctgcagaagtgtcacaaga

SEQ ID NO: 11054 - DNA, 45 bp, Artificial Sequence
  Amplification primer (forwards)
ggggacaagtttgtacaaaaaagcaggctcttttgatggattttt

SEQ ID NO: 11055 - DNA, 48 bp, Artificial Sequence
  Amplification primer (forwards)
ggggacaagtttgtacaaaaaagcaggctctacaaatgaaaaacgaac

SEQ ID NO: 11056 - DNA, 52 bp, Artificial Sequence
  Amplification primer (forwards)
ggggacaagtttgtacaaaaaagcaggctctgaaattaaactcaaaaatatt

SEQ ID NO: 11057 - DNA, 50 bp, Artificial Sequence
  Amplification primer (forwards)
ggggacaagtttgtacaaaaaagcaggctctcatactcaagaacacaaaa

SEQ ID NO: 11058 - DNA, 51 bp, Artificial Sequence
  Amplification primer (forwards)
ggggacaagtttgtacaaaaaagcaggctctcctaagaagaaatcagatac

SEQ ID NO: 11059 - DNA, 50 bp, Artificial Sequence
  Amplification primer (forwards)
ggggacaagtttgtacaaaaaagcaggctctgcagaactaactcttttaa

SEQ ID NO: 11060 - DNA, 51 bp, Artificial Sequence
  Amplification primer (forwards)
ggggacaagtttgtacaaaaaagcaggctctgcggatacatataataacta

SEQ ID NO: 11061 - DNA, 46 bp, Artificial Sequence
  Amplification primer (forwards)
ggggacaagtttgtacaaaaaagcaggctcttaccaaaaaatgacg

SEQ ID NO: 11062 - DNA, 48 bp, Artificial Sequence
  Amplification primer (forwards)
ggggacaagtttgtacaaaaaagcaggctctgaagagcttaccaaaac

SEQ ID NO: 11063 - DNA, 51 bp, Artificial Sequence
  Amplification primer (forwards)
ggggacaagtttgtacaaaaaagcaggctctagatatacaaatggaaattt

SEQ ID NO: 11064 - DNA, 50 bp, Artificial Sequence
  Amplification primer (forwards)
ggggacaagtttgtacaaaaaagcaggctctaaaaaaggacaagtaaatg

SEQ ID NO: 11065 - DNA, 50 bp, Artificial Sequence
  Amplification primer (forwards)
ggggacaagtttgtacaaaaaagcaggctctgattctgtcataaataagc

SEQ ID NO: 11066 - DNA, 47 bp, Artificial Sequence
  Amplification primer (forwards)
ggggacaagtttgtacaaaaaagcaggctctgaattttcacgagaaa

SEQ ID NO: 11067 - DNA, 48 bp, Artificial Sequence
  Amplification primer (forwards)
ggggacaagtttgtacaaaaaagcaggctaccaattaggtagctataa

SEQ ID NO: 11068 - DNA, 51 bp, Artificial Sequence
  Amplification primer (forwards)
ggggacaagtttgtacaaaaaagcaggctctgttaatacaaaaacacttct

SEQ ID NO: 11069 - DNA, 50 bp, Artificial Sequence
  Amplification primer (forwards)
ggggacaagtttgtacaaaaaagcaggctctggtcagtctaaaaatgaag

SEQ ID NO: 11070 - DNA, 47 bp, Artificial Sequence
  Amplification primer (forwards)
ggggacaagtttgtacaaaaaagcaggctctagccaggaggtatatg

SEQ ID NO: 11071 - DNA, 50 bp, Artificial Sequence
  Amplification primer (forwards)
ggggacaagtttgtacaaaaaagcaggctctgaaactattaatccagaaa

SEQ ID NO: 11072 - DNA, 49 bp, Artificial Sequence
  Amplification primer (forwards)
ggggacaagtttgtacaaaaaagcaggctctacaagtatgaaccatcaa

SEQ ID NO: 11073 - DNA, 47 bp, Artificial Sequence
  Amplification primer (forwards)
ggggacaagtttgtacaaaaaagcaggctctaaggggccaaaagtag

SEQ ID NO: 11074 - DNA, 54 bp, Artificial Sequence
  Amplification primer (forwards)
ggggacaagtttgtacaaaaaagcaggctctattactttagaaaaatttataga

SEQ ID NO: 11075 - DNA, 47 bp, Artificial Sequence
  Amplification primer (forwards)
ggggacaagtttgtacaaaaaagcaggctctgccttttactttggca

SEQ ID NO: 11076 - DNA, 48 bp, Artificial Sequence
  Amplification primer (forwards)
ggggacaagtttgtacaaaaaagcaggctctattttttccttgatcat

SEQ ID NO: 11077 - DNA, 47 bp, Artificial Sequence
  Amplification primer (forwards)
ggggacaagtttgtacaaaaaagcaggctctggtgaaacccaagata

SEQ ID NO: 11078 - DNA, 45 bp, Artificial Sequence
  Amplification primer (forwards)
ggggacaagtttgtacaaaaaagcaggcttaacaattcatggacc

SEQ ID NO: 11079 - DNA, 45 bp, Artificial Sequence; identical to SEQ ID NO: 11078
  Amplification primer (forwards)

SEQ ID NO: 11080 - DNA, 47 bp, Artificial Sequence
  Amplification primer (forwards)
ggggacaagtttgtacaaaaaagcaggctctcaaggacctcccggtg

SEQ ID NO: 11081 - DNA, 48 bp, Artificial Sequence
  Amplification primer (forwards)
ggggacaagtttgtacaaaaaagcaggctctcaaaatcaaaattcaca

SEQ ID NO: 11082 - DNA, 47 bp, Artificial Sequence
  Amplification primer (forwards)
ggggacaagtttgtacaaaaaagcaggctctctggagccttttattt

SEQ ID NO: 11083 - DNA, 49 bp, Artificial Sequence
  Amplification primer (forwards)
ggggacaagtttgtacaaaaaagcaggctctggtaatcgttcagataag

SEQ ID NO: 11084 - DNA, 47 bp, Artificial Sequence
  Amplification primer (forwards)
ggggacaagtttgtacaaaaaagcaggctctatccagcagatcaact

SEQ ID NO: 11085 - DNA, 47 bp, Artificial Sequence
  Amplification primer (forwards)
ggggacaagtttgtacaaaaaagcaggctctaaacgggttcgctatg

SEQ ID NO: 11086 - DNA, 50 bp, Artificial Sequence
  Amplification primer (forwards)
ggggacaagtttgtacaaaaaagcaggctctgtaaaattagtattcgcac

SEQ ID NO: 11087 - DNA, 48 bp, Artificial Sequence
  Amplification primer (forwards)
ggggacaagtttgtacaaaaaagcaggctctgttagcgttgataaggc

SEQ ID NO: 11088 - DNA, 50 bp, Artificial Sequence
  Amplification primer (forwards)
ggggacaagtttgtacaaaaaagcaggctctacaattaaaaatctcactg

SEQ ID NO: 11089 - DNA, 52 bp, Artificial Sequence
  Amplification primer (forwards)
ggggacaagtttgtacaaaaaagcaggctctagtaaaatcaaaattgtaacg

SEQ ID NO: 11090 - DNA, 50 bp, Artificial Sequence
  Amplification primer (forwards)
ggggacaagtttgtacaaaaaagcaggctctaatcttttaattatgggtt

SEQ ID NO: 11091 - DNA, 48 bp, Artificial Sequence
  Amplification primer (forwards)
ggggacaagtttgtacaaaaaagcaggctttcaatactatttaaaagg

SEQ ID NO: 11092 - DNA, 47 bp, Artificial Sequence
  Amplification primer (forwards)
ggggacaagtttgtacaaaaaagcaggctctaccgaggagccattaa

SEQ ID NO: 11093 - DNA, 49 bp, Artificial Sequence
  Amplification primer (forwards)
ggggacaagtttgtacaaaaaagcaggctctgaacaatcacaaaaaaca

SEQ ID NO: 11094 - DNA, 47 bp, Artificial Sequence
  Amplification primer (forwards)
ggggacaagtttgtacaaaaaagcaggctctatggtgacggtgctgg

SEQ ID NO: 11095 - DNA, 47 bp, Artificial Sequence
  Amplification primer (forwards)
ggggacaagtttgtacaaaaaagcaggctctagtcagccggtagggg

SEQ ID NO: 11096 - DNA, 47 bp, Artificial Sequence
  Amplification primer (forwards)
ggggacaagtttgtacaaaaaagcaggctctggtggagcatttgcta

SEQ ID NO: 11097 - DNA, 52 bp, Artificial Sequence; identical to SEQ ID NO: 11028
  Amplification primer (forwards)

SEQ ID NO: 11098 - DNA, 47 bp, Artificial Sequence
  Amplification primer (forwards)
ggggacaagtttgtacaaaaaagcaggctctgctgccaccaagaaag

SEQ ID NO: 11099 - DNA, 48 bp, Artificial Sequence
  Amplification primer (forwards)
ggggacaagtttgtacaaaaaagcaggctctacaacaaatgtaatggc

SEQ ID NO: 11100 - DNA, 46 bp, Artificial Sequence
  Amplification primer (forwards)
ggggacaagtttgtacaaaaaagcaggctcaatgaatttttcattt

SEQ ID NO: 11101 - DNA, 49 bp, Artificial Sequence
  Amplification primer (forwards)
ggggacaagtttgtacaaaaaagcaggctctacaaaatatcagcgaatg

SEQ ID NO: 11102 - DNA, 48 bp, Artificial Sequence
  Amplification primer (forwards)
ggggacaagtttgtacaaaaaagcaggctctactaagcaagcaatgtc

SEQ ID NO: 11103 - DNA, 52 bp, Artificial Sequence
  Amplification primer (forwards)
ggggacaagtttgtacaaaaaagcaggctctacaaaagaatatcaaaattat

SEQ ID NO: 11104 - DNA, 45 bp, Artificial Sequence
  Amplification primer (forwards)
ggggacaagtttgtacaaaaaagcaggctcgactaattcgttaaa

SEQ ID NO: 11105 - DNA, 47 bp, Artificial Sequence
  Amplification primer (forwards)
ggggacaagtttgtacaaaaaagcaggctttgaaatagtattggaaa

SEQ ID NO: 11106 - DNA, 54 bp, Artificial Sequence
  Amplification primer (forwards)
ggggacaagtttgtacaaaaaagcaggctctatattttctattttttattatgt

SEQ ID NO: 11107 - DNA, 49 bp, Artificial Sequence
  Amplification primer (forwards)
ggggacaagtttgtacaaaaaagcaggctctaaaaaacaacttcacaac

SEQ ID NO: 11108 - DNA, 51 bp, Artificial Sequence
  Amplification primer (forwards)
ggggacaagtttgtacaaaaaagcaggctctaaaacagatattgaaatagc

SEQ ID NO: 11109 - DNA, 51 bp, Artificial Sequence
  Amplification primer (forwards)
ggggacaagtttgtacaaaaaagcaggctctattaaatattatcatttgca

SEQ ID NO: 11110 - DNA, 47 bp, Artificial Sequence
  Amplification primer (forwards)
ggggacaagtttgtacaaaaaagcaggctctgctttacggaaccttg

SEQ ID NO: 11111 - DNA, 52 bp, Artificial Sequence
  Amplification primer (forwards)
ggggacaagtttgtacaaaaaagcaggctctactatttctcaacaacaatac

SEQ ID NO: 11112 - DNA, 51 bp, Artificial Sequence
  Amplification primer (forwards)
ggggacaagtttgtacaaaaaagcaggctctgaaaaaaagagtagttcaac

SEQ ID NO: 11113 - DNA, 50 bp, Artificial Sequence
  Amplification primer (forwards)
ggggacaagtttgtacaaaaaagcaggctctaatcaattatcagaaatca

SEQ ID NO: 11114 - DNA, 52 bp, Artificial Sequence
  Amplification primer (forwards)
ggggacaagtttgtacaaaaaagcaggctctcaagagtataaaacaaaagag

SEQ ID NO: 11115 - DNA, 49 bp, Artificial Sequence
  Amplification primer (forwards)
ggggacaagtttgtacaaaaaagcaggctctgctgtatttacactcgtc

SEQ ID NO: 11116 - DNA, 47 bp, Artificial Sequence
  Amplification primer (forwards)
ggggacaagtttgtacaaaaaagcaggctctggcggcaagataaaat

SEQ ID NO: 11117 - DNA, 50 bp, Artificial Sequence
  Amplification primer (forwards)
ggggacaagtttgtacaaaaaagcaggctctgatgggttaaagaataatg

SEQ ID NO: 11118 - DNA, 50 bp, Artificial Sequence
  Amplification primer (forwards)
ggggacaagtttgtacaaaaaagcaggctctgatgttgtaattagtggag

SEQ ID NO: 11119 - DNA, 46 bp, Artificial Sequence
  Amplification primer (forwards)
ggggacaagtttgtacaaaaaagcaggcttcgaattaagagaaaga

SEQ ID NO: 11120 - DNA, 49 bp, Artificial Sequence
  Amplification primer (forwards)
ggggacaagtttgtacaaaaaagcaggctctagctttttagtgatttca

SEQ ID NO: 11121 - DNA, 45 bp, Artificial Sequence
  Amplification primer (forwards)
ggggacaagtttgtacaaaaaagcaggctatacgcatagtggaac

SEQ ID NO: 11122 - DNA, 47 bp, Artificial Sequence
  Amplification primer (forwards)
ggggacaagtttgtacaaaaaagcaggctctgttattatcaggggcg

SEQ ID NO: 11123 - DNA, 47 bp, Artificial Sequence
  Amplification primer (forwards)
ggggacaagtttgtacaaaaaagcaggctctgttagtcgttctccga

SEQ ID NO: 11124 - DNA, 48 bp, Artificial Sequence
  Amplification primer (forwards)
ggggacaagtttgtacaaaaaagcaggctctgaggagcaagaattaaa

SEQ ID NO: 11125 - DNA, 49 bp, Artificial Sequence
  Amplification primer (forwards)
ggggacaagtttgtacaaaaaagcaggctctattctaacaaaagcaagt

SEQ ID NO: 11126 - DNA, 47 bp, Artificial Sequence
  Amplification primer (forwards)
ggggacaagtttgtacaaaaaagcaggctctagtgggcgttcatgga

SEQ ID NO: 11127 - DNA, 49 bp, Artificial Sequence
  Amplification primer (forwards)
ggggacaagtttgtacaaaaaagcaggctctgatacccctaatcaacta

SEQ ID NO: 11128 - DNA, 44 bp, Artificial Sequence
  Amplification primer (forwards)
ggggacaagtttgtacaaaaaagcaggctgcaggagctgtccgc

SEQ ID NO: 11129 - DNA, 47 bp, Artificial Sequence
  Amplification primer (forwards)
ggggacaagtttgtacaaaaaagcaggctctgtccgcattggtaaag

SEQ ID NO: 11130 - DNA, 49 bp, Artificial Sequence
  Amplification primer (forwards)
ggggacaagtttgtacaaaaaagcaggctctaactgcttagaaaatgaa

SEQ ID NO: 11131 - DNA, 44 bp, Artificial Sequence
  Amplification primer (forwards)
ggggacaagtttgtacaaaaaagcaggctctaacaactccagca

SEQ ID NO: 11132 - DNA, 47 bp, Artificial Sequence
  Amplification primer (forwards)
ggggacaagtttgtacaaaaaagcaggctctggaaaggtcagtgcag

SEQ ID NO: 11133 - DNA, 50 bp, Artificial Sequence
  Amplification primer (forwards)
ggggacaagtttgtacaaaaaagcaggctctattttattttcagatgaac

SEQ ID NO: 11134 - DNA, 47 bp, Artificial Sequence
  Amplification primer (forwards)
ggggacaagtttgtacaaaaaagcaggctctgcatcagatgttcaga

SEQ ID NO: 11135 - DNA, 48 bp, Artificial Sequence
  Amplification primer (forwards)
ggggacaagtttgtacaaaaaagcaggctctagtgacgttgacaaata

SEQ ID NO: 11136 - DNA, 50 bp, Artificial Sequence
  Amplification primer (forwards)
ggggacaagtttgtacaaaaaagcaggctctatgaccatttacttcaata

SEQ ID NO: 11137 - DNA, 47 bp, Artificial Sequence
  Amplification primer (forwards)
ggggacaagtttgtacaaaaaagcaggctctcaaactattttgacgc

SEQ ID NO: 11138 - DNA, 50 bp, Artificial Sequence
  Amplification primer (forwards)
ggggacaagtttgtacaaaaaagcaggctctgatgaatatctacgtgtcg

SEQ ID NO: 11139 - DNA, 50 bp, Artificial Sequence
  Amplification primer (forwards)
ggggacaagtttgtacaaaaaagcaggctctgatgaggtggactataaca

SEQ ID NO: 11140 - DNA, 50 bp, Artificial Sequence
  Amplification primer (forwards)
ggggacaagtttgtacaaaaaagcaggctctattttcttgctcttagttg

SEQ ID NO: 11141 - DNA, 50 bp, Artificial Sequence
  Amplification primer (forwards)
ggggacaagtttgtacaaaaaagcaggctctgaaactgtcattcaacttg

SEQ ID NO: 11142 - DNA, 48 bp, Artificial Sequence
  Amplification primer (forwards)
ggggacaagtttgtacaaaaaagcaggctattttttaacaacaaaaaa

SEQ ID NO: 11143 - DNA, 48 bp, Artificial Sequence
  Amplification primer (forwards)
ggggacaagtttgtacaaaaaagcaggctctccaatttttattggttt

SEQ ID NO: 11144 - DNA, 48 bp, Artificial Sequence; identical to SEQ ID NO: 10983
  Amplification primer (forwards)

SEQ ID NO: 11145 - DNA, 49 bp, Artificial Sequence
  Amplification primer (forwards)
ggggacaagtttgtacaaaaaagcaggctctacaatttatattgcttgg

SEQ ID NO: 11146 - DNA, 47 bp, Artificial Sequence
  Amplification primer (forwards)
ggggacaagtttgtacaaaaaagcaggctctgttggattgatgttgg

SEQ ID NO: 11147 - DNA, 44 bp, Artificial Sequence
  Amplification primer (forwards)
ggggacaagtttgtacaaaaaagcaggctggaaacaaatcacag

SEQ ID NO: 11148 - DNA, 51 bp, Artificial Sequence
  Amplification primer (forwards)
ggggacaagtttgtacaaaaaagcaggctctgcaatagtttttactttttt

SEQ ID NO: 11149 - DNA, 50 bp, Artificial Sequence
  Amplification primer (forwards)
ggggacaagtttgtacaaaaaagcaggctctggttcttatcatttaacaa

SEQ ID NO: 11150 - DNA, 47 bp, Artificial Sequence
  Amplification primer (forwards)
ggggacaagtttgtacaaaaaagcaggctctgctagacccaaacagt

SEQ ID NO: 11151 - DNA, 48 bp, Artificial Sequence
  Amplification primer (forwards)
ggggacaagtttgtacaaaaaagcaggctacactcatattgttgaaaa

SEQ ID NO: 11152 - DNA, 51 bp, Artificial Sequence
  Amplification primer (forwards)
ggggacaagtttgtacaaaaaagcaggctctaatagtactgagacaagtgc

SEQ ID NO: 11153 - DNA, 48 bp, Artificial Sequence
  Amplification primer (forwards)
ggggacaagtttgtacaaaaaagcaggctctgcttatgtcgtcaattt

SEQ ID NO: 11154 - DNA, 49 bp, Artificial Sequence
  Amplification primer (forwards)
ggggacaagtttgtacaaaaaagcaggctctgaattaccttcgtttatc

SEQ ID NO: 11155 - DNA, 50 bp, Artificial Sequence
  Amplification primer (forwards)
ggggacaagtttgtacaaaaaagcaggctctaaacatccgatacttaatg

SEQ ID NO: 11156 - DNA, 47 bp, Artificial Sequence
  Amplification primer (forwards)
ggggacaagtttgtacaaaaaagcaggctctaattatccttttgcga

SEQ ID NO: 11157 - DNA, 47 bp, Artificial Sequence
  Amplification primer (forwards)
ggggacaagtttgtacaaaaaagcaggctctggactacgcggagtat

SEQ ID NO: 11158 - DNA, 47 bp, Artificial Sequence
  Amplification primer (forwards)
ggggacaagtttgtacaaaaaagcaggctctgctattggagcagctg

SEQ ID NO: 11159 - DNA, 50 bp, Artificial Sequence
  Amplification primer (forwards)
ggggacaagtttgtacaaaaaagcaggctctgataaagaagggatagagg

SEQ ID NO: 11160 - DNA, 50 bp, Artificial Sequence
  Amplification primer (forwards)
ggggacaagtttgtacaaaaaagcaggctctaaagaaaaatcacaaactg

SEQ ID NO: 11161 - DNA, 52 bp, Artificial Sequence
  Amplification primer (forwards)
ggggacaagtttgtacaaaaaagcaggctctcaaaataataaaaaagtaaaa

SEQ ID NO: 11162 - DNA, 52 bp, Artificial Sequence; identical to SEQ ID NO: 11161
  Amplification primer (forwards)

SEQ ID NO: 11163 - DNA, 46 bp, Artificial Sequence
  Amplification primer (forwards)
ggggacaagtttgtacaaaaaagcaggctcaaatggtcaatctagc

SEQ ID NO: 11164 - DNA, 48 bp, Artificial Sequence
  Amplification primer (forwards)
ggggacaagtttgtacaaaaaagcaggctctaaggattcaaaaatccc

SEQ ID NO: 11165 - DNA, 47 bp, Artificial Sequence
  Amplification primer (forwards)
ggggacaagtttgtacaaaaaagcaggctctgggcaaccatctacat

SEQ ID NO: 11166 - DNA, 47 bp, Artificial Sequence
  Amplification primer (forwards)
ggggacaagtttgtacaaaaaagcaggctctcattcacaggatagca

SEQ ID NO: 11167 - DNA, 48 bp, Artificial Sequence
  Amplification primer (forwards)
ggggacaagtttgtacaaaaaagcaggctctggacgaggagaagtatc

SEQ ID NO: 11168 - DNA, 45 bp, Artificial Sequence
  Amplification primer (forwards)
ggggacaagtttgtacaaaaaagcaggctcacaatcttctcaaaa

SEQ ID NO: 11169 - DNA, 48 bp, Artificial Sequence
  Amplification primer (forwards)
ggggacaagtttgtacaaaaaagcaggctctgataagtcagcaaaccc

SEQ ID NO: 11170 - DNA, 49 bp, Artificial Sequence
  Amplification primer (forwards)
ggggacaagtttgtacaaaaaagcaggctctatcacgacattacagact

SEQ ID NO: 11171 - DNA, 49 bp, Artificial Sequence
  Amplification primer (forwards)
ggggacaagtttgtacaaaaaagcaggctctagatatttaactgctggt

SEQ ID NO: 11172 - DNA, 52 bp, Artificial Sequence
  Amplification primer (forwards)
ggggacaagtttgtacaaaaaagcaggctctataaaatatcaagatgatttt

SEQ ID NO: 11173 - DNA, 46 bp, Artificial Sequence
  Amplification primer (forwards)
ggggacaagtttgtacaaaaaagcaggcttagaagtcagagagcag

SEQ ID NO: 11174 - DNA, 47 bp, Artificial Sequence
  Amplification primer (forwards)
ggggacaagtttgtacaaaaaagcaggctctattatggagacgggta

SEQ ID NO: 11175 - DNA, 50 bp, Artificial Sequence
  Amplification primer (forwards)
ggggacaagtttgtacaaaaaagcaggctctttgaataataaaggtgtcg

SEQ ID NO: 11176 - DNA, 50 bp, Artificial Sequence; identical to SEQ ID NO: 11175
  Amplification primer (forwards)

SEQ ID NO: 11177 - DNA, 50 bp, Artificial Sequence
  Amplification primer (forwards)
ggggacaagtttgtacaaaaaagcaggctctatttcctcaaatttttacg

SEQ ID NO: 11178 - DNA, 49 bp, Artificial Sequence
  Amplification primer (forwards)
ggggacaagtttgtacaaaaaagcaggctctaatttttataagctcttg

SEQ ID NO: 11179 - DNA, 47 bp, Artificial Sequence
  Amplification primer (forwards)
ggggacaagtttgtacaaaaaagcaggctctgcgcttaaagaattaa

SEQ ID NO: 11180 - DNA, 47 bp, Artificial Sequence
  Amplification primer (forwards)
ggggacaagtttgtacaaaaaagcaggctttttaaaagaaattgaaa

SEQ ID NO: 11181 - DNA, 48 bp, Artificial Sequence
  Amplification primer (forwards)
ggggacaagtttgtacaaaaaagcaggctttcgtaaatataattttga

SEQ ID NO: 11182 - DNA, 49 bp, Artificial Sequence
  Amplification primer (forwards)
ggggacaagtttgtacaaaaaagcaggctctagcgatacctttaatttt

SEQ ID NO: 11183 - DNA, 47 bp, Artificial Sequence
  Amplification primer (forwards)
ggggacaagtttgtacaaaaaagcaggctctatgctgattaagtcgc

SEQ ID NO: 11184 - DNA, 45 bp, Artificial Sequence
  Amplification primer (forwards)
ggggacaagtttgtacaaaaaagcaggctgtggtaaaactggact

SEQ ID NO: 11185 - DNA, 48 bp, Artificial Sequence
  Amplification primer (forwards)
ggggacaagtttgtacaaaaaagcaggctctaagacaggagcacccgt

SEQ ID NO: 11186 - DNA, 44 bp, Artificial Sequence
  Amplification primer (forwards)
ggggacaagtttgtacaaaaaagcaggctgcgagtcaattgagc

SEQ ID NO: 11187 - DNA, 51 bp, Artificial Sequence
  Amplification primer (forwards)
ggggacaagtttgtacaaaaaagcaggctctacaaatactttgaaaaaaga

SEQ ID NO: 11188 - DNA, 50 bp, Artificial Sequence
  Amplification primer (forwards)
ggggacaagtttgtacaaaaaagcaggctctaatttatttaaacgttcct

SEQ ID NO: 11189 - DNA, 47 bp, Artificial Sequence
  Amplification primer (forwards)
ggggacaagtttgtacaaaaaagcaggctctaaaaagcggctagtca

SEQ ID NO: 11190 - DNA, 49 bp, Artificial Sequence
  Amplification primer (forwards)
ggggacaagtttgtacaaaaaagcaggctctggacaaaaatcaaaaata

SEQ ID NO: 11191 - DNA, 49 bp, Artificial Sequence; identical to SEQ ID NO: 11190
  Amplification primer (forwards)

SEQ ID NO: 11192 - DNA, 48 bp, Artificial Sequence
  Amplification primer (forwards)
ggggacaagtttgtacaaaaaagcaggctctggaggaaaatttcagaa

SEQ ID NO: 11193 - DNA, 50 bp, Artificial Sequence
  Amplification primer (forwards)
ggggacaagtttgtacaaaaaagcaggctctacctcatatccttttattt

SEQ ID NO: 11194 - DNA, 44 bp, Artificial Sequence
  Amplification primer (forwards)
ggggacaagtttgtacaaaaaagcaggctgtggacatcgtggtg

SEQ ID NO: 11195 - DNA, 50 bp, Artificial Sequence
  Amplification primer (forwards)
ggggacaagtttgtacaaaaaagcaggctctaagactaaaaaaatcatca

SEQ ID NO: 11196 - DNA, 49 bp, Artificial Sequence
  Amplification primer (forwards)
ggggacaagtttgtacaaaaaagcaggctctaaacacaccagtaaagaa

SEQ ID NO: 11197 - DNA, 52 bp, Artificial Sequence
  Amplification primer (forwards)
ggggacaagtttgtacaaaaaagcaggctctaaaaataaaaaaatcttattt

SEQ ID NO: 11198 - DNA, 49 bp, Artificial Sequence
  Amplification primer (forwards)
ggggacaagtttgtacaaaaaagcaggcttaataaaaggattattgtca

SEQ ID NO: 11199 - DNA, 48 bp, Artificial Sequence
  Amplification primer (forwards)
ggggacaagtttgtacaaaaaagcaggctctgctcgtttaataccaca

SEQ ID NO: 11200 - DNA, 49 bp, Artificial Sequence
  Amplification primer (forwards)
ggggacaagtttgtacaaaaaagcaggctctaacactaacatccctagc

SEQ ID NO: 11201 - DNA, 49 bp, Artificial Sequence
  Amplification primer (forwards)
ggggacaagtttgtacaaaaaagcaggctctagagggaaggttatttac

SEQ ID NO: 11202 - DNA, 51 bp, Artificial Sequence
  Amplification primer (forwards)
ggggacaagtttgtacaaaaaagcaggctctatcaataaagtaacagctca

SEQ ID NO: 11203 - DNA, 53 bp, Artificial Sequence
  Amplification primer (forwards)
ggggacaagtttgtacaaaaaagcaggctctagaacactatttagaatgatat

SEQ ID NO: 11204 - DNA, 45 bp, Artificial Sequence
  Amplification primer (forwards)
ggggacaagtttgtacaaaaaagcaggctactatgcgaatcacag

SEQ ID NO: 11205 - DNA, 48 bp, Artificial Sequence
  Amplification primer (forwards)
ggggacaagtttgtacaaaaaagcaggctctagtttagcattgcaaat

SEQ ID NO: 11206 - DNA, 50 bp, Artificial Sequence
  Amplification primer (forwards)
ggggacaagtttgtacaaaaaagcaggctctacattttataaaaagacgg

SEQ ID NO: 11207 - DNA, 51 bp, Artificial Sequence
  Amplification primer (forwards)
ggggacaagtttgtacaaaaaagcaggctctaagaaaatacgaagctatac

SEQ ID NO: 11208 - DNA, 49 bp, Artificial Sequence
  Amplification primer (forwards)
ggggacaagtttgtacaaaaaagcaggctctggaggaaatgaaatatta

SEQ ID NO: 11209 - DNA, 51 bp, Artificial Sequence
  Amplification primer (forwards)
ggggacaagtttgtacaaaaaagcaggctctggtatgtctaataaggaaat

SEQ ID NO: 11210 - DNA, 51 bp, Artificial Sequence
  Amplification primer (forwards)
ggggacaagtttgtacaaaaaagcaggctctaacaaacttattacagaaaa

SEQ ID NO: 11211 - DNA, 50 bp, Artificial Sequence
  Amplification primer (forwards)
ggggacaagtttgtacaaaaaagcaggctctgtttcatatgaaaaagtcc

SEQ ID NO: 11212 - DNA, 52 bp, Artificial Sequence
  Amplification primer (forwards)
ggggacaagtttgtacaaaaaagcaggctctagtagaggtatttttttacaa

SEQ ID NO: 11213 - DNA, 47 bp, Artificial Sequence
  Amplification primer (forwards)
ggggacaagtttgtacaaaaaagcaggctctgaacgtcgggtaagtc

SEQ ID NO: 11214 - DNA, 47 bp, Artificial Sequence
  Amplification primer (forwards)
ggggacaagtttgtacaaaaaagcaggctttttaatcgattttattt

SEQ ID NO: 11215 - DNA, 48 bp, Artificial Sequence
  Amplification primer (forwards)
ggggacaagtttgtacaaaaaagcaggctcattaattattcttacggt

SEQ ID NO: 11216 - DNA, 48 bp, Artificial Sequence
  Amplification primer (forwards)
ggggacaagtttgtacaaaaaagcaggctctttatacgttgttaaaca

SEQ ID NO: 11217 - DNA, 46 bp, Artificial Sequence
  Amplification primer (forwards)
ggggacaagtttgtacaaaaaagcaggctggctaagtaagcatgag

SEQ ID NO: 11218 - DNA, 44 bp, Artificial Sequence
  Amplification primer (forwards)
ggggacaagtttgtacaaaaaagcaggcttcccagctagctgtc

SEQ ID NO: 11219 - DNA, 52 bp, Artificial Sequence
  Amplification primer (forwards)
ggggacaagtttgtacaaaaaagcaggctctatagaaattgctgtattaatt

SEQ ID NO: 11220 - DNA, 50 bp, Artificial Sequence
  Amplification primer (forwards)
ggggacaagtttgtacaaaaaagcaggctctattcgatttcttattcttg

SEQ ID NO: 11221 - DNA, 48 bp, Artificial Sequence
  Amplification primer (forwards)
ggggacaagtttgtacaaaaaagcaggctctgactcaaccacagtctc

SEQ ID NO: 11222 - DNA, 48 bp, Artificial Sequence
  Amplification primer (forwards)
ggggacaagtttgtacaaaaaagcaggctctgcagaccttacaagtca

SEQ ID NO: 11223 - DNA, 49 bp, Artificial Sequence
  Amplification primer (forwards)
ggggacaagtttgtacaaaaaagcaggctctattgtatttgctattgca

SEQ ID NO: 11224 - DNA, 51 bp, Artificial Sequence
  Amplification primer (forwards)
ggggacaagtttgtacaaaaaagcaggctctgatattttttcagctattga

SEQ ID NO: 11225 - DNA, 49 bp, Artificial Sequence
  Amplification primer (forwards)
ggggacaagtttgtacaaaaaagcaggctctgttagtgctgctattgaa

SEQ ID NO: 11226 - DNA, 51 bp, Artificial Sequence
  Amplification primer (forwards)
ggggacaagtttgtacaaaaaagcaggctctaagaagcttacttttatttg

SEQ ID NO: 11227 - DNA, 46 bp, Artificial Sequence
  Amplification primer (forwards)
ggggacaagtttgtacaaaaaagcaggctcaaaaggatattcaaga

SEQ ID NO: 11228 - DNA, 54 bp, Artificial Sequence
  Amplification primer (forwards)
ggggacaagtttgtacaaaaaagcaggctctcataatatattaagatttttagg

SEQ ID NO: 11229 - DNA, 48 bp, Artificial Sequence
  Amplification primer (forwards)
ggggacaagtttgtacaaaaaagcaggctctattcttggtcaagatgt

SEQ ID NO: 11230 - DNA, 50 bp, Artificial Sequence
  Amplification primer (forwards)
ggggacaagtttgtacaaaaaagcaggctctcatgaaaatgttaaaaaag

SEQ ID NO: 11231 - DNA, 48 bp, Artificial Sequence
  Amplification primer (forwards)
ggggacaagtttgtacaaaaaagcaggctctaagtcaacggtaacaaa

SEQ ID NO: 11232 - DNA, 44 bp, Artificial Sequence
  Amplification primer (forwards)
ggggacaagtttgtacaaaaaagcaggcaggaaacgtttttcct

SEQ ID NO: 11233 - DNA, 49 bp, Artificial Sequence
  Amplification primer (forwards)
ggggacaagtttgtacaaaaaagcaggctctaaccataagggaaaagta

SEQ ID NO: 11234 - DNA, 49 bp, Artificial Sequence
  Amplification primer (forwards)
ggggacaagtttgtacaaaaaagcaggctctgctaaacaattaattggt

SEQ ID NO: 11235 - DNA, 49 bp, Artificial Sequence
  Amplification primer (forwards)
ggggacaagtttgtacaaaaaagcaggctctttgatggtgttgttattc

SEQ ID NO: 11236 - DNA, 50 bp, Artificial Sequence
  Amplification primer (forwards)
ggggacaagtttgtacaaaaaagcaggctctaaaacttatttgtcaaatg

SEQ ID NO: 11237 - DNA, 44 bp, Artificial Sequence
  Amplification primer (forwards)
ggggacaagtttgtacaaaaaagcaggctgggcttaccatactg

SEQ ID NO: 11238 - DNA, 47 bp, Artificial Sequence
  Amplification primer (forwards)
ggggacaagtttgtacaaaaaagcaggctctggccttaatcttaagc

SEQ ID NO: 11239 - DNA, 50 bp, Artificial Sequence
  Amplification primer (forwards)
ggggacaagtttgtacaaaaaagcaggctctcaatattttttgaaacaag

SEQ ID NO: 11240 - DNA, 48 bp, Artificial Sequence
  Amplification primer (forwards)
ggggacaagtttgtacaaaaaagcaggctttatttcaggttatatcaa

SEQ ID NO: 11241 - DNA, 48 bp, Artificial Sequence
  Amplification primer (forwards)
ggggacaagtttgtacaaaaaagcaggctctgaaaattggaagtttgc

SEQ ID NO: 11242 - DNA, 47 bp, Artificial Sequence
  Amplification primer (forwards)
ggggacaagtttgtacaaaaaagcaggctctattgaaaagggagttg

SEQ ID NO: 11243 - DNA, 50 bp, Artificial Sequence
  Amplification primer (forwards)
ggggacaagtttgtacaaaaaagcaggctctattgttggtagagaaatca

SEQ ID NO: 11244 - DNA, 48 bp, Artificial Sequence
  Amplification primer (forwards)
ggggacaagtttgtacaaaaaagcaggctatcatgtaaaaattgatca

SEQ ID NO: 11245 - DNA, 51 bp, Artificial Sequence
  Amplification primer (forwards)
ggggacaagtttgtacaaaaaagcaggctctgattttttatacaaaggagg

SEQ ID NO: 11246 - DNA, 52 bp, Artificial Sequence
  Amplification primer (forwards)
ggggacaagtttgtacaaaaaagcaggctctgaacgttatacagataaaatg

SEQ ID NO: 11247 - DNA, 49 bp, Artificial Sequence
  Amplification primer (forwards)
ggggacaagtttgtacaaaaaagcaggctctctttctcgtaaaaaagag

SEQ ID NO: 11248 - DNA, 52 bp, Artificial Sequence
  Amplification primer (forwards)
ggggacaagtttgtacaaaaaagcaggctctactcttgtcttagttgtttat

SEQ ID NO: 11249 - DNA, 50 bp, Artificial Sequence
  Amplification primer (forwards)
ggggacaagtttgtacaaaaaagcaggctctataaagaaagctgaaaatc

SEQ ID NO: 11250 - DNA, 51 bp, Artificial Sequence
  Amplification primer (forwards)
ggggacaagtttgtacaaaaaagcaggctctataaaaaatgctatagcata

SEQ ID NO: 11251 - DNA, 50 bp, Artificial Sequence
  Amplification primer (forwards)
ggggacaagtttgtacaaaaaagcaggctctcagccttctaaactacttc

SEQ ID NO: 11252 - DNA, 49 bp, Artificial Sequence
  Amplification primer (forwards)
ggggacaagtttgtacaaaaaagcaggctctgatttgtttagcatgttg

SEQ ID NO: 11253 - DNA, 47 bp, Artificial Sequence
  Amplification primer (forwards)
ggggacaagtttgtacaaaaaagcaggctctcttgcttccctgattt

SEQ ID NO: 11254 - DNA, 50 bp, Artificial Sequence
  Amplification primer (forwards)
ggggacaagtttgtacaaaaaagcaggctctcatcaatcaaatcattatc

SEQ ID NO: 11255 - DNA, 49 bp, Artificial Sequence
  Amplification primer (forwards)
ggggacaagtttgtacaaaaaagcaggctctatctttattatcggacaa

SEQ ID NO: 11256 - DNA, 52 bp, Artificial Sequence
  Amplification primer (forwards)
ggggacaagtttgtacaaaaaagcaggctctaaagaatttattaaagaatgg

SEQ ID NO: 11257 - DNA, 47 bp, Artificial Sequence
  Amplification primer (forwards)
ggggacaagtttgtacaaaaaagcaggctctgcagatgatggtggtt

SEQ ID NO: 11258 - DNA, 47 bp, Artificial Sequence
  Amplification primer (forwards)
ggggacaagtttgtacaaaaaagcaggcttaaatgatgcaataacaa

SEQ ID NO: 11259 - DNA, 44 bp, Artificial Sequence
  Amplification primer (forwards)
ggggacaagtttgtacaaaaaagcaggcttgctggattatcctc

SEQ ID NO: 11260 - DNA, 50 bp, Artificial Sequence
  Amplification primer (forwards)
ggggacaagtttgtacaaaaaagcaggctctgtatttatggcaaataaga

SEQ ID NO: 11261 - DNA, 49 bp, Artificial Sequence
  Amplification primer (forwards)
ggggacaagtttgtacaaaaaagcaggctctatgagttctctggaagtt

SEQ ID NO: 11262 - DNA, 47 bp, Artificial Sequence
  Amplification primer (forwards)
ggggacaagtttgtacaaaaaagcaggctctggtgtcctcaactctg

SEQ ID NO: 11263 - DNA, 48 bp, Artificial Sequence
  Amplification primer (forwards)
ggggacaagtttgtacaaaaaagcaggctctgttcatgattttggtga

SEQ ID NO: 11264 - DNA, 47 bp, Artificial Sequence
  Amplification primer (forwards)
ggggacaagtttgtacaaaaaagcaggctctggggtttggttttata

SEQ ID NO: 11265 - DNA, 49 bp, Artificial Sequence
  Amplification primer (forwards)
ggggacaagtttgtacaaaaaagcaggctctcaatcagacattaaagca

SEQ ID NO: 11266 - DNA, 47 bp, Artificial Sequence
  Amplification primer (forwards)
ggggacaagtttgtacaaaaaagcaggctctatttggaggggggaaa

SEQ ID NO: 11267 - DNA, 47 bp, Artificial Sequence
  Amplification primer (forwards)
ggggacaagtttgtacaaaaaagcaggctctaccaaatttgactggg

SEQ ID NO: 11268 - DNA, 47 bp, Artificial Sequence
  Amplification primer (forwards)
ggggacaagtttgtacaaaaaagcaggctctgttacgtttttcttat

SEQ ID NO: 11269 - DNA, 52 bp, Artificial Sequence
  Amplification primer (forwards)
ggggacaagtttgtacaaaaaagcaggctctaaaaagaaaagtttaattagc

SEQ ID NO: 11270 - DNA, 47 bp, Artificial Sequence
  Amplification primer (forwards)
ggggacaagtttgtacaaaaaagcaggctttgatttttttaagaaaa

SEQ ID NO: 11271 - DNA, 53 bp, Artificial Sequence
  Amplification primer (forwards)
ggggacaagtttgtacaaaaaagcaggctctaagaaattaattataggtattt

SEQ ID NO: 11272 - DNA, 47 bp, Artificial Sequence
  Amplification primer (forwards)
ggggacaagtttgtacaaaaaagcaggctctggtttttcgtttttga

SEQ ID NO: 11273 - DNA, 50 bp, Artificial Sequence
  Amplification primer (forwards)
ggggacaagtttgtacaaaaaagcaggctctctattctcagatgaaacaa

SEQ ID NO: 11274 - DNA, 52 bp, Artificial Sequence
  Amplification primer (forwards)
ggggacaagtttgtacaaaaaagcaggctctgttaaattaaaatcgttactg

SEQ ID NO: 11275 - DNA, 47 bp, Artificial Sequence
  Amplification primer (forwards)
ggggacaagtttgtacaaaaaagcaggctctatgcaacgattaggac

SEQ ID NO: 11276 - DNA, 45 bp, Artificial Sequence
  Amplification primer (forwards)
ggggacaagtttgtacaaaaaagcaggcttaggtgaaagcaaatc

SEQ ID NO: 11277 - DNA, 50 bp, Artificial Sequence
  Amplification primer (forwards)
ggggacaagtttgtacaaaaaagcaggctctggaggattttatatgaaag

SEQ ID NO: 11278 - DNA, 49 bp, Artificial Sequence
  Amplification primer (forwards)
ggggacaagtttgtacaaaaaagcaggctctgcacacacacctactagt

SEQ ID NO: 11279 - DNA, 47 bp, Artificial Sequence
  Amplification primer (forwards)
ggggacaagtttgtacaaaaaagcaggctctaacaatcgttcaaagc

SEQ ID NO: 11280 - DNA, 51 bp, Artificial Sequence
  Amplification primer (forwards)
ggggacaagtttgtacaaaaaagcaggctctaaaaagtttttaaaagtttt

SEQ ID NO: 11281 - DNA, 46 bp, Artificial Sequence
  Amplification primer (forwards)
ggggacaagtttgtacaaaaaagcaggctggaataatcatcagtca

SEQ ID NO: 11282 - DNA, 47 bp, Artificial Sequence
  Amplification primer (forwards)
ggggacaagtttgtacaaaaaagcaggctctcaatctaaagggcaaa

SEQ ID NO: 11283 - DNA, 47 bp, Artificial Sequence; identical to SEQ ID NO: 11282
  Amplification primer (forwards)

SEQ ID NO: 11284 - DNA, 50 bp, Artificial Sequence
  Amplification primer (forwards)
ggggacaagtttgtacaaaaaagcaggctattacttatcaaaagaaaagg

SEQ ID NO: 11285 - DNA, 51 bp, Artificial Sequence
  Amplification primer (forwards)
ggggacaagtttgtacaaaaaagcaggctctcaagtattaaatgacaatgg

SEQ ID NO: 11286 - DNA, 46 bp, Artificial Sequence
  Amplification primer (forwards)
ggggacaagtttgtacaaaaaagcaggcttgaatcgtaaaaaaagg

SEQ ID NO: 11287 - DNA, 47 bp, Artificial Sequence
  Amplification primer (forwards)
ggggacaagtttgtacaaaaaagcaggctctatgggtctagcaacaa

SEQ ID NO: 11288 - DNA, 47 bp, Artificial Sequence; identical to SEQ ID NO: 11287
  Amplification primer (forwards)

SEQ ID NO: 11289 - DNA, 48 bp, Artificial Sequence
  Amplification primer (forwards)
ggggacaagtttgtacaaaaaagcaggctctgttacagctaaacacgg

SEQ ID NO: 11290 - DNA, 49 bp, Artificial Sequence
  Amplification primer (forwards)
ggggacaagtttgtacaaaaaagcaggctctggtcattttagtgaaaaa

SEQ ID NO: 11291 - DNA, 48 bp, Artificial Sequence
  Amplification primer (forwards)
ggggacaagtttgtacaaaaaagcaggctctagcgacataaaaatcat

SEQ ID NO: 11292 - DNA, 49 bp, Artificial Sequence
  Amplification primer (forwards)
ggggacaagtttgtacaaaaaagcaggctctaaaggtattattttagcg

SEQ ID NO: 11293 - DNA, 48 bp, Artificial Sequence
  Amplification primer (forwards)
ggggacaagtttgtacaaaaaagcaggctctattcagattggcaaatt

SEQ ID NO: 11294 - DNA, 52 bp, Artificial Sequence
  Amplification primer (forwards)
ggggacaagtttgtacaaaaaagcaggctctactaaatttattgttgattca

SEQ ID NO: 11295 - DNA, 47 bp, Artificial Sequence
  Amplification primer (forwards)
ggggacaagtttgtacaaaaaagcaggctttgaaatacttaaacctg

SEQ ID NO: 11296 - DNA, 51 bp, Artificial Sequence
  Amplification primer (forwards)
ggggacaagtttgtacaaaaaagcaggctctgcttctacaaataatgtttc

SEQ ID NO: 11297 - DNA, 51 bp, Artificial Sequence
  Amplification primer (forwards)
ggggacaagtttgtacaaaaaagcaggctctgtaattaatattgagcaagc

SEQ ID NO: 11298 - DNA, 50 bp, Artificial Sequence
  Amplification primer (forwards)
ggggacaagtttgtacaaaaaagcaggctctgaaatcaacactgaaatag

SEQ ID NO: 11299 - DNA, 51 bp, Artificial Sequence
  Amplification primer (forwards)
ggggacaagtttgtacaaaaaagcaggctctacaaggcatataaaaatttc

SEQ ID NO: 11300 - DNA, 48 bp, Artificial Sequence
  Amplification primer (forwards)
ggggacaagtttgtacaaaaaagcaggctctaacgaaatcaaatgccc

SEQ ID NO: 11301 - DNA, 49 bp, Artificial Sequence
  Amplification primer (forwards)
ggggacaagtttgtacaaaaaagcaggctctggacgagtaatgaaaaca

SEQ ID NO: 11302 - DNA, 48 bp, Artificial Sequence
  Amplification primer (forwards)
ggggacaagtttgtacaaaaaagcaggctctgggaaaaaaattgtttt

SEQ ID NO: 11303 - DNA, 53 bp, Artificial Sequence
  Amplification primer (forwards)
ggggacaagtttgtacaaaaaagcaggctctaaatttacagaacttaacttat

SEQ ID NO: 11304 - DNA, 47 bp, Artificial Sequence
  Amplification primer (forwards)
ggggacaagtttgtacaaaaaagcaggcatgacacagatgaatttta

SEQ ID NO: 11305 - DNA, 44 bp, Artificial Sequence
  Amplification primer (forwards)
ggggacaagtttgtacaaaaaagcaggcttgcaacttggaattg

SEQ ID NO: 11306 - DNA, 49 bp, Artificial Sequence
  Amplification primer (forwards)
ggggacaagtttgtacaaaaaagcaggctctgctaaagagagggtagat

SEQ ID NO: 11307 - DNA, 49 bp, Artificial Sequence
  Amplification primer (forwards)
ggggacaagtttgtacaaaaaagcaggctcaattattactgatgtttac

SEQ ID NO: 11308 - DNA, 49 bp, Artificial Sequence
  Amplification primer (forwards)
ggggacaagtttgtacaaaaaagcaggctctactgcaactaaacaacat

SEQ ID NO: 11309 - DNA, 49 bp, Artificial Sequence
  Amplification primer (forwards)
ggggacaagtttgtacaaaaaagcaggctctaaacgtattgctgtttta

SEQ ID NO: 11310 - DNA, 52 bp, Artificial Sequence
  Amplification primer (forwards)
ggggacaagtttgtacaaaaaagcaggctctaaattttatcttgttagacac

SEQ ID NO: 11311 - DNA, 50 bp, Artificial Sequence
  Amplification primer (forwards)
ggggacaagtttgtacaaaaaagcaggctctataggggattattcagtaa

SEQ ID NO: 11312 - DNA, 48 bp, Artificial Sequence
  Amplification primer (forwards)
ggggacaagtttgtacaaaaaagcaggctctactgaacgaacattcga

SEQ ID NO: 11313 - DNA, 50 bp, Artificial Sequence
  Amplification primer (forwards)
ggggacaagtttgtacaaaaaagcaggctctaataagccatattcaatag

SEQ ID NO: 11314 - DNA, 50 bp, Artificial Sequence; identical to SEQ ID NO: 11313
  Amplification primer (forwards)

SEQ ID NO: 11315 - DNA, 48 bp, Artificial Sequence
  Amplification primer (forwards)
ggggacaagtttgtacaaaaaagcaggctctgacttgaatggcaatat

SEQ ID NO: 11316 - DNA, 53 bp, Artificial Sequence
  Amplification primer (forwards)
ggggacaagtttgtacaaaaaagcaggctctattgattttattatttctattg

SEQ ID NO: 11317 - DNA, 48 bp, Artificial Sequence
  Amplification primer (forwards)
ggggacaagtttgtacaaaaaagcaggcttaaaacattttggtagtaa

SEQ ID NO: 11318 - DNA, 50 bp, Artificial Sequence
  Amplification primer (forwards)
ggggacaagtttgtacaaaaaagcaggctctactatttatgaccaaattg

SEQ ID NO: 11319 - DNA, 51 bp, Artificial Sequence
  Amplification primer (forwards)
ggggacaagtttgtacaaaaaagcaggctctaaaaataaaaaagatcagtt

SEQ ID NO: 11320 - DNA, 49 bp, Artificial Sequence
  Amplification primer (forwards)
ggggacaagtttgtacaaaaaagcaggctctcaagaaacagatacgacg

SEQ ID NO: 11321 - DNA, 49 bp, Artificial Sequence
  Amplification primer (forwards)
ggggacaagtttgtacaaaaaagcaggctctggtaatgagtcaaagaac

SEQ ID NO: 11322 - DNA, 48 bp, Artificial Sequence
  Amplification primer (forwards)
ggggacaagtttgtacaaaaaagcaggctctggaagtaaatcagcttc

SEQ ID NO: 11323 - DNA, 47 bp, Artificial Sequence
  Amplification primer (forwards)
ggggacaagtttgtacaaaaaagcaggctctgcttggcaacttgttc

SEQ ID NO: 11324 - DNA, 48 bp, Artificial Sequence
  Amplification primer (forwards)
ggggacaagtttgtacaaaaaagcaggctctggcatctcagacttacc

SEQ ID NO: 11325 - DNA, 47 bp, Artificial Sequence
  Amplification primer (forwards)
ggggacaagtttgtacaaaaaagcaggctctaaattcaaatctgggg

SEQ ID NO: 11326 - DNA, 47 bp, Artificial Sequence; identical to SEQ ID NO: 11325
  Amplification primer (forwards)

SEQ ID NO: 11327 - DNA, 47 bp, Artificial Sequence
  Amplification primer (forwards)
ggggacaagtttgtacaaaaaagcaggctctggagggaaaatgaatc

SEQ ID NO: 11328 - DNA, 47 bp, Artificial Sequence; identical to SEQ ID NO: 11327
  Amplification primer (forwards)

SEQ ID NO: 11329 - DNA, 47 bp, Artificial Sequence
  Amplification primer (forwards)
ggggacaagtttgtacaaaaaagcaggctctggcaacttcaaagcat

SEQ ID NO: 11330 - DNA, 47 bp, Artificial Sequence
  Amplification primer (forwards)
ggggacaagtttgtacaaaaaagcaggctctgaccaagtcggtgtcc

SEQ ID NO: 11331 - DNA, 50 bp, Artificial Sequence
  Amplification primer (forwards)
ggggacaagtttgtacaaaaaagcaggctctaaatcaaagacctcttcta

SEQ ID NO: 11332 - DNA, 49 bp, Artificial Sequence
  Amplification primer (forwards)
ggggacaagtttgtacaaaaaagcaggctctaataaacgcgtaaaaatc

SEQ ID NO: 11333 - DNA, 48 bp, Artificial Sequence
  Amplification primer (forwards)
ggggacaagtttgtacaaaaaagcaggctctaccagaacagtagcaat

SEQ ID NO: 11334 - DNA, 50 bp, Artificial Sequence
  Amplification primer (forwards)
ggggacaagtttgtacaaaaaagcaggctctacaaaaaacctgttattaa

SEQ ID NO: 11335 - DNA, 52 bp, Artificial Sequence
  Amplification primer (forwards)
ggggacaagtttgtacaaaaaagcaggctctattgatatacaaaaaataaaa

SEQ ID NO: 11336 - DNA, 47 bp, Artificial Sequence
  Amplification primer (forwards)
ggggacaagtttgtacaaaaaagcaggctctggatcattgagggcaa

SEQ ID NO: 11337 - DNA, 53 bp, Artificial Sequence
  Amplification primer (forwards)
ggggacaagtttgtacaaaaaagcaggctctaatttagtaaaagtgaatagtg

SEQ ID NO: 11338 - DNA, 51 bp, Artificial Sequence
  Amplification primer (forwards)
ggggacaagtttgtacaaaaaagcaggctctgaagaagaaaaatattttga

SEQ ID NO: 11339 - DNA, 49 bp, Artificial Sequence
  Amplification primer (forwards)
ggggacaagtttgtacaaaaaagcaggctctcaggttgaagttgactta

SEQ ID NO: 11340 - DNA, 49 bp, Artificial Sequence
  Amplification primer (forwards)
ggggacaagtttgtacaaaaaagcaggctctgaaacagattcgtttgta

SEQ ID NO: 11341 - DNA, 49 bp, Artificial Sequence
  Amplification primer (forwards)
ggggacaagtttgtacaaaaaagcaggctctgctataatagacaaaaag

SEQ ID NO: 11342 - DNA, 45 bp, Artificial Sequence
  Amplification primer (forwards)
ggggacaagtttgtacaaaaaagcaggctcgaaaccgattaagat

SEQ ID NO: 11343 - DNA, 47 bp, Artificial Sequence
  Amplification primer (forwards)
ggggacaagtttgtacaaaaaagcaggctctcaagtcatgcgctatg

SEQ ID NO: 11344 - DNA, 52 bp, Artificial Sequence
  Amplification primer (forwards)
ggggacaagtttgtacaaaaaagcaggctctggatttctctataattacttc

SEQ ID NO: 11345 - DNA, 48 bp, Artificial Sequence
  Amplification primer (forwards)
ggggacaagtttgtacaaaaaagcaggctctggaaaaccattgttaac

SEQ ID NO: 11346 - DNA, 49 bp, Artificial Sequence
  Amplification primer (forwards)
ggggacaagtttgtacaaaaaagcaggctctcagaaaattgaaggtatt

SEQ ID NO: 11347 - DNA, 47 bp, Artificial Sequence
  Amplification primer (forwards)
ggggacaagtttgtacaaaaaagcaggctctgaaatgcaagttcaaa

SEQ ID NO: 11348 - DNA, 47 bp, Artificial Sequence
  Amplification primer (forwards)
ggggacaagtttgtacaaaaaagcaggctctgcacaacgcagaatgt

SEQ ID NO: 11349 - DNA, 47 bp, Artificial Sequence
  Amplification primer (forwards)
ggggacaagtttgtacaaaaaagcaggctctaaaaacctgaattggg

SEQ ID NO: 11350 - DNA, 53 bp, Artificial Sequence
  Amplification primer (forwards)
ggggacaagtttgtacaaaaaagcaggctctaataaaatagctaatacagaag

SEQ ID NO: 11351 - DNA, 52 bp, Artificial Sequence
  Amplification primer (forwards)
ggggacaagtttgtacaaaaaagcaggctctattgatattcattctcatatc

SEQ ID NO: 11352 - DNA, 51 bp, Artificial Sequence
  Amplification primer (forwards)
ggggacaagtttgtacaaaaaagcaggctctactggatctaaaaaattagc

SEQ ID NO: 11353 - DNA, 52 bp, Artificial Sequence
  Amplification primer (forwards)
ggggacaagtttgtacaaaaaagcaggctctaaagatcgcttatataataaa

SEQ ID NO: 11354 - DNA, 52 bp, Artificial Sequence
  Amplification primer (forwards)
ggggacaagtttgtacaaaaaagcaggctctgcaaaagatataattaaggtt

SEQ ID NO: 11355 - DNA, 45 bp, Artificial Sequence
  Amplification primer (forwards)
ggggacaagtttgtacaaaaaagcaggctcagaagatcaaaaaca

SEQ ID NO: 11356 - DNA, 51 bp, Artificial Sequence
  Amplification primer (forwards)
ggggacaagtttgtacaaaaaagcaggctctactttttttaaaaagctaaa

SEQ ID NO: 11357 - DNA, 51 bp, Artificial Sequence
  Amplification primer (forwards)
ggggacaagtttgtacaaaaaagcaggctctggtacagatagtaaatttgg

SEQ ID NO: 11358 - DNA, 50 bp, Artificial Sequence
  Amplification primer (forwards)
ggggacaagtttgtacaaaaaagcaggctctacaatgttaaaaattgaaa

SEQ ID NO: 11359 - DNA, 52 bp, Artificial Sequence
  Amplification primer (forwards)
ggggacaagtttgtacaaaaaagcaggctctattaaagaactaaaagaattt

SEQ ID NO: 11360 - DNA, 44 bp, Artificial Sequence
  Amplification primer (forwards)
ggggacaagtttgtacaaaaaagcaggctctcgctcactacctt

SEQ ID NO: 11361 - DNA, 53 bp, Artificial Sequence
  Amplification primer (forwards)
ggggacaagtttgtacaaaaaagcaggctctaaattctatattattgatgatg

SEQ ID NO: 11362 - DNA, 48 bp, Artificial Sequence
  Amplification primer (forwards)
ggggacaagtttgtacaaaaaagcaggcttggaacatttttatattat

SEQ ID NO: 11363 - DNA, 47 bp, Artificial Sequence
  Amplification primer (forwards)
ggggacaagtttgtacaaaaaagcaggcttttatacaattgaagagc

SEQ ID NO: 11364 - DNA, 46 bp, Artificial Sequence
  Amplification primer (forwards)
ggggacaagtttgtacaaaaaagcaggctcaagaaataattacggt

SEQ ID NO: 11365 - DNA, 47 bp, Artificial Sequence
  Amplification primer (forwards)
ggggacaagtttgtacaaaaaagcaggctctataatgaaggcggtct

SEQ ID NO: 11366 - DNA, 49 bp, Artificial Sequence
  Amplification primer (forwards)
ggggacaagtttgtacaaaaaagcaggctctagcgtatatgttagtgga

SEQ ID NO: 11367 - DNA, 47 bp, Artificial Sequence
  Amplification primer (forwards)
ggggacaagtttgtacaaaaaagcaggctctactaaaccacaggggg

SEQ ID NO: 11368 - DNA, 47 bp, Artificial Sequence; identical to SEQ ID NO: 11367
  Amplification primer (forwards)

SEQ ID NO: 11369 - DNA, 51 bp, Artificial Sequence
  Amplification primer (forwards)
ggggacaagtttgtacaaaaaagcaggctctggtaatgaaggaaatatcac

SEQ ID NO: 11370 - DNA, 50 bp, Artificial Sequence
  Amplification primer (forwards)
ggggacaagtttgtacaaaaaagcaggctctctcgaattaaaaaatattg

SEQ ID NO: 11371 - DNA, 49 bp, Artificial Sequence
  Amplification primer (forwards)
ggggacaagtttgtacaaaaaagcaggctctaactatatgggtatgggc

SEQ ID NO: 11372 - DNA, 52 bp, Artificial Sequence
  Amplification primer (forwards)
ggggacaagtttgtacaaaaaagcaggctctggaactgctacatatagtagg

SEQ ID NO: 11373 - DNA, 45 bp, Artificial Sequence
  Amplification primer (forwards)
ggggacaagtttgtacaaaaaagcaggctggcttgacattatttt

SEQ ID NO: 11374 - DNA, 51 bp, Artificial Sequence
  Amplification primer (forwards)
ggggacaagtttgtacaaaaaagcaggctctaagaaattaaaaatattccc

SEQ ID NO: 11375 - DNA, 49 bp, Artificial Sequence
  Amplification primer (forwards)
ggggacaagtttgtacaaaaaagcaggctctaaaatcattattcaacgt

SEQ ID NO: 11376 - DNA, 48 bp, Artificial Sequence
  Amplification primer (forwards)
ggggacaagtttgtacaaaaaagcaggctctagtagaatgattccagg

SEQ ID NO: 11377 - DNA, 47 bp, Artificial Sequence
  Amplification primer (forwards)
ggggacaagtttgtacaaaaaagcaggctctaccgaatttaatgacg

SEQ ID NO: 11378 - DNA, 53 bp, Artificial Sequence
  Amplification primer (forwards)
ggggacaagtttgtacaaaaaagcaggctctaaagatagatatattttagcag

SEQ ID NO: 11379 - DNA, 46 bp, Artificial Sequence
  Amplification primer (forwards)
ggggacaagtttgtacaaaaaagcaggctcagaaaaatattccact

SEQ ID NO: 11380 - DNA, 47 bp, Artificial Sequence
  Amplification primer (forwards)
ggggacaagtttgtacaaaaaagcaggctctgaaattggtcagcaaa

SEQ ID NO: 11381 - DNA, 53 bp, Artificial Sequence
  Amplification primer (forwards)
ggggacaagtttgtacaaaaaagcaggctctaagttcgaaaatataatatatg

SEQ ID NO: 11382 - DNA, 52 bp, Artificial Sequence
  Amplification primer (forwards)
ggggacaagtttgtacaaaaaagcaggctctgaaaaagaaactattttaagt

SEQ ID NO: 11383 - DNA, 50 bp, Artificial Sequence
  Amplification primer (forwards)
ggggacaagtttgtacaaaaaagcaggctctaaagaaaagaaaaatttgg

SEQ ID NO: 11384 - DNA, 51 bp, Artificial Sequence
  Amplification primer (forwards)
ggggacaagtttgtacaaaaaagcaggctctggtaataaactgatgtatca

SEQ ID NO: 11385 - DNA, 52 bp, Artificial Sequence
  Amplification primer (forwards)
ggggacaagtttgtacaaaaaagcaggctctgaagatcaactcactatattt

SEQ ID NO: 11386 - DNA, 47 bp, Artificial Sequence
  Amplification primer (forwards)
ggggacaagtttgtacaaaaaagcaggctctcaaattacccgagaag

SEQ ID NO: 11387 - DNA, 53 bp, Artificial Sequence
  Amplification primer (forwards)
ggggacaagtttgtacaaaaaagcaggctctcttaaaagattacttactgaag

SEQ ID NO: 11388 - DNA, 47 bp, Artificial Sequence
  Amplification primer (forwards)
ggggacaagtttgtacaaaaaagcaggctctcttgggatagctcaca

SEQ ID NO: 11389 - DNA, 54 bp, Artificial Sequence
  Amplification primer (forwards)
ggggacaagtttgtacaaaaaagcaggctctataaagtttaaattattttttaa

SEQ ID NO: 11390 - DNA, 53 bp, Artificial Sequence
  Amplification primer (forwards)
ggggacaagtttgtacaaaaaagcaggctctattttacagacgaatatactat

SEQ ID NO: 11391 - DNA, 48 bp, Artificial Sequence
  Amplification primer (forwards)
ggggacaagtttgtacaaaaaagcaggctctagaataattgttgtcgg

SEQ ID NO: 11392 - DNA, 46 bp, Artificial Sequence
  Amplification primer (forwards)
ggggacaagtttgtacaaaaaagcaggctctaatgtaaaaaaacgc

SEQ ID NO: 11393 - DNA, 51 bp, Artificial Sequence
  Amplification primer (forwards)
ggggacaagtttgtacaaaaaagcaggctctctagtatcaaaggagaaagc

SEQ ID NO: 11394 - DNA, 46 bp, Artificial Sequence
  Amplification primer (forwards)
ggggacaagtttgtacaaaaaagcaggctctggtatgttgttagca

SEQ ID NO: 11395 - DNA, 53 bp, Artificial Sequence
  Amplification primer (forwards)
ggggacaagtttgtacaaaaaagcaggctctcttatgataataaattcattcg

SEQ ID NO: 11396 - DNA, 52 bp, Artificial Sequence
  Amplification primer (forwards)
ggggacaagtttgtacaaaaaagcaggctctatgaatagtgaacataaaatt

SEQ ID NO: 11397 - DNA, 47 bp, Artificial Sequence
  Amplification primer (forwards)
ggggacaagtttgtacaaaaaagcaggctctagggaaacttactgga

SEQ ID NO: 11398 - DNA, 50 bp, Artificial Sequence
  Amplification primer (forwards)
ggggacaagtttgtacaaaaaagcaggctctaaaaaagtcatcgatttaa

SEQ ID NO: 11399 - DNA, 51 bp, Artificial Sequence
  Amplification primer (forwards)
ggggacaagtttgtacaaaaaagcaggctctattacatatgatttcacaag

SEQ ID NO: 11400 - DNA, 50 bp, Artificial Sequence
  Amplification primer (forwards)
ggggacaagtttgtacaaaaaagcaggctctaataaatcttggttgagaa

SEQ ID NO: 11401 - DNA, 48 bp, Artificial Sequence
  Amplification primer (forwards)
ggggacaagtttgtacaaaaaagcaggctctcctatgttgtctgttgg

SEQ ID NO: 11402 - DNA, 50 bp, Artificial Sequence
  Amplification primer (forwards)
ggggacaagtttgtacaaaaaagcaggctctacttatcaaaaaacagttg

SEQ ID NO: 11403 - DNA, 44 bp, Artificial Sequence
  Amplification primer (forwards)
ggggacaagtttgtacaaaaaagcaggctttgtcaaagggattt

SEQ ID NO: 11404 - DNA, 54 bp, Artificial Sequence
  Amplification primer (forwards)
ggggacaagtttgtacaaaaaagcaggctctaaattatttgataagtttataga

SEQ ID NO: 11405 - DNA, 48 bp, Artificial Sequence
  Amplification primer (forwards)
ggggacaagtttgtacaaaaaagcaggctctaaaactgctacagttag

SEQ ID NO: 11406 - DNA, 50 bp, Artificial Sequence
  Amplification primer (forwards)
ggggacaagtttgtacaaaaaagcaggctatttagaacaattaaaagagg

SEQ ID NO: 11407 - DNA, 52 bp, Artificial Sequence
  Amplification primer (forwards)
ggggacaagtttgtacaaaaaagcaggctctaaagttttagtagttgatgat

SEQ ID NO: 11408 - DNA, 47 bp, Artificial Sequence
  Amplification primer (forwards)
ggggacaagtttgtacaaaaaagcaggctctaaaatagttgaaggcg

SEQ ID NO: 11409 - DNA, 50 bp, Artificial Sequence
  Amplification primer (forwards)
ggggacaagtttgtacaaaaaagcaggctctggaattgaatttaaaaatg

SEQ ID NO: 11410 - DNA, 50 bp, Artificial Sequence
  Amplification primer (forwards)
ggggacaagtttgtacaaaaaagcaggctctggaaaatattttggtacag

SEQ ID NO: 11411 - DNA, 50 bp, Artificial Sequence
  Amplification primer (forwards)
ggggacaagtttgtacaaaaaagcaggctctgaggttagaatggtaactc

SEQ ID NO: 11412 - DNA, 51 bp, Artificial Sequence
  Amplification primer (forwards)
ggggacaagtttgtacaaaaaagcaggctctaaaatagatgacctaagaaa

SEQ ID NO: 11413 - DNA, 48 bp, Artificial Sequence
  Amplification primer (forwards)
ggggacaagtttgtacaaaaaagcaggcttgaaaattcagtattatca

SEQ ID NO: 11414 - DNA, 53 bp, Artificial Sequence
  Amplification primer (forwards)
ggggacaagtttgtacaaaaaagcaggctctgataaaaataatttagaagact

SEQ ID NO: 11415 - DNA, 48 bp, Artificial Sequence
  Amplification primer (forwards)
ggggacaagtttgtacaaaaaagcaggctctaaaattgacatgaggaa

SEQ ID NO: 11416 - DNA, 48 bp, Artificial Sequence; identical to SEQ ID NO: 11415
  Amplification primer (forwards)

SEQ ID NO: 11417 - DNA, 50 bp, Artificial Sequence
  Amplification primer (forwards)
ggggacaagtttgtacaaaaaagcaggctctaaccacttacttaacctca

SEQ ID NO: 11418 - DNA, 52 bp, Artificial Sequence
  Amplification primer (forwards)
ggggacaagtttgtacaaaaaagcaggctctaaggtagtagtagctattgat

SEQ ID NO: 11419 - DNA, 49 bp, Artificial Sequence
  Amplification primer (forwards)
ggggacaagtttgtacaaaaaagcaggctctactgaagagagaaatcct

SEQ ID NO: 11420 - DNA, 52 bp, Artificial Sequence
  Amplification primer (forwards)
ggggacaagtttgtacaaaaaagcaggctctgctttattatcagttattgtc

SEQ ID NO: 11421 - DNA, 54 bp, Artificial Sequence
  Amplification primer (forwards)
ggggacaagtttgtacaaaaaagcaggctctaaagactatattaacagaatatt

SEQ ID NO: 11422 - DNA, 47 bp, Artificial Sequence
  Amplification primer (forwards)
ggggacaagtttgtacaaaaaagcaggctctggattttttgcacagc

SEQ ID NO: 11423 - DNA, 48 bp, Artificial Sequence
  Amplification primer (forwards)
ggggacaagtttgtacaaaaaagcaggctctattgttggtgaacaaga

SEQ ID NO: 11424 - DNA, 47 bp, Artificial Sequence
  Amplification primer (forwards)
ggggacaagtttgtacaaaaaagcaggcttaaatcaatattttctgc

SEQ ID NO: 11425 - DNA, 47 bp, Artificial Sequence
  Amplification primer (forwards)
ggggacaagtttgtacaaaaaagcaggctctgagcgaattcctgttc

SEQ ID NO: 11426 - DNA, 48 bp, Artificial Sequence
  Amplification primer (forwards)
ggggacaagtttgtacaaaaaagcaggctctgaagtcattcgtgaaca

SEQ ID NO: 11427 - DNA, 49 bp, Artificial Sequence
  Amplification primer (forwards)
ggggacaagtttgtacaaaaaagcaggctcaaaacaatatgattatatc

SEQ ID NO: 11428 - DNA, 47 bp, Artificial Sequence
  Amplification primer (forwards)
ggggacaagtttgtacaaaaaagcaggctctagcaagcctaatgttg

SEQ ID NO: 11429 - DNA, 51 bp, Artificial Sequence
  Amplification primer (forwards)
ggggacaagtttgtacaaaaaagcaggctctgatttaaataattacatcgc

SEQ ID NO: 11430 - DNA, 50 bp, Artificial Sequence
  Amplification primer (forwards)
ggggacaagtttgtacaaaaaagcaggctctaaacgtgaattactactcg

SEQ ID NO: 11431 - DNA, 48 bp, Artificial Sequence
  Amplification primer (forwards)
ggggacaagtttgtacaaaaaagcaggctctatacgccagtttttaag

SEQ ID NO: 11432 - DNA, 44 bp, Artificial Sequence
  Amplification primer (forwards)
ggggacaagtttgtacaaaaaagcaggcttttcgagcgattttg

SEQ ID NO: 11433 - DNA, 49 bp, Artificial Sequence
  Amplification primer (forwards)
ggggacaagtttgtacaaaaaagcaggctctgtaaccaaagttgaagag

SEQ ID NO: 11434 - DNA, 51 bp, Artificial Sequence
  Amplification primer (forwards)
ggggacaagtttgtacaaaaaagcaggctctatgaaagattttattgaatg

SEQ ID NO: 11435 - DNA, 51 bp, Artificial Sequence; identical to SEQ ID NO: 11434
  Amplification primer (forwards)

SEQ ID NO: 11436 - DNA, 52 bp, Artificial Sequence
  Amplification primer (forwards)
ggggacaagtttgtacaaaaaagcaggctctatagcctttaatagtttattt

SEQ ID NO: 11437 - DNA, 54 bp, Artificial Sequence
  Amplification primer (forwards)
ggggacaagtttgtacaaaaaagcaggctctdacagtttataatataaaccatg

SEQ ID NO: 11438 - DNA, 48 bp, Artificial Sequence
  Amplification primer (forwards)
ggggacaagtttgtacaaaaaagcaggctattcttttgaagaactttt

SEQ ID NO: 11439 - DNA, 48 bp, Artificial Sequence
  Amplification primer (forwards)
ggggacaagtttgtacaaaaaagcaggctctataaaaattttgatccc

SEQ ID NO: 11440 - DNA, 48 bp, Artificial Sequence
  Amplification primer (forwards)
ggggacaagtttgtacaaaaaagcaggctctaatcattccattgaatc

SEQ ID NO: 11441 - DNA, 46 bp, Artificial Sequence
  Amplification primer (forwards)
ggggacaagtttgtacaaaaaagcaggcttacaaaaaaaatatcgg

SEQ ID NO: 11442 - DNA, 47 bp, Artificial Sequence
  Amplification primer (forwards)
ggggacaagtttgtacaaaaaagcaggctctgcggctcaattagctg

SEQ ID NO: 11443 - DNA, 47 bp, Artificial Sequence
  Amplification primer (forwards)
ggggacaagtttgtacaaaaaagcaggctctcgtaccttcaaaccag

SEQ ID NO: 11444 - DNA, 50 bp, Artificial Sequence
  Amplification primer (forwards)
ggggacaagtttgtacaaaaaagcaggctctattaaagcaacttttactc

SEQ ID NO: 11445 - DNA, 46 bp, Artificial Sequence
  Amplification primer (forwards)
ggggacaagtttgtacaaaaaagcaggctcaatttttcagacaaca

SEQ ID NO: 11446 - DNA, 51 bp, Artificial Sequence
  Amplification primer (forwards)
ggggacaagtttgtacaaaaaagcaggctctagaaaacgtaatgatacatt

SEQ ID NO: 11447 - DNA, 49 bp, Artificial Sequence
  Amplification primer (forwards)
ggggacaagtttgtacaaaaaagcaggctctgattgtcaaattacacca

SEQ ID NO: 11448 - DNA, 48 bp, Artificial Sequence
  Amplification primer (forwards)
ggggacaagtttgtacaaaaaagcaggctctatttttcgtggtgataa

SEQ ID NO: 11449 - DNA, 49 bp, Artificial Sequence
  Amplification primer (forwards)
ggggacaagtttgtacaaaaaagcaggcttttttaatattgaatatcac

SEQ ID NO: 11450 - DNA, 49 bp, Artificial Sequence
  Amplification primer (forwards)
ggggacaagtttgtacaaaaaagcaggctctaagggagtccaatatatg

SEQ ID NO: 11451 - DNA, 47 bp, Artificial Sequence
  Amplification primer (forwards)
ggggacaagtttgtacaaaaaagcaggctctcgtcgcatgaatacca

SEQ ID NO: 11452 - DNA, 47 bp, Artificial Sequence
  Amplification primer (forwards)
ggggacaagtttgtacaaaaaagcaggctctatagaattttcagggc

SEQ ID NO: 11453 - DNA, 50 bp, Artificial Sequence
  Amplification primer (forwards)
ggggacaagtttgtacaaaaaagcaggctctgctactcactctaactcag

SEQ ID NO: 11454 - DNA, 46 bp, Artificial Sequence
  Amplification primer (forwards)
ggggacaagtttgtacaaaaaagcaggctgctcttcttcaaatact

SEQ ID NO: 11455 - DNA, 50 bp, Artificial Sequence
  Amplification primer (forwards)
ggggacaagtttgtacaaaaaagcaggctctctaacaccatttacaaaag

SEQ ID NO: 11456 - DNA, 50 bp, Artificial Sequence
  Amplification primer (forwards)
ggggacaagtttgtacaaaaaagcaggctctcaacaaggtattatggata

SEQ ID NO: 11457 - DNA, 49 bp, Artificial Sequence
  Amplification primer (forwards)
ggggacaagtttgtacaaaaaagcaggctctaaaattttaggtacacca

SEQ ID NO: 11458 - DNA, 48 bp, Artificial Sequence
  Amplification primer (forwards)
ggggacaagtttgtacaaaaaagcaggctctggaaaaatggttaagaa

SEQ ID NO: 11459 - DNA, 48 bp, Artificial Sequence
  Amplification primer (forwards)
ggggacaagtttgtacaaaaaagcaggctctaaattcgtccgaaccgt

SEQ ID NO: 11460 - DNA, 47 bp, Artificial Sequence
  Amplification primer (forwards)
ggggacaagtttgtacaaaaaagcaggctctggtcttccaacgcagc

SEQ ID NO: 11461 - DNA, 44 bp, Artificial Sequence
  Amplification primer (forwards)
ggggacaagtttgtacaaaaaagcaggctgctcaggtaaaacat

SEQ ID NO: 11462 - DNA, 47 bp, Artificial Sequence
  Amplification primer (forwards)
ggggacaagtttgtacaaaaaagcaggctctgaaagcaaatctttgc

SEQ ID NO: 11463 - DNA, 44 bp, Artificial Sequence
  Amplification primer (forwards)
ggggacaagtttgtacaaaaaagcaggctgtgctaattggattg

SEQ ID NO: 11464 - DNA, 44 bp, Artificial Sequence
  Amplification primer (forwards)
ggggacaagtttgtacaaaaaagcaggctgtggaaatgtcggag

SEQ ID NO: 11465 - DNA, 44 bp, Artificial Sequence
  Amplification primer (forwards)
ggggacaagtttgtacaaaaaagcaggctgtcagtcaaaccaca

SEQ ID NO: 11466 - DNA, 50 bp, Artificial Sequence
  Amplification primer (forwards)
ggggacaagtttgtacaaaaaagcaggctctgctagtttttattttttcc

SEQ ID NO: 11467 - DNA, 45 bp, Artificial Sequence
  Amplification primer (forwards)
ggggacaagtttgtacaaaaaagcaggctgtggaagtaaatcagc

SEQ ID NO: 11468 - DNA, 52 bp, Artificial Sequence; identical to SEQ ID NO: 11274
  Amplification primer (forwards)

SEQ ID NO: 11469 - DNA, 47 bp, Artificial Sequence
  Amplification primer (forwards)
ggggacaagtttgtacaaaaaagcaggctctattgctggtcctagtg

SEQ ID NO: 11470 - DNA, 46 bp, Artificial Sequence
  Amplification primer (forwards)
ggggacaagtttgtacaaaaaagcaggcttattttttggaaattgg

SEQ ID NO: 11471 - DNA, 49 bp, Artificial Sequence; identical to SEQ ID NO: 11115
  Amplification primer (forwards)

SEQ ID NO: 11472 - DNA, 48 bp, Artificial Sequence
  Amplification primer (forwards)
ggggacaagtttgtacaaaaaagcaggcttttatatgaaagaacaaca

SEQ ID NO: 11473 - DNA, 47 bp, Artificial Sequence
  Amplification primer (forwards)
ggggacaagtttgtacaaaaaagcaggctcaattattattgggttaa

SEQ ID NO: 11474 - DNA, 50 bp, Artificial Sequence
  Amplification primer (forwards)
ggggacaagtttgtacaaaaaagcaggctctcctaaattaaccctagtct

SEQ ID NO: 11475 - DNA, 47 bp, Artificial Sequence
  Amplification primer (forwards)
ggggacaagtttgtacaaaaaagcaggctctagtcttgcgaaggcag

SEQ ID NO: 11476 - DNA, 51 bp, Artificial Sequence
  Amplification primer (forwards)
ggggacaagtttgtacaaaaaagcaggctctgtatttacactcgtcttaca

SEQ ID NO: 11477 - DNA, 50 bp, Artificial Sequence; identical to SEQ ID NO: 11277
  Amplification primer (forwards)

SEQ ID NO: 11478 - DNA, 52 bp, Artificial Sequence; identical to SEQ ID NO: 11274
  Amplification primer (forwards)

SEQ ID NO: 11479 - DNA, 48 bp, Artificial Sequence
  Amplification primer (forwards)
ggggacaagtttgtacaaaaaagcaggctctggttcatcagacaaaca

SEQ ID NO: 11480 - DNA, 53 bp, Artificial Sequence
  Amplification primer (forwards)
ggggacaagtttgtacaaaaaagcaggctctgtagttaaagttggtattaacg

SEQ ID NO: 11481 - DNA, 51 bp, Artificial Sequence
  Amplification primer (forwards)
ggggacaagtttgtacaaaaaagcaggctctgtattagaagtacatgctga

SEQ ID NO: 11482 - DNA, 48 bp, Artificial Sequence
  Amplification primer (forwards)
ggggacaagtttgtacaaaaaagcaggctctgagacaccagtaatggc

SEQ ID NO: 11483 - DNA, 47 bp, Artificial Sequence
  Amplification primer (forwards)
ggggacaagtttgtacaaaaaagcaggctctgctaacaagcaggatc

SEQ ID NO: 11484 - DNA, 52 bp, Artificial Sequence
  Amplification primer (forwards)
ggggacaagtttgtacaaaaaagcaggctctaataagtccagtaactctaag

SEQ ID NO: 11485 - DNA, 50 bp, Artificial Sequence
  Amplification primer (forwards)
ggggacaagtttgtacaaaaaagcaggctctgcttttgatgtaattatgc

SEQ ID NO: 11486 - DNA, 51 bp, Artificial Sequence
  Amplification primer (forwards)
ggggacaagtttgtacaaaaaagcaggctctattaactatgaggttaaagc

SEQ ID NO: 11487 - DNA, 52 bp, Artificial Sequence
  Amplification primer (forwards)
ggggacaagtttgtacaaaaaagcaggctctgtaattgttgaacttagtttg

SEQ ID NO: 11488 - DNA, 50 bp, Artificial Sequence
  Amplification primer (forwards)
ggggacaagtttgtacaaaaaagcaggctctcttaggaagtataagcaaa

SEQ ID NO: 11489 - DNA, 48 bp, Artificial Sequence
  Amplification primer (forwards)
ggggacaagtttgtacaaaaaagcaggctctaaaatttgtctggttgg

SEQ ID NO: 11490 - DNA, 52 bp, Artificial Sequence
  Amplification primer (forwards)
ggggacaagtttgtacaaaaaagcaggctctgacttttatgatatcaatctt

SEQ ID NO: 11491 - DNA, 47 bp, Artificial Sequence
  Amplification primer (forwards)
ggggacaagtttgtacaaaaaagcaggctatgctattatgcaaaaag

SEQ ID NO: 11492 - DNA, 47 bp, Artificial Sequence
  Amplification primer (forwards)
ggggacaagtttgtacaaaaaagcaggctctgcaatcgtttcagcag

SEQ ID NO: 11493 - DNA, 50 bp, Artificial Sequence
  Amplification primer (reverse)
ggggaccactttgtacaagaaagctgggttatttttagacatcatagaca

SEQ ID NO: 11494 - DNA, 45 bp, Artificial Sequence
  Amplification primer (reverse)
ggggaccactttgtacaagaaagctgggttgggaatgcctacaaa

SEQ ID NO: 11495 - DNA, 50 bp, Artificial Sequence
  Amplification primer (reverse)
ggggaccactttgtacaagaaagctgggttttttttactatactttttgt

SEQ ID NO: 11496 - DNA, 48 bp, Artificial Sequence
  Amplification primer (reverse)
ggggaccactttgtacaagaaagctgggttttcctttttaggcttact

SEQ ID NO: 11497 - DNA, 48 bp, Artificial Sequence
  Amplification primer (reverse)
ggggaccactttgtacaagaaagctgggttattagcttcatttgtcag

SEQ ID NO: 11498 - DNA, 50 bp, Artificial Sequence
  Amplification primer (reverse)
ggggaccactttgtacaagaaagctgggttagtttcttctttaaaatcat

SEQ ID NO: 11499 - DNA, 48 bp, Artificial Sequence
  Amplification primer (reverse)
ggggaccactttgtacaagaaagctgggttctctgaagctgtaaaacc

SEQ ID NO: 11500 - DNA, 49 bp, Artificial Sequence
  Amplification primer (reverse)
ggggaccactttgtacaagaaagctgggtttttatcaatgtttgaaacg

SEQ ID NO: 11501 - DNA, 50 bp, Artificial Sequence
  Amplification primer (reverse)
ggggaccactttgtacaagaaagctgggtttagtaaatcaagtttttgca

SEQ ID NO: 11502 - DNA, 47 bp, Artificial Sequence
  Amplification primer (reverse)
ggggaccactttgtacaagaaagctgggttatcccttctattttcga

SEQ ID NO: 11503 - DNA, 49 bp, Artificial Sequence
  Amplification primer (reverse)
ggggaccactttgtacaagaaagctgggttatgtagtgacgtttctgtg

SEQ ID NO: 11504 - DNA, 49 bp, Artificial Sequence; identical to SEQ ID NO: 11503
  Amplification primer (reverse)

SEQ ID NO: 11505 - DNA, 46 bp, Artificial Sequence
  Amplification primer (reverse)
ggggaccactttgtacaagaaagctgggttattgggtgtaagcatt

SEQ ID NO: 11506 - DNA, 47 bp, Artificial Sequence
  Amplification primer (reverse)
ggggaccactttgtacaagaaagctgggttcttaactctacccgtcc

SEQ ID NO: 11507 - DNA, 50 bp, Artificial Sequence
  Amplification primer (reverse)
ggggaccactttgtacaagaaagctgggttttttctcttattaaagaatt

SEQ ID NO: 11508 - DNA, 48 bp, Artificial Sequence
  Amplification primer (reverse)
ggggaccactttgtacaagaaagctgggttataccagccgttactatt

SEQ ID NO: 11509 - DNA, 49 bp, Artificial Sequence
  Amplification primer (reverse)
ggggaccactttgtacaagaaagctgggtttttagctgcttttttaatg

SEQ ID NO: 11510 - DNA, 50 bp, Artificial Sequence
  Amplification primer (reverse)
ggggaccactttgtacaagaaagctgggttaaatactacatttacaggtg

SEQ ID NO: 11511 - DNA, 49 bp, Artificial Sequence
  Amplification primer (reverse)
ggggaccactttgtacaagaaagctgggttttggttattctcctttaat

SEQ ID NO: 11512 - DNA, 50 bp, Artificial Sequence
  Amplification primer (reverse)
ggggaccactttgtacaagaaagctgggttattatatttttggatatttc

SEQ ID NO: 11513 - DNA, 47 bp, Artificial Sequence
  Amplification primer (reverse)
ggggaccactttgtacaagaaagctgggttgggctttttcttaaaaa

SEQ ID NO: 11514 - DNA, 45 bp, Artificial Sequence
  Amplification primer (reverse)
ggggaccactttgtacaagaaagctgggttgttggcatccctttt

SEQ ID NO: 11515 - DNA, 46 bp, Artificial Sequence
  Amplification primer (reverse)
ggggaccactttgtacaagaaagctgggttcttttgatgggattgg

SEQ ID NO: 11516 - DNA, 47 bp, Artificial Sequence
  Amplification primer (reverse)
ggggaccactttgtacaagaaagctgggttttgatttaacgatttga

SEQ ID NO: 11517 - DNA, 51 bp, Artificial Sequence
  Amplification primer (reverse)
ggggaccactttgtacaagaaagctgggtttttatctcctctaaaataatg

SEQ ID NO: 11518 - DNA, 48 bp, Artificial Sequence
  Amplification primer (reverse)
ggggaccactttgtacaagaaagctgggttctttgataagtcagacca

SEQ ID NO: 11519 - DNA, 46 bp, Artificial Sequence
  Amplification primer (reverse)
ggggaccactttgtacaagaaagctgggttgtaaccccaagctgat

SEQ ID NO: 11520 - DNA, 47 bp, Artificial Sequence
  Amplification primer (reverse)
ggggaccactttgtacaagaaagctgggtttgattttgcaatatcaa

SEQ ID NO: 11521 - DNA, 51 bp, Artificial Sequence
  Amplification primer (reverse)
ggggaccactttgtacaagaaagctgggtttttttgtaatttaagtactaa

SEQ ID NO: 11522 - DNA, 50 bp, Artificial Sequence
  Amplification primer (reverse)
ggggaccactttgtacaagaaagctgggttttcttttatattaagagctt

SEQ ID NO: 11523 - DNA, 47 bp, Artificial Sequence
  Amplification primer (reverse)
ggggaccactttgtacaagaaagctgggttattcggataaatgtagc

SEQ ID NO: 11524 - DNA, 47 bp, Artificial Sequence
  Amplification primer (reverse)
ggggaccactttgtacaagaaagctgggtttccatttttatcctcac

SEQ ID NO: 11525 - DNA, 47 bp, Artificial Sequence; identical to SEQ ID NO: 11524
  Amplification primer (reverse)

SEQ ID NO: 11526 - DNA, 47 bp, Artificial Sequence
  Amplification primer (reverse)
ggggaccactttgtacaagaaagctgggttatgacctctactttcca

SEQ ID NO: 11527 - DNA, 47 bp, Artificial Sequence
  Amplification primer (reverse)
ggggaccactttgtacaagaaagctgggttcttgtaatcacttggac

SEQ ID NO: 11528 - DNA, 48 bp, Artificial Sequence
  Amplification primer (reverse)
ggggaccactttgtacaagaaagctgggttattaatcatggtattggt

SEQ ID NO: 11529 - DNA, 46 bp, Artificial Sequence
  Amplification primer (reverse)
ggggaccactttgtacaagaaagctgggttccattgtggaatatca

SEQ ID NO: 11530 - DNA, 47 bp, Artificial Sequence
  Amplification primer (reverse)
ggggaccactttgtacaagaaagctgggtttttgtaaagcagttctt

SEQ ID NO: 11531 - DNA, 51 bp, Artificial Sequence
  Amplification primer (reverse)
ggggaccactttgtacaagaaagctgggttatcattcatatgatctctaga

SEQ ID NO: 11532 - DNA, 49 bp, Artificial Sequence
  Amplification primer (reverse)
ggggaccactttgtacaagaaagctgggttattttgattgattctactc

SEQ ID NO: 11533 - DNA, 48 bp, Artificial Sequence
  Amplification primer (reverse)
ggggaccactttgtacaagaaagctgggttttttgtttttttcaaata

SEQ ID NO: 11534 - DNA, 46 bp, Artificial Sequence
  Amplification primer (reverse)
ggggaccactttgtacaagaaagctgggttatcttcaacgtcctcc

SEQ ID NO: 11535 - DNA, 47 bp, Artificial Sequence
  Amplification primer (reverse)
ggggaccactttgtacaagaaagctgggttaaagtcaaaggaaactt

SEQ ID NO: 11536 - DNA, 52 bp, Artificial Sequence
  Amplification primer (reverse)
ggggaccactttgtacaagaaagctgggttttctttatctaatttataatag

SEQ ID NO: 11537 - DNA, 46 bp, Artificial Sequence
  Amplification primer (reverse)
ggggaccactttgtacaagaaagctgggttttgcaatgttttttct

SEQ ID NO: 11538 - DNA, 49 bp, Artificial Sequence
  Amplification primer (reverse)
ggggaccactttgtacaagaaagctgggtttaaactttggataatctgt

SEQ ID NO: 11539 - DNA, 48 bp, Artificial Sequence
  Amplification primer (reverse)
ggggaccactttgtacaagaaagctgggttgttgaaattttgatatga

SEQ ID NO: 11540 - DNA, 52 bp, Artificial Sequence
  Amplification primer (reverse)
ggggaccactttgtacaagaaagctgggttctcctttactatatagctaact

SEQ ID NO: 11541 - DNA, 48 bp, Artificial Sequence
  Amplification primer (reverse)
ggggaccactttgtacaagaaagctgggttttgtttgtgaagtaaaac

SEQ ID NO: 11542 - DNA, 50 bp, Artificial Sequence
  Amplification primer (reverse)
ggggaccactttgtacaagaaagctgggtttgataatatctccatatttt

SEQ ID NO: 11543 - DNA, 44 bp, Artificial Sequence
  Amplification primer (reverse)
ggggaccactttgtacaagaaagctgggttgcattggcgccata

SEQ ID NO: 11544 - DNA, 49 bp, Artificial Sequence
  Amplification primer (reverse)
ggggaccactttgtacaagaaagctgggttttctacacgacttttattc

SEQ ID NO: 11545 - DNA, 46 bp, Artificial Sequence
  Amplification primer (reverse)
ggggaccactttgtacaagaaagctgggttaagacctcctcgagat

SEQ ID NO: 11546 - DNA, 48 bp, Artificial Sequence
  Amplification primer (reverse)
ggggaccactttgtacaagaaagctgggtttgttttttctttctgttg

SEQ ID NO: 11547 - DNA, 47 bp, Artificial Sequence
  Amplification primer (reverse)
ggggaccactttgtacaagaaagctgggtttggattagtttgacctg

SEQ ID NO: 11548 - DNA, 49 bp, Artificial Sequence
  Amplification primer (reverse)
ggggaccactttgtacaagaaagctgggtttttatcgtaagcacttagg

SEQ ID NO: 11549 - DNA, 46 bp, Artificial Sequence
  Amplification primer (reverse)
ggggaccactttgtacaagaaagctgggttctccttccaggcatcg

SEQ ID NO: 11550 - DNA, 52 bp, Artificial Sequence
  Amplification primer (reverse)
ggggaccactttgtacaagaaagctgggttgtaaaagtatcttaaatagtca

SEQ ID NO: 11551 - DNA, 45 bp, Artificial Sequence
  Amplification primer (reverse)
ggggaccactttgtacaagaaagctgggtttgccattcctcctct

SEQ ID NO: 11552 - DNA, 49 bp, Artificial Sequence
  Amplification primer (reverse)
ggggaccactttgtacaagaaagctgggtttgttacctttttattttct

SEQ ID NO: 11553 - DNA, 46 bp, Artificial Sequence
  Amplification primer (reverse)
ggggaccactttgtacaagaaagctgggtttttttcatgcgattga

SEQ ID NO: 11554 - DNA, 49 bp, Artificial Sequence
  Amplification primer (reverse)
ggggaccactttgtacaagaaagctgggttgagacgtttcttatacctt

SEQ ID NO: 11555 - DNA, 49 bp, Artificial Sequence
  Amplification primer (reverse)
ggggaccactttgtacaagaaagctgggtttgtaccatatgttctctct

SEQ ID NO: 11556 - DNA, 48 bp, Artificial Sequence
  Amplification primer (reverse)
ggggaccactttgtacaagaaagctgggttaaaagttggactactttc

SEQ ID NO: 11557 - DNA, 43 bp, Artificial Sequence
  Amplification primer (reverse)
ggggaccactttgtacaagaaagctgggtttcgttttccaccc

SEQ ID NO: 11558 - DNA, 43 bp, Artificial Sequence; identical to SEQ ID NO: 11557
  Amplification primer (reverse)

SEQ ID NO: 11559 - DNA, 50 bp, Artificial Sequence
  Amplification primer (reverse)
ggggaccactttgtacaagaaagctgggttatttgggtaaatatagtaaa

SEQ ID NO: 11560 - DNA, 48 bp, Artificial Sequence
  Amplification primer (reverse)
ggggaccactttgtacaagaaagctgggtttttacgactaacctcaac

SEQ ID NO: 11561 - DNA, 45 bp, Artificial Sequence
  Amplification primer (reverse)
ggggaccactttgtacaagaaagctgggttaattccttttggtgg

SEQ ID NO: 11562 - DNA, 46 bp, Artificial Sequence
  Amplification primer (reverse)
ggggaccactttgtacaagaaagctgggttggcagaatacaccttc

SEQ ID NO: 11563 - DNA, 46 bp, Artificial Sequence
  Amplification primer (reverse)
ggggaccactttgtacaagaaagctgggttggctgacgtcgacgca

SEQ ID NO: 11564 - DNA, 52 bp, Artificial Sequence
  Amplification primer (reverse)
ggggaccactttgtacaagaaagctgggttaactctcttaatatattcttct

SEQ ID NO: 11565 - DNA, 49 bp, Artificial Sequence
  Amplification primer (reverse)
ggggaccactttgtacaagaaagctgggttgtctttttcaatattctgt

SEQ ID NO: 11566 - DNA, 49 bp, Artificial Sequence; identical to SEQ ID NO: 11565
  Amplification primer (reverse)

SEQ ID NO: 11567 - DNA, 49 bp, Artificial Sequence
  Amplification primer (reverse)
ggggaccactttgtacaagaaagctgggttcttctccttaggagtaacg

SEQ ID NO: 11568 - DNA, 53 bp, Artificial Sequence
  Amplification primer (reverse)
ggggaccactttgtacaagaaagctgggttattattatcaattaataactctt

SEQ ID NO: 11569 - DNA, 48 bp, Artificial Sequence
  Amplification primer (reverse)
ggggaccactttgtacaagaaagctgggttgtcaaacatacttccaaa

SEQ ID NO: 11570 - DNA, 46 bp, Artificial Sequence
  Amplification primer (reverse)
ggggaccactttgtacaagaaagctgggtttttcgtcgtataagca

SEQ ID NO: 11571 - DNA, 46 bp, Artificial Sequence; identical to SEQ ID NO: 11570
  Amplification primer (reverse)

SEQ ID NO: 11572 - DNA, 47 bp, Artificial Sequence
  Amplification primer (reverse)
ggggaccactttgtacaagaaagctgggtttgtcctcattttttcag

SEQ ID NO: 11573 - DNA, 47 bp, Artificial Sequence
  Amplification primer (reverse)
ggggaccactttgtacaagaaagctgggttaatacttgctggaacag

SEQ ID NO: 11574 - DNA, 48 bp, Artificial Sequence
  Amplification primer (reverse)
ggggaccactttgtacaagaaagctgggttgtctttcttcaattttgg

SEQ ID NO: 11575 - DNA, 48 bp, Artificial Sequence
  Amplification primer (reverse)
ggggaccactttgtacaagaaagctgggttgtcgtgatttttatgagt

SEQ ID NO: 11576 - DNA, 46 bp, Artificial Sequence
  Amplification primer (reverse)
ggggaccactttgtacaagaaagctgggttcccaaactggcataac

SEQ ID NO: 11577 - DNA, 46 bp, Artificial Sequence; identical to SEQ ID NO: 11576
  Amplification primer (reverse)

SEQ ID NO: 11578 - DNA, 46 bp, Artificial Sequence
  Amplification primer (reverse)
ggggaccactttgtacaagaaagctgggtttgaaggacgtttgttg

SEQ ID NO: 11579 - DNA, 49 bp, Artificial Sequence
  Amplification primer (reverse)
ggggaccactttgtacaagaaagctgggtttttttttagtttaaggcta

SEQ ID NO: 11580 - DNA, 44 bp, Artificial Sequence
  Amplification primer (reverse)
ggggaccactttgtacaagaaagctgggttgtccaccttccgat

SEQ ID NO: 11581 - DNA, 48 bp, Artificial Sequence
  Amplification primer (reverse)
ggggaccactttgtacaagaaagctgggttaacattgtttttcctttc

SEQ ID NO: 11582 - DNA, 46 bp, Artificial Sequence
  Amplification primer (reverse)
ggggaccactttgtacaagaaagctgggttatggtgatgatgacct

SEQ ID NO: 11583 - DNA, 47 bp, Artificial Sequence
  Amplification primer (reverse)
ggggaccactttgtacaagaaagctgggttattaacattttgagggt

SEQ ID NO: 11584 - DNA, 46 bp, Artificial Sequence
  Amplification primer (reverse)
ggggaccactttgtacaagaaagctgggttttttgcaaaatcaaca

SEQ ID NO: 11585 - DNA, 51 bp, Artificial Sequence
  Amplification primer (reverse)
ggggaccactttgtacaagaaagctgggttgaataaataactgtatttttt

SEQ ID NO: 11586 - DNA, 49 bp, Artificial Sequence
  Amplification primer (reverse)
ggggaccactttgtacaagaaagctgggttattttcattaatttcctct

SEQ ID NO: 11587 - DNA, 48 bp, Artificial Sequence
  Amplification primer (reverse)
ggggaccactttgtacaagaaagctgggttgatagctaattggtctgt

SEQ ID NO: 11588 - DNA, 48 bp, Artificial Sequence
  Amplification primer (reverse)
ggggaccactttgtacaagaaagctgggtttaaaagatgagcttctcg

SEQ ID NO: 11589 - DNA, 48 bp, Artificial Sequence
  Amplification primer (reverse)
ggggaccactttgtacaagaaagctgggttaatttcaatatagcgacg

SEQ ID NO: 11590 - DNA, 48 bp, Artificial Sequence
  Amplification primer (reverse)
ggggaccactttgtacaagaaagctgggttcttgtttgtctttacctt

SEQ ID NO: 11591 - DNA, 47 bp, Artificial Sequence
  Amplification primer (reverse)
ggggaccactttgtacaagaaagctgggttattatccttcaaagctg

SEQ ID NO: 11592 - DNA, 50 bp, Artificial Sequence
  Amplification primer (reverse)
ggggaccactttgtacaagaaagctgggtttgtgtcatataatgtaacca

SEQ ID NO: 11593 - DNA, 47 bp, Artificial Sequence
  Amplification primer (reverse)
ggggaccactttgtacaagaaagctgggtttgatcttaattttcgag

SEQ ID NO: 11594 - DNA, 46 bp, Artificial Sequence
  Amplification primer (reverse)
ggggaccactttgtacaagaaagctgggttccaaacaggttgatct

SEQ ID NO: 11595 - DNA, 49 bp, Artificial Sequence
  Amplification primer (reverse)
ggggaccactttgtacaagaaagctgggttatttacatcagactgtgac

SEQ ID NO: 11596 - DNA, 46 bp, Artificial Sequence
  Amplification primer (reverse)
ggggaccactttgtacaagaaagctgggtttttatggccaataaca

SEQ ID NO: 11597 - DNA, 50 bp, Artificial Sequence
  Amplification primer (reverse)
ggggaccactttgtacaagaaagctgggttttttttagtagttgtcaatt

SEQ ID NO: 11598 - DNA, 47 bp, Artificial Sequence
  Amplification primer (reverse)
ggggaccactttgtacaagaaagctgggttgtaagctgaattttcga

SEQ ID NO: 11599 - DNA, 47 bp, Artificial Sequence
  Amplification primer (reverse)
ggggaccactttgtacaagaaagctgggttacgagagtggttattgg

SEQ ID NO: 11600 - DNA, 50 bp, Artificial Sequence
  Amplification primer (reverse)
ggggaccactttgtacaagaaagctgggtttttcttcactctttctagag

SEQ ID NO: 11601 - DNA, 46 bp, Artificial Sequence
  Amplification primer (reverse)
ggggaccactttgtacaagaaagctgggttcggccagttttttctt

SEQ ID NO: 11602 - DNA, 46 bp, Artificial Sequence
  Amplification primer (reverse)
ggggaccactttgtacaagaaagctgggttaacacctggtgggcgt

SEQ ID NO: 11603 - DNA, 49 bp, Artificial Sequence
  Amplification primer (reverse)
ggggaccactttgtacaagaaagctgggttactatttctaattgctctg

SEQ ID NO: 11604 - DNA, 46 bp, Artificial Sequence
  Amplification primer (reverse)
ggggaccactttgtacaagaaagctgggtttggtcccggtgcgcca

SEQ ID NO: 11605 - DNA, 49 bp, Artificial Sequence; identical to SEQ ID NO: 11603
  Amplification primer (reverse)

SEQ ID NO: 11606 - DNA, 47 bp, Artificial Sequence
  Amplification primer (reverse)
ggggaccactttgtacaagaaagctgggttcttagcagattcatccc

SEQ ID NO: 11607 - DNA, 49 bp, Artificial Sequence
  Amplification primer (reverse)
ggggaccactttgtacaagaaagctgggtttttactatttgaaaattgg

SEQ ID NO: 11608 - DNA, 49 bp, Artificial Sequence
  Amplification primer (reverse)
ggggaccactttgtacaagaaagctgggtttttcataggaacttgtatt

SEQ ID NO: 11609 - DNA, 46 bp, Artificial Sequence
  Amplification primer (reverse)
ggggaccactttgtacaagaaagctgggttgtccacacctgcgact

SEQ ID NO: 11610 - DNA, 46 bp, Artificial Sequence; identical to SEQ ID NO: 11609
  Amplification primer (reverse)

SEQ ID NO: 11611 - DNA, 51 bp, Artificial Sequence
  Amplification primer (reverse)
ggggaccactttgtacaagaaagctgggtttttacctaagtaatattctga

SEQ ID NO: 11612 - DNA, 46 bp, Artificial Sequence
  Amplification primer (reverse)
ggggaccactttgtacaagaaagctgggtttccccgtcttttttgt

SEQ ID NO: 11613 - DNA, 48 bp, Artificial Sequence
  Amplification primer (reverse)
ggggaccactttgtacaagaaagctgggttgtcgtaatcataaaagcc

SEQ ID NO: 11614 - DNA, 48 bp, Artificial Sequence
  Amplification primer (reverse)
ggggaccactttgtacaagaaagctgggttttcataacgaaccataac

SEQ ID NO: 11615 - DNA, 47 bp, Artificial Sequence
  Amplification primer (reverse)
ggggaccactttgtacaagaaagctgggtttttgagttctagcaacg

SEQ ID NO: 11616 - DNA, 49 bp, Artificial Sequence
  Amplification primer (reverse)
ggggaccactttgtacaagaaagctgggttttttttatcttcttcttgc

SEQ ID NO: 11617 - DNA, 48 bp, Artificial Sequence
  Amplification primer (reverse)
ggggaccactttgtacaagaaagctgggttttttaaaacctggtaaac

SEQ ID NO: 11618 - DNA, 46 bp, Artificial Sequence
  Amplification primer (reverse)
ggggaccactttgtacaagaaagctgggtttcagctcgtactgttt

SEQ ID NO: 11619 - DNA, 46 bp, Artificial Sequence
  Amplification primer (reverse)
ggggaccactttgtacaagaaagctgggttgtcctcctcaattggt

SEQ ID NO: 11620 - DNA, 47 bp, Artificial Sequence
  Amplification primer (reverse)
ggggaccactttgtacaagaaagctgggttctcttttatacgcgatg

SEQ ID NO: 11621 - DNA, 47 bp, Artificial Sequence
  Amplification primer (reverse)
ggggaccactttgtacaagaaagctgggttgttatttgctcgttgtt

SEQ ID NO: 11622 - DNA, 48 bp, Artificial Sequence
  Amplification primer (reverse)
ggggaccactttgtacaagaaagctgggtttttctcaaatgttttcat

SEQ ID NO: 11623 - DNA, 48 bp, Artificial Sequence
  Amplification primer (reverse)
ggggaccactttgtacaagaaagctgggtttttcaaatgatctacagc

SEQ ID NO: 11624 - DNA, 46 bp, Artificial Sequence
  Amplification primer (reverse)
ggggaccactttgtacaagaaagctgggttggctagtgtctgtccg

SEQ ID NO: 11625 - DNA, 48 bp, Artificial Sequence
  Amplification primer (reverse)
ggggaccactttgtacaagaaagctgggttaccatctatttttacccc

SEQ ID NO: 11626 - DNA, 46 bp, Artificial Sequence
  Amplification primer (reverse)
ggggaccactttgtacaagaaagctgggttagaacccgcactctca

SEQ ID NO: 11627 - DNA, 46 bp, Artificial Sequence
  Amplification primer (reverse)
ggggaccactttgtacaagaaagctgggttgaacgcaacggctgct

SEQ ID NO: 11628 - DNA, 50 bp, Artificial Sequence
  Amplification primer (reverse)
ggggaccactttgtacaagaaagctgggtttttcatatcaaaaactatcg

SEQ ID NO: 11629 - DNA, 50 bp, Artificial Sequence
  Amplification primer (reverse)
ggggaccactttgtacaagaaagctgggttttctttatctcttaatgctt

SEQ ID NO: 11630 - DNA, 49 bp, Artificial Sequence
  Amplification primer (reverse)
ggggaccactttgtacaagaaagctgggttcacaacagttattttttca

SEQ ID NO: 11631 - DNA, 46 bp, Artificial Sequence
  Amplification primer (reverse)
ggggaccactttgtacaagaaagctgggttaggcccttctgagtag

SEQ ID NO: 11632 - DNA, 46 bp, Artificial Sequence; identical to SEQ ID NO: 11631
  Amplification primer (reverse)

SEQ ID NO: 11633 - DNA, 47 bp, Artificial Sequence
  Amplification primer (reverse)
ggggaccactttgtacaagaaagctgggttaaataatccaatggctg

SEQ ID NO: 11634 - DNA, 47 bp, Artificial Sequence
  Amplification primer (reverse)
ggggaccactttgtacaagaaagctgggttcttttcaagctttttcc

SEQ ID NO: 11635 - DNA, 48 bp, Artificial Sequence
  Amplification primer (reverse)
ggggaccactttgtacaagaaagctgggttaaaatgatcagtttgagg

SEQ ID NO: 11636 - DNA, 47 bp, Artificial Sequence
  Amplification primer (reverse)
ggggaccactttgtacaagaaagctgggtttttttggcttaagaaag

SEQ ID NO: 11637 - DNA, 51 bp, Artificial Sequence
  Amplification primer (reverse)
ggggaccactttgtacaagaaagctgggttcttacgatacattttaaattg

SEQ ID NO: 11638 - DNA, 49 bp, Artificial Sequence
  Amplification primer (reverse)
ggggaccactttgtacaagaaagctgggttttctttttttactttagcg

SEQ ID NO: 11639 - DNA, 46 bp, Artificial Sequence
  Amplification primer (reverse)
ggggaccactttgtacaagaaagctgggttccattgcaatccagca

SEQ ID NO: 11640 - DNA, 46 bp, Artificial Sequence
  Amplification primer (reverse)
ggggaccactttgtacaagaaagctgggttatgtttatggcttgct

SEQ ID NO: 11641 - DNA, 46 bp, Artificial Sequence
  Amplification primer (reverse)
ggggaccactttgtacaagaaagctgggtttttttgataaatcccc

SEQ ID NO: 11642 - DNA, 49 bp, Artificial Sequence
  Amplification primer (reverse)
ggggaccactttgtacaagaaagctgggttatatgtgtattcatccttt

SEQ ID NO: 11643 - DNA, 50 bp, Artificial Sequence
  Amplification primer (reverse)
ggggaccactttgtacaagaaagctgggtttacttctatttttccatctg

SEQ ID NO: 11644 - DNA, 49 bp, Artificial Sequence
  Amplification primer (reverse)
ggggaccactttgtacaagaaagctgggttgtaatgcaataaatcaaaa

SEQ ID NO: 11645 - DNA, 46 bp, Artificial Sequence
  Amplification primer (reverse)
ggggaccactttgtacaagaaagctgggttggattttagtttcgca

SEQ ID NO: 11646 - DNA, 46 bp, Artificial Sequence
  Amplification primer (reverse)
ggggaccactttgtacaagaaagctgggttcccattgatttcgtcg

SEQ ID NO: 11647 - DNA, 48 bp, Artificial Sequence
  Amplification primer (reverse)
ggggaccactttgtacaagaaagctgggtttacctctttcaataccac

SEQ ID NO: 11648 - DNA, 49 bp, Artificial Sequence
  Amplification primer (reverse)
ggggaccactttgtacaagaaagctgggttattaccgttaggtactgta

SEQ ID NO: 11649 - DNA, 48 bp, Artificial Sequence
  Amplification primer (reverse)
ggggaccactttgtacaagaaagctgggttggtatggttaacagaatc

SEQ ID NO: 11650 - DNA, 50 bp, Artificial Sequence
  Amplification primer (reverse)
ggggaccactttgtacaagaaagctgggttatataccctagactttttga

SEQ ID NO: 11651 - DNA, 50 bp, Artificial Sequence
  Amplification primer (reverse)
ggggaccactttgtacaagaaagctgggttaggagttttattgatgatat

SEQ ID NO: 11652 - DNA, 47 bp, Artificial Sequence
  Amplification primer (reverse)
ggggaccactttgtacaagaaagctgggttaaatgattgtggaaaaa

SEQ ID NO: 11653 - DNA, 49 bp, Artificial Sequence
  Amplification primer (reverse)
ggggaccactttgtacaagaaagctgggttatcaaagaagttgacattg

SEQ ID NO: 11654 - DNA, 49 bp, Artificial Sequence; identical to SEQ ID NO: 11653
  Amplification primer (reverse)

SEQ ID NO: 11655 - DNA, 50 bp, Artificial Sequence
  Amplification primer (reverse)
ggggaccactttgtacaagaaagctgggttgttagataaattaaccagtg

SEQ ID NO: 11656 - DNA, 46 bp, Artificial Sequence
  Amplification primer (reverse)
ggggaccactttgtacaagaaagctgggttccctttgcttcgttgt

SEQ ID NO: 11657 - DNA, 46 bp, Artificial Sequence
  Amplification primer (reverse)
ggggaccactttgtacaagaaagctgggttttccacaagtccgatt

SEQ ID NO: 11658 - DNA, 46 bp, Artificial Sequence
  Amplification primer (reverse)
ggggaccactttgtacaagaaagctgggttttgtttgattcgtcct

SEQ ID NO: 11659 - DNA, 46 bp, Artificial Sequence
  Amplification primer (reverse)
ggggaccactttgtacaagaaagctgggttactaccaaactgctgg

SEQ ID NO: 11660 - DNA, 50 bp, Artificial Sequence
  Amplification primer (reverse)
ggggaccactttgtacaagaaagctgggttttgtgtatttttagttaggt

SEQ ID NO: 11661 - DNA, 47 bp, Artificial Sequence
  Amplification primer (reverse)
ggggaccactttgtacaagaaagctgggttgtggataaaattcgaaa

SEQ ID NO: 11662 - DNA, 47 bp, Artificial Sequence
  Amplification primer (reverse)
ggggaccactttgtacaagaaagctgggttcagactgactaggagct

SEQ ID NO: 11663 - DNA, 48 bp, Artificial Sequence
  Amplification primer (reverse)
ggggaccactttgtacaagaaagctgggttgacttgtaattgattcgc

SEQ ID NO: 11664 - DNA, 46 bp, Artificial Sequence
  Amplification primer (reverse)
ggggaccactttgtacaagaaagctgggttgaaggcaccaccacct

SEQ ID NO: 11665 - DNA, 52 bp, Artificial Sequence
  Amplification primer (reverse)
ggggaccactttgtacaagaaagctgggttgttgtatagatgagttaatctg

SEQ ID NO: 11666 - DNA, 47 bp, Artificial Sequence
  Amplification primer (reverse)
ggggaccactttgtacaagaaagctgggttacggtttttaaagaatg

SEQ ID NO: 11667 - DNA, 49 bp, Artificial Sequence
  Amplification primer (reverse)
ggggaccactttgtacaagaaagctgggtttttttctttatcttctgtg

SEQ ID NO: 11668 - DNA, 47 bp, Artificial Sequence
  Amplification primer (reverse)
ggggaccactttgtacaagaaagctgggttcgattttgtaagagctt

SEQ ID NO: 11669 - DNA, 46 bp, Artificial Sequence
  Amplification primer (reverse)
ggggaccactttgtacaagaaagctgggttcgacgaagctatttct

SEQ ID NO: 11670 - DNA, 46 bp, Artificial Sequence
  Amplification primer (reverse)
ggggaccactttgtacaagaaagctgggtttaaggcttgcattttg

SEQ ID NO: 11671 - DNA, 48 bp, Artificial Sequence
  Amplification primer (reverse)
ggggaccactttgtacaagaaagctgggttttttcctaaaaattttcc

SEQ ID NO: 11672 - DNA, 46 bp, Artificial Sequence
  Amplification primer (reverse)
ggggaccactttgtacaagaaagctgggttggcatctcctagcttt

SEQ ID NO: 11673 - DNA, 50 bp, Artificial Sequence
  Amplification primer (reverse)
ggggaccactttgtacaagaaagctgggtttgataaaggtagttctacac

SEQ ID NO: 11674 - DNA, 50 bp, Artificial Sequence; identical to SEQ ID NO: 11673
  Amplification primer (reverse)

SEQ ID NO: 11675 - DNA, 48 bp, Artificial Sequence
  Amplification primer (reverse)
ggggaccactttgtacaagaaagctgggttttttagatgtttttgtgg

SEQ ID NO: 11676 - DNA, 49 bp, Artificial Sequence
  Amplification primer (reverse)
ggggaccactttgtacaagaaagctgggttatgattgataattttaagc

SEQ ID NO: 11677 - DNA, 46 bp, Artificial Sequence
  Amplification primer (reverse)
ggggaccactttgtacaagaaagctgggtttgctttttgatatgcc

SEQ ID NO: 11678 - DNA, 50 bp, Artificial Sequence
  Amplification primer (reverse)
ggggaccactttgtacaagaaagctgggtttaaaataaagttcagaaaag

SEQ ID NO: 11679 - DNA, 47 bp, Artificial Sequence
  Amplification primer (reverse)
ggggaccactttgtacaagaaagctgggtttttctcccttgactttc

SEQ ID NO: 11680 - DNA, 47 bp, Artificial Sequence
  Amplification primer (reverse)
ggggaccactttgtacaagaaagctgggttctttttctcagatgctt

SEQ ID NO: 11681 - DNA, 46 bp, Artificial Sequence
  Amplification primer (reverse)
ggggaccactttgtacaagaaagctgggttgacattgaaacggaat

SEQ ID NO: 11682 - DNA, 48 bp, Artificial Sequence
  Amplification primer (reverse)
ggggaccactttgtacaagaaagctgggttttttatcaatgatgttga

SEQ ID NO: 11683 - DNA, 46 bp, Artificial Sequence
  Amplification primer (reverse)
ggggaccactttgtacaagaaagctgggttcatatgacgcaaacgc

SEQ ID NO: 11684 - DNA, 46 bp, Artificial Sequence
  Amplification primer (reverse)
ggggaccactttgtacaagaaagctgggttagcctcttttcttgtt

SEQ ID NO: 11685 - DNA, 48 bp, Artificial Sequence
  Amplification primer (reverse)
ggggaccactttgtacaagaaagctgggttacgattatcaacaaagtt

SEQ ID NO: 11686 - DNA, 50 bp, Artificial Sequence
  Amplification primer (reverse)
ggggaccactttgtacaagaaagctgggttcattcttttaaatacaaatc

SEQ ID NO: 11687 - DNA, 46 bp, Artificial Sequence
  Amplification primer (reverse)
ggggaccactttgtacaagaaagctgggttgggtttgaaagttttc

SEQ ID NO: 11688 - DNA, 51 bp, Artificial Sequence
  Amplification primer (reverse)
ggggaccactttgtacaagaaagctgggtttttaactttaattactggaat

SEQ ID NO: 11689 - DNA, 48 bp, Artificial Sequence
  Amplification primer (reverse)
ggggaccactttgtacaagaaagctgggttttttttaataagcttcga

SEQ ID NO: 11690 - DNA, 48 bp, Artificial Sequence
  Amplification primer (reverse)
ggggaccactttgtacaagaaagctgggttttttttgtaaacttcctg

SEQ ID NO: 11691 - DNA, 51 bp, Artificial Sequence
  Amplification primer (reverse)
ggggaccactttgtacaagaaagctgggttcttagatacattgtttttttc

SEQ ID NO: 11692 - DNA, 48 bp, Artificial Sequence
  Amplification primer (reverse)
ggggaccactttgtacaagaaagctgggttctttcttttcttacttgc

SEQ ID NO: 11693 - DNA, 52 bp, Artificial Sequence
  Amplification primer (reverse)
ggggaccactttgtacaagaaagctgggtttttattatttttaatacttgaa

SEQ ID NO: 11694 - DNA, 49 bp, Artificial Sequence
  Amplification primer (reverse)
ggggaccactttgtacaagaaagctgggttcttcaactgttgatagagc

SEQ ID NO: 11695 - DNA, 46 bp, Artificial Sequence
  Amplification primer (reverse)
ggggaccactttgtacaagaaagctgggtttcctttagcaggagct

SEQ ID NO: 11696 - DNA, 50 bp, Artificial Sequence
  Amplification primer (reverse)
ggggaccactttgtacaagaaagctgggttgttatacatgttgtctgaag

SEQ ID NO: 11697 - DNA, 48 bp, Artificial Sequence
  Amplification primer (reverse)
ggggaccactttgtacaagaaagctgggttccaaataataacacgttt

SEQ ID NO: 11698 - DNA, 46 bp, Artificial Sequence
  Amplification primer (reverse)
ggggaccactttgtacaagaaagctgggttgctatccctttccaat

SEQ ID NO: 11699 - DNA, 50 bp, Artificial Sequence
  Amplification primer (reverse)
ggggaccactttgtacaagaaagctgggtttgtatttttaatttgttttc

SEQ ID NO: 11700 - DNA, 50 bp, Artificial Sequence; identical to SEQ ID NO: 11699
  Amplification primer (reverse)

SEQ ID NO: 11701 - DNA, 50 bp, Artificial Sequence
  Amplification primer (reverse)
ggggaccactttgtacaagaaagctgggttcaaacttttaacatttaatg

SEQ ID NO: 11702 - DNA, 48 bp, Artificial Sequence
  Amplification primer (reverse)
ggggaccactttgtacaagaaagctgggttatagtgtaagctaccagc

SEQ ID NO: 11703 - DNA, 48 bp, Artificial Sequence
  Amplification primer (reverse)
ggggaccactttgtacaagaaagctgggttgtcatcatattcctgaaa

SEQ ID NO: 11704 - DNA, 46 bp, Artificial Sequence
  Amplification primer (reverse)
ggggaccactttgtacaagaaagctgggtttgttcggcgtaagatt

SEQ ID NO: 11705 - DNA, 47 bp, Artificial Sequence
  Amplification primer (reverse)
ggggaccactttgtacaagaaagctgggttattggtcatttcttgag

SEQ ID NO: 11706 - DNA, 48 bp, Artificial Sequence
  Amplification primer (reverse)
ggggaccactttgtacaagaaagctgggttaacagatttattggttgg

SEQ ID NO: 11707 - DNA, 49 bp, Artificial Sequence
  Amplification primer (reverse)
ggggaccactttgtacaagaaagctgggttagactcatcaactttttct

SEQ ID NO: 11708 - DNA, 46 bp, Artificial Sequence
  Amplification primer (reverse)
ggggaccactttgtacaagaaagctgggttgaaccctgaagggtag

SEQ ID NO: 11709 - DNA, 48 bp, Artificial Sequence
  Amplification primer (reverse)
ggggaccactttgtacaagaaagctgggttccaattgtatttttcaac

SEQ ID NO: 11710 - DNA, 51 bp, Artificial Sequence
  Amplification primer (reverse)
ggggaccactttgtacaagaaagctgggttatttatactacctgttgaatc

SEQ ID NO: 11711 - DNA, 52 bp, Artificial Sequence
  Amplification primer (reverse)
ggggaccactttgtacaagaaagctgggtttttaaatttgtagtctttaata

SEQ ID NO: 11712 - DNA, 49 bp, Artificial Sequence
  Amplification primer (reverse)
ggggaccactttgtacaagaaagctgggttctcttttacttttccaaaa

SEQ ID NO: 11713 - DNA, 46 bp, Artificial Sequence
  Amplification primer (reverse)
ggggaccactttgtacaagaaagctgggttccctcccttaagagaa

SEQ ID NO: 11714 - DNA, 46 bp, Artificial Sequence
  Amplification primer (reverse)
ggggaccactttgtacaagaaagctgggttttgacgatgttgcatc

SEQ ID NO: 11715 - DNA, 48 bp, Artificial Sequence
  Amplification primer (reverse)
ggggaccactttgtacaagaaagctgggtttttcgaattattgtgact

SEQ ID NO: 11716 - DNA, 46 bp, Artificial Sequence
  Amplification primer (reverse)
ggggaccactttgtacaagaaagctgggttgtattgttgttgcctg

SEQ ID NO: 11717 - DNA, 47 bp, Artificial Sequence
  Amplification primer (reverse)
ggggaccactttgtacaagaaagctgggtttttttgatttccctttc

SEQ ID NO: 11718 - DNA, 48 bp, Artificial Sequence
  Amplification primer (reverse)
ggggaccactttgtacaagaaagctgggtttttatagtgtgtttgcaa

SEQ ID NO: 11719 - DNA, 47 bp, Artificial Sequence
  Amplification primer (reverse)
ggggaccactttgtacaagaaagctgggtttttgctaggaactttga

SEQ ID NO: 11720 - DNA, 47 bp, Artificial Sequence
  Amplification primer (reverse)
ggggaccactttgtacaagaaagctgggtttgattcaattccttttc

SEQ ID NO: 11721 - DNA, 49 bp, Artificial Sequence
  Amplification primer (reverse)
ggggaccactttgtacaagaaagctgggtttttttcctctactttctta

SEQ ID NO: 11722 - DNA, 46 bp, Artificial Sequence
  Amplification primer (reverse)
ggggaccactttgtacaagaaagctgggtttttgctcacctccaca

SEQ ID NO: 11723 - DNA, 51 bp, Artificial Sequence
  Amplification primer (reverse)
ggggaccactttgtacaagaaagctgggttcaataacttctgtaaaataaa

SEQ ID NO: 11724 - DNA, 48 bp, Artificial Sequence
  Amplification primer (reverse)
ggggaccactttgtacaagaaagctgggttttcacccttaaaataatt

SEQ ID NO: 11725 - DNA, 46 bp, Artificial Sequence
  Amplification primer (reverse)
ggggaccactttgtacaagaaagctgggtttgcatttttcccttct

SEQ ID NO: 11726 - DNA, 52 bp, Artificial Sequence
  Amplification primer (reverse)
ggggaccactttgtacaagaaagctgggttctccagtaaagtattagtattt

SEQ ID NO: 11727 - DNA, 47 bp, Artificial Sequence
  Amplification primer (reverse)
ggggaccactttgtacaagaaagctgggttgtgaggttttggtaatt

SEQ ID NO: 11728 - DNA, 49 bp, Artificial Sequence
  Amplification primer (reverse)
ggggaccactttgtacaagaaagctgggtttgcatataagttttttagc

SEQ ID NO: 11729 - DNA, 49 bp, Artificial Sequence; identical to SEQ ID NO: 11728
  Amplification primer (reverse)

SEQ ID NO: 11730 - DNA, 49 bp, Artificial Sequence
  Amplification primer (reverse)
ggggaccactttgtacaagaaagctgggttctcatctaaagtgctatcc

SEQ ID NO: 11731 - DNA, 47 bp, Artificial Sequence
  Amplification primer (reverse)
ggggaccactttgtacaagaaagctgggttctcgtatttaggcaact

SEQ ID NO: 11732 - DNA, 47 bp, Artificial Sequence
  Amplification primer (reverse)
ggggaccactttgtacaagaaagctgggttattggatatgccataaa

SEQ ID NO: 11733 - DNA, 50 bp, Artificial Sequence
  Amplification primer (reverse)
ggggaccactttgtacaagaaagctgggttgactttttgatgtttacttt

SEQ ID NO: 11734 - DNA, 52 bp, Artificial Sequence
  Amplification primer (reverse)
ggggaccactttgtacaagaaagctgggttttctttactataaacatcttca

SEQ ID NO: 11735 - DNA, 49 bp, Artificial Sequence
  Amplification primer (reverse)
ggggaccactttgtacaagaaagctgggttagcatttaaagttgaatgt

SEQ ID NO: 11736 - DNA, 49 bp, Artificial Sequence
  Amplification primer (reverse)
ggggaccactttgtacaagaaagctgggttgttagtctcttcaagatca

SEQ ID NO: 11737 - DNA, 46 bp, Artificial Sequence
  Amplification primer (reverse)
ggggaccactttgtacaagaaagctgggttaagacctaccgcccaa

SEQ ID NO: 11738 - DNA, 50 bp, Artificial Sequence
  Amplification primer (reverse)
ggggaccactttgtacaagaaagctgggtttacttctttctctttcaatt

SEQ ID NO: 11739 - DNA, 48 bp, Artificial Sequence
  Amplification primer (reverse)
ggggaccactttgtacaagaaagctgggttcttagtgttccgatatga

SEQ ID NO: 11740 - DNA, 48 bp, Artificial Sequence
  Amplification primer (reverse)
ggggaccactttgtacaagaaagctgggtttcttgttttaagagcaga

SEQ ID NO: 11741 - DNA, 48 bp, Artificial Sequence; identical to SEQ ID NO: 11740
  Amplification primer (reverse)

SEQ ID NO: 11742 - DNA, 47 bp, Artificial Sequence
  Amplification primer (reverse)
ggggaccactttgtacaagaaagctgggttatcatgttttccctcaa

SEQ ID NO: 11743 - DNA, 50 bp, Artificial Sequence
  Amplification primer (reverse)
ggggaccactttgtacaagaaagctgggttatctgatatatccgttttat

SEQ ID NO: 11744 - DNA, 49 bp, Artificial Sequence
  Amplification primer (reverse)
ggggaccactttgtacaagaaagctgggttttttttgtctcctttttta

SEQ ID NO: 11745 - DNA, 50 bp, Artificial Sequence
  Amplification primer (reverse)
ggggaccactttgtacaagaaagctgggttaaagacacgataaacataag

SEQ ID NO: 11746 - DNA, 50 bp, Artificial Sequence; identical to SEQ ID NO: 11745
  Amplification primer (reverse)

SEQ ID NO: 11747 - DNA, 49 bp, Artificial Sequence
  Amplification primer (reverse)
ggggaccactttgtacaagaaagctgggttatttgcaacttcttgtata

SEQ ID NO: 11748 - DNA, 52 bp, Artificial Sequence
  Amplification primer (reverse)
ggggaccactttgtacaagaaagctgggtttttaaaagtatccttaaataag

SEQ ID NO: 11749 - DNA, 48 bp, Artificial Sequence
  Amplification primer (reverse)
ggggaccactttgtacaagaaagctgggttcttcctcctcaatagttg

SEQ ID NO: 11750 - DNA, 46 bp, Artificial Sequence
  Amplification primer (reverse)
ggggaccactttgtacaagaaagctgggttttctcctcccccatta

SEQ ID NO: 11751 - DNA, 47 bp, Artificial Sequence
  Amplification primer (reverse)
ggggaccactttgtacaagaaagctgggttatccaaacgagtgaaat

SEQ ID NO: 11752 - DNA, 48 bp, Artificial Sequence
  Amplification primer (reverse)
ggggaccactttgtacaagaaagctgggttaggtgttgttgtattttc

SEQ ID NO: 11753 - DNA, 52 bp, Artificial Sequence
  Amplification primer (reverse)
ggggaccactttgtacaagaaagctgggttctttctaagtttattaaacata

SEQ ID NO: 11754 - DNA, 46 bp, Artificial Sequence
  Amplification primer (reverse)
ggggaccactttgtacaagaaagctgggttggcatctgttaccttg

SEQ ID NO: 11755 - DNA, 49 bp, Artificial Sequence
  Amplification primer (reverse)
ggggaccactttgtacaagaaagctgggttaaacaactccattattttt

SEQ ID NO: 11756 - DNA, 47 bp, Artificial Sequence
  Amplification primer (reverse)
ggggaccactttgtacaagaaagctgggtttaaacgttgaagagcat

SEQ ID NO: 11757 - DNA, 52 bp, Artificial Sequence
  Amplification primer (reverse)
ggggaccactttgtacaagaaagctgggttcttatcatatcttgttaaatca

SEQ ID NO: 11758 - DNA, 52 bp, Artificial Sequence; identical to SEQ ID NO: 11757
  Amplification primer (reverse)

SEQ ID NO: 11759 - DNA, 46 bp, Artificial Sequence
  Amplification primer (reverse)
ggggaccactttgtacaagaaagctgggttttgccatgggttatag

SEQ ID NO: 11760 - DNA, 49 bp, Artificial Sequence
  Amplification primer (reverse)
ggggaccactttgtacaagaaagctgggttagaattaaaattttcatgc

SEQ ID NO: 11761 - DNA, 49 bp, Artificial Sequence; identical to SEQ ID NO: 11760
  Amplification primer (reverse)

SEQ ID NO: 11762 - DNA, 50 bp, Artificial Sequence
  Amplification primer (reverse)
ggggaccactttgtacaagaaagctgggttttttttagatgttttatgtg

SEQ ID NO: 11763 - DNA, 49 bp, Artificial Sequence
  Amplification primer (reverse)
ggggaccactttgtacaagaaagctgggttctcttttactttagcttca

SEQ ID NO: 11764 - DNA, 46 bp, Artificial Sequence
  Amplification primer (reverse)
ggggaccactttgtacaagaaagctgggtttttcaaactccagcca

SEQ ID NO: 11765 - DNA, 46 bp, Artificial Sequence
  Amplification primer (reverse)
ggggaccactttgtacaagaaagctgggttggagtgcctttctact

SEQ ID NO: 11766 - DNA, 48 bp, Artificial Sequence
  Amplification primer (reverse)
ggggaccactttgtacaagaaagctgggttttcatatcgtaaagcatc

SEQ ID NO: 11767 - DNA, 46 bp, Artificial Sequence
  Amplification primer (reverse)
ggggaccactttgtacaagaaagctgggttatcgtcaaccttaacg

SEQ ID NO: 11768 - DNA, 48 bp, Artificial Sequence
  Amplification primer (reverse)
ggggaccactttgtacaagaaagctgggttttttacttgacgtctcac

SEQ ID NO: 11769 - DNA, 49 bp, Artificial Sequence
  Amplification primer (reverse)
ggggaccactttgtacaagaaagctgggttgtcttccattaatattccc

SEQ ID NO: 11770 - DNA, 49 bp, Artificial Sequence
  Amplification primer (reverse)
ggggaccactttgtacaagaaagctgggttccaattattttgaaagttc

SEQ ID NO: 11771 - DNA, 52 bp, Artificial Sequence
  Amplification primer (reverse)
ggggaccactttgtacaagaaagctgggttatttttttgaataatataatcc

SEQ ID NO: 11772 - DNA, 48 bp, Artificial Sequence
  Amplification primer (reverse)
ggggaccactttgtacaagaaagctgggtttttattatcagaaaaggc

SEQ ID NO: 11773 - DNA, 48 bp, Artificial Sequence
  Amplification primer (reverse)
ggggaccactttgtacaagaaagctgggttattcaaaaaatttttcaa

SEQ ID NO: 11774 - DNA, 46 bp, Artificial Sequence
  Amplification primer (reverse)
ggggaccactttgtacaagaaagctgggttcgaaacgtcaggtaaa

SEQ ID NO: 11775 - DNA, 53 bp, Artificial Sequence
  Amplification primer (reverse)
ggggaccactttgtacaagaaagctgggttacttatttttgataatatttctt

SEQ ID NO: 11776 - DNA, 47 bp, Artificial Sequence
  Amplification primer (reverse)
ggggaccactttgtacaagaaagctgggttatcagcatttctacgaa

SEQ ID NO: 11777 - DNA, 50 bp, Artificial Sequence
  Amplification primer (reverse)
ggggaccactttgtacaagaaagctgggttatgtagactcctaatgattt

SEQ ID NO: 11778 - DNA, 47 bp, Artificial Sequence
  Amplification primer (reverse)
ggggaccactttgtacaagaaagctgggtttttactgttcctttcgc

SEQ ID NO: 11779 - DNA, 52 bp, Artificial Sequence
  Amplification primer (reverse)
ggggaccactttgtacaagaaagctgggttgagattaatttgattatatttt

SEQ ID NO: 11780 - DNA, 46 bp, Artificial Sequence
  Amplification primer (reverse)
ggggaccactttgtacaagaaagctgggttaacatcatttcctccc

SEQ ID NO: 11781 - DNA, 48 bp, Artificial Sequence
  Amplification primer (reverse)
ggggaccactttgtacaagaaagctgggttgttgatagttccaaaacg

SEQ ID NO: 11782 - DNA, 51 bp, Artificial Sequence
  Amplification primer (reverse)
ggggaccactttgtacaagaaagctgggtttaaatgtgttcctactaaatt

SEQ ID NO: 11783 - DNA, 47 bp, Artificial Sequence
  Amplification primer (reverse)
ggggaccactttgtacaagaaagctgggttcatcaatagccgagctg

SEQ ID NO: 11784 - DNA, 48 bp, Artificial Sequence
  Amplification primer (reverse)
ggggaccactttgtacaagaaagctgggtttttattttccaaatgaca

SEQ ID NO: 11785 - DNA, 47 bp, Artificial Sequence
  Amplification primer (reverse)
ggggaccactttgtacaagaaagctgggttttcactcggagttggag

SEQ ID NO: 11786 - DNA, 47 bp, Artificial Sequence; identical to SEQ ID NO: 11785
  Amplification primer (reverse)

SEQ ID NO: 11787 - DNA, 49 bp, Artificial Sequence
  Amplification primer (reverse)
ggggaccactttgtacaagaaagctgggttaatgtaaatgacaaaggta

SEQ ID NO: 11788 - DNA, 47 bp, Artificial Sequence
  Amplification primer (reverse)
ggggaccactttgtacaagaaagctgggttgttttttaatggtttgc

SEQ ID NO: 11789 - DNA, 50 bp, Artificial Sequence
  Amplification primer (reverse)
ggggaccactttgtacaagaaagctgggtttttatcataagcatctagac

SEQ ID NO: 11790 - DNA, 48 bp, Artificial Sequence
  Amplification primer (reverse)
ggggaccactttgtacaagaaagctgggttctgatctcttgttgatgc

SEQ ID NO: 11791 - DNA, 46 bp, Artificial Sequence
  Amplification primer (reverse)
ggggaccactttgtacaagaaagctgggttaagcaggggagcaata

SEQ ID NO: 11792 - DNA, 46 bp, Artificial Sequence; identical to SEQ ID NO: 11791
  Amplification primer (reverse)

SEQ ID NO: 11793 - DNA, 46 bp, Artificial Sequence
  Amplification primer (reverse)
ggggaccactttgtacaagaaagctgggttctgagcaacacctgtc

SEQ ID NO: 11794 - DNA, 46 bp, Artificial Sequence
  Amplification primer (reverse)
ggggaccactttgtacaagaaagctgggttggcaattttgtggcaa

SEQ ID NO: 11795 - DNA, 47 bp, Artificial Sequence
  Amplification primer (reverse)
ggggaccactttgtacaagaaagctgggttttgcttagttaatggct

SEQ ID NO: 11796 - DNA, 48 bp, Artificial Sequence
  Amplification primer (reverse)
ggggaccactttgtacaagaaagctgggttaggcgttgaatataattc

SEQ ID NO: 11797 - DNA, 48 bp, Artificial Sequence; identical to SEQ ID NO: 11796
  Amplification primer (reverse)

SEQ ID NO: 11798 - DNA, 47 bp, Artificial Sequence
  Amplification primer (reverse)
ggggaccactttgtacaagaaagctgggttcttttcaactccaaaca

SEQ ID NO: 11799 - DNA, 48 bp, Artificial Sequence
  Amplification primer (reverse)
ggggaccactttgtacaagaaagctgggttgagttgtctttttttgtc

SEQ ID NO: 11800 - DNA, 47 bp, Artificial Sequence
  Amplification primer (reverse)
ggggaccactttgtacaagaaagctgggttgcaatcacaattgacat

SEQ ID NO: 11801 - DNA, 47 bp, Artificial Sequence
  Amplification primer (reverse)
ggggaccactttgtacaagaaagctgggttctttgtctgcttcactt

SEQ ID NO: 11802 - DNA, 48 bp, Artificial Sequence
  Amplification primer (reverse)
ggggaccactttgtacaagaaagctgggttttgtatcttctcctgacc

SEQ ID NO: 11803 - DNA, 46 bp, Artificial Sequence
  Amplification primer (reverse)
ggggaccactttgtacaagaaagctgggttttggttaatcgtcttg

SEQ ID NO: 11804 - DNA, 46 bp, Artificial Sequence; identical to SEQ ID NO: 11803
  Amplification primer (reverse)

SEQ ID NO: 11805 - DNA, 51 bp, Artificial Sequence
  Amplification primer (reverse)
ggggaccactttgtacaagaaagctgggtttttagttactttcataaatgg

SEQ ID NO: 11806 - DNA, 51 bp, Artificial Sequence; identical to SEQ ID NO: 11805
  Amplification primer (reverse)

SEQ ID NO: 11807 - DNA, 52 bp, Artificial Sequence
  Amplification primer (reverse)
ggggaccactttgtacaagaaagctgggttatataattcctctaaaactagc

SEQ ID NO: 11808 - DNA, 49 bp, Artificial Sequence
  Amplification primer (reverse)
ggggaccactttgtacaagaaagctgggttccacttcaaattaactaac

SEQ ID NO: 11809 - DNA, 46 bp, Artificial Sequence
  Amplification primer (reverse)
ggggaccactttgtacaagaaagctgggttattccttgaacacgaa

SEQ ID NO: 11810 - DNA, 46 bp, Artificial Sequence
  Amplification primer (reverse)
ggggaccactttgtacaagaaagctgggttgtgccattcattctct

SEQ ID NO: 11811 - DNA, 47 bp, Artificial Sequence
  Amplification primer (reverse)
ggggaccactttgtacaagaaagctgggttttgtcctgtgaactgtg

SEQ ID NO: 11812 - DNA, 48 bp, Artificial Sequence
  Amplification primer (reverse)
ggggaccactttgtacaagaaagctgggttagggtttatttgttgaag

SEQ ID NO: 11813 - DNA, 47 bp, Artificial Sequence
  Amplification primer (reverse)
ggggaccactttgtacaagaaagctgggtttcctgatttatccactg

SEQ ID NO: 11814 - DNA, 48 bp, Artificial Sequence; identical to SEQ ID NO: 11812
  Amplification primer (reverse)

SEQ ID NO: 11815 - DNA, 48 bp, Artificial Sequence
  Amplification primer (reverse)
ggggaccactttgtacaagaaagctgggttcaaaatacctaagctagc

SEQ ID NO: 11816 - DNA, 46 bp, Artificial Sequence
  Amplification primer (reverse)
ggggaccactttgtacaagaaagctgggttacgaacttccataacc

SEQ ID NO: 11817 - DNA, 46 bp, Artificial Sequence
  Amplification primer (reverse)
ggggaccactttgtacaagaaagctgggttggcttctccaatcaaa

SEQ ID NO: 11818 - DNA, 48 bp, Artificial Sequence
  Amplification primer (reverse)
ggggaccactttgtacaagaaagctgggttttgagttaatggattgtt

SEQ ID NO: 11819 - DNA, 48 bp, Artificial Sequence
  Amplification primer (reverse)
ggggaccactttgtacaagaaagctgggtttagcgttatttcactgtg

SEQ ID NO: 11820 - DNA, 46 bp, Artificial Sequence
  Amplification primer (reverse)
ggggaccactttgtacaagaaagctgggtttttctccgcccagtca

SEQ ID NO: 11821 - DNA, 49 bp, Artificial Sequence
  Amplification primer (reverse)
ggggaccactttgtacaagaaagctgggttccgtttattctttctactg

SEQ ID NO: 11822 - DNA, 48 bp, Artificial Sequence
  Amplification primer (reverse)
ggggaccactttgtacaagaaagctgggttcatatctgttgcatcaat

SEQ ID NO: 11823 - DNA, 48 bp, Artificial Sequence
  Amplification primer (reverse)
ggggaccactttgtacaagaaagctgggttaactggctttttagtcag

SEQ ID NO: 11824 - DNA, 52 bp, Artificial Sequence
  Amplification primer (reverse)
ggggaccactttgtacaagaaagctgggtttttattatttaattcttcaata

SEQ ID NO: 11825 - DNA, 47 bp, Artificial Sequence
  Amplification primer (reverse)
ggggaccactttgtacaagaaagctgggttgtcttttagagcatcga

SEQ ID NO: 11826 - DNA, 49 bp, Artificial Sequence
  Amplification primer (reverse)
ggggaccactttgtacaagaaagctgggttctctcctctaagactttcg

SEQ ID NO: 11827 - DNA, 48 bp, Artificial Sequence
  Amplification primer (reverse)
ggggaccactttgtacaagaaagctgggtttccttttgttacttttgc

SEQ ID NO: 11828 - DNA, 46 bp, Artificial Sequence
  Amplification primer (reverse)
ggggaccactttgtacaagaaagctgggtttttatcgcctttgttg

SEQ ID NO: 11829 - DNA, 46 bp, Artificial Sequence
  Amplification primer (reverse)
ggggaccactttgtacaagaaagctgggttatgttcaggttctccg

SEQ ID NO: 11830 - DNA, 49 bp, Artificial Sequence
  Amplification primer (reverse)
ggggaccactttgtacaagaaagctgggttttccattatcttcaagtta

SEQ ID NO: 11831 - DNA, 49 bp, Artificial Sequence
  Amplification primer (reverse)
ggggaccactttgtacaagaaagctgggttctcttcttcatttttctta

SEQ ID NO: 11832 - DNA, 50 bp, Artificial Sequence
  Amplification primer (reverse)
ggggaccactttgtacaagaaagctgggtttttttttaagttgtagaatg

SEQ ID NO: 11833 - DNA, 48 bp, Artificial Sequence
  Amplification primer (reverse)
ggggaccactttgtacaagaaagctgggttgttttttgatgcttcttg

SEQ ID NO: 11834 - DNA, 48 bp, Artificial Sequence
  Amplification primer (reverse)
ggggaccactttgtacaagaaagctgggtttttactactttggttggc

SEQ ID NO: 11835 - DNA, 47 bp, Artificial Sequence
  Amplification primer (reverse)
ggggaccactttgtacaagaaagctgggttgtgtgtcattttgacct

SEQ ID NO: 11836 - DNA, 48 bp, Artificial Sequence
  Amplification primer (reverse)
ggggaccactttgtacaagaaagctgggtttccttcaagatcatttaa

SEQ ID NO: 11837 - DNA, 48 bp, Artificial Sequence
  Amplification primer (reverse)
ggggaccactttgtacaagaaagctgggttacctccttttctttcatt

SEQ ID NO: 11838 - DNA, 49 bp, Artificial Sequence
  Amplification primer (reverse)
ggggaccactttgtacaagaaagctgggttatcttctcctaacttaccc

SEQ ID NO: 11839 - DNA, 50 bp, Artificial Sequence
  Amplification primer (reverse)
ggggaccactttgtacaagaaagctgggttactagctagattcttaacgc

SEQ ID NO: 11840 - DNA, 49 bp, Artificial Sequence; identical to SEQ ID NO: 11838
  Amplification primer (reverse)

SEQ ID NO: 11841 - DNA, 46 bp, Artificial Sequence
  Amplification primer (reverse)
ggggaccactttgtacaagaaagctgggttgcctctttctccaaat

SEQ ID NO: 11842 - DNA, 50 bp, Artificial Sequence
  Amplification primer (reverse)
ggggaccactttgtacaagaaagctgggttatgtcctgttatatcttctt

SEQ ID NO: 11843 - DNA, 46 bp, Artificial Sequence
  Amplification primer (reverse)
ggggaccactttgtacaagaaagctgggttgcgttgaataatggtt

SEQ ID NO: 11844 - DNA, 50 bp, Artificial Sequence
  Amplification primer (reverse)
ggggaccactttgtacaagaaagctgggtttatttctttagtttcttcaa

SEQ ID NO: 11845 - DNA, 53 bp, Artificial Sequence
  Amplification primer (reverse)
ggggaccactttgtacaagaaagctgggtttaataaaaattatataagaacct

SEQ ID NO: 11846 - DNA, 50 bp, Artificial Sequence
  Amplification primer (reverse)
ggggaccactttgtacaagaaagctgggttttctgtcttataagcataag

SEQ ID NO: 11847 - DNA, 49 bp, Artificial Sequence
  Amplification primer (reverse)
ggggaccactttgtacaagaaagctgggttttttttataagcatgtgta

SEQ ID NO: 11848 - DNA, 48 bp, Artificial Sequence
  Amplification primer (reverse)
ggggaccactttgtacaagaaagctgggttatgagacataaggtcttg

SEQ ID NO: 11849 - DNA, 46 bp, Artificial Sequence
  Amplification primer (reverse)
ggggaccactttgtacaagaaagctgggttgttggagctcctactg

SEQ ID NO: 11850 - DNA, 46 bp, Artificial Sequence; identical to SEQ ID NO: 11849
  Amplification primer (reverse)

SEQ ID NO: 11851 - DNA, 48 bp, Artificial Sequence
  Amplification primer (reverse)
ggggaccactttgtacaagaaagctgggttcatttctttggttaaagc

SEQ ID NO: 11852 - DNA, 48 bp, Artificial Sequence
  Amplification primer (reverse)
ggggaccactttgtacaagaaagctgggtttatctcgagtgctatttg

SEQ ID NO: 11853 - DNA, 49 bp, Artificial Sequence
  Amplification primer (reverse)
ggggaccactttgtacaagaaagctgggttctcttcatcgacatagtaa

SEQ ID NO: 11854 - DNA, 48 bp, Artificial Sequence; identical to SEQ ID NO: 11852
  Amplification primer (reverse)

SEQ ID NO: 11855 - DNA, 50 bp, Artificial Sequence
  Amplification primer (reverse)
ggggaccactttgtacaagaaagctgggttattttacagtagtggagttt

SEQ ID NO: 11856 - DNA, 46 bp, Artificial Sequence
  Amplification primer (reverse)
ggggaccactttgtacaagaaagctgggtttgtcctcattttttca

SEQ ID NO: 11857 - DNA, 48 bp, Artificial Sequence
  Amplification primer (reverse)
ggggaccactttgtacaagaaagctgggtttttaacagtacgaacacg

SEQ ID NO: 11858 - DNA, 47 bp, Artificial Sequence
  Amplification primer (reverse)
ggggaccactttgtacaagaaagctgggttccccctgtttttaaaat

SEQ ID NO: 11859 - DNA, 46 bp, Artificial Sequence
  Amplification primer (reverse)
ggggaccactttgtacaagaaagctgggttaccctcatatgattcc

SEQ ID NO: 11860 - DNA, 51 bp, Artificial Sequence
  Amplification primer (reverse)
ggggaccactttgtacaagaaagctgggtttttaaaataatgatacatctc

SEQ ID NO: 11861 - DNA, 51 bp, Artificial Sequence; identical to SEQ ID NO: 11860
  Amplification primer (reverse)

SEQ ID NO: 11862 - DNA, 46 bp, Artificial Sequence
  Amplification primer (reverse)
ggggaccactttgtacaagaaagctgggtttaaccccgtctcaaca

SEQ ID NO: 11863 - DNA, 48 bp, Artificial Sequence
  Amplification primer (reverse)
ggggaccactttgtacaagaaagctgggtttattttcgttttctcaaa

SEQ ID NO: 11864 - DNA, 49 bp, Artificial Sequence
  Amplification primer (reverse)
ggggaccactttgtacaagaaagctgggtttttctccaaataatctctc

SEQ ID NO: 11865 - DNA, 51 bp, Artificial Sequence
  Amplification primer (reverse)
ggggaccactttgtacaagaaagctgggttcctacttttagttttagaaga

SEQ ID NO: 11866 - DNA, 46 bp, Artificial Sequence
  Amplification primer (reverse)
ggggaccactttgtacaagaaagctgggttgaaatcatagcttccc

SEQ ID NO: 11867 - DNA, 49 bp, Artificial Sequence
  Amplification primer (reverse)
ggggaccactttgtacaagaaagctgggttaccttttacttttggtagt

SEQ ID NO: 11868 - DNA, 49 bp, Artificial Sequence; identical to SEQ ID NO: 11867
  Amplification primer (reverse)

SEQ ID NO: 11869 - DNA, 49 bp, Artificial Sequence
  Amplification primer (reverse)
ggggaccactttgtacaagaaagctgggttttgtttgtgaagtaaaacg

SEQ ID NO: 11870 - DNA, 50 bp, Artificial Sequence
  Amplification primer (reverse)
ggggaccactttgtacaagaaagctgggtttaatttaaaaattgcataaa

SEQ ID NO: 11871 - DNA, 49 bp, Artificial Sequence
  Amplification primer (reverse)
ggggaccactttgtacaagaaagctgggtttttcgttaccatatctaga

SEQ ID NO: 11872 - DNA, 48 bp, Artificial Sequence
  Amplification primer (reverse)
ggggaccactttgtacaagaaagctgggtttaaatcatggaaactagc

SEQ ID NO: 11873 - DNA, 46 bp, Artificial Sequence
  Amplification primer (reverse)
ggggaccactttgtacaagaaagctgggttaaagcccaaccttccg

SEQ ID NO: 11874 - DNA, 46 bp, Artificial Sequence
  Amplification primer (reverse)
ggggaccactttgtacaagaaagctgggttgtttccacgtcctttc

SEQ ID NO: 11875 - DNA, 48 bp, Artificial Sequence
  Amplification primer (reverse)
ggggaccactttgtacaagaaagctgggttaagtttattcaaatctgg

SEQ ID NO: 11876 - DNA, 50 bp, Artificial Sequence
  Amplification primer (reverse)
ggggaccactttgtacaagaaagctgggttaatgtaatggttttttaata

SEQ ID NO: 11877 - DNA, 49 bp, Artificial Sequence
  Amplification primer (reverse)
ggggaccactttgtacaagaaagctgggttagctaaaatacctaaccag

SEQ ID NO: 11878 - DNA, 48 bp, Artificial Sequence
  Amplification primer (reverse)
ggggaccactttgtacaagaaagctgggttattttttaaacgactcat

SEQ ID NO: 11879 - DNA, 46 bp, Artificial Sequence
  Amplification primer (reverse)
ggggaccactttgtacaagaaagctgggttagcggaacggtgaata

SEQ ID NO: 11880 - DNA, 51 bp, Artificial Sequence
  Amplification primer (reverse)
ggggaccactttgtacaagaaagctgggttataatctaaactatcagctct

SEQ ID NO: 11881 - DNA, 50 bp, Artificial Sequence
  Amplification primer (reverse)
ggggaccactttgtacaagaaagctgggttatctcctattgtaattttga

SEQ ID NO: 11882 - DNA, 50 bp, Artificial Sequence; identical to SEQ ID NO: 11881
  Amplification primer (reverse)

SEQ ID NO: 11883 - DNA, 46 bp, Artificial Sequence
  Amplification primer (reverse)
ggggaccactttgtacaagaaagctgggttcacctcttttgtcaga

SEQ ID NO: 11884 - DNA, 48 bp, Artificial Sequence
  Amplification primer (reverse)
ggggaccactttgtacaagaaagctgggtttttgttagcgagtaagtc

SEQ ID NO: 11885 - DNA, 50 bp, Artificial Sequence
  Amplification primer (reverse)
ggggaccactttgtacaagaaagctgggtttttatcatcctccttaataa

SEQ ID NO: 11886 - DNA, 50 bp, Artificial Sequence
  Amplification primer (reverse)
ggggaccactttgtacaagaaagctgggttaaacgttttactctgtaaaa

SEQ ID NO: 11887 - DNA, 51 bp, Artificial Sequence
  Amplification primer (reverse)
ggggaccactttgtacaagaaagctgggttaaataagaatgttaaaagagc

SEQ ID NO: 11888 - DNA, 46 bp, Artificial Sequence
  Amplification primer (reverse)
ggggaccactttgtacaagaaagctgggttttccccaaaaatttct

SEQ ID NO: 11889 - DNA, 46 bp, Artificial Sequence
  Amplification primer (reverse)
ggggaccactttgtacaagaaagctgggttacgcagtcccattttc

SEQ ID NO: 11890 - DNA, 46 bp, Artificial Sequence
  Amplification primer (reverse)
ggggaccactttgtacaagaaagctgggttctggcatgaggtctca

SEQ ID NO: 11891 - DNA, 48 bp, Artificial Sequence
  Amplification primer (reverse)
ggggaccactttgtacaagaaagctgggttccttttttcaataatagc

SEQ ID NO: 11892 - DNA, 49 bp, Artificial Sequence
  Amplification primer (reverse)
ggggaccactttgtacaagaaagctgggttatctttaatcttaccatcc

SEQ ID NO: 11893 - DNA, 46 bp, Artificial Sequence
  Amplification primer (reverse)
ggggaccactttgtacaagaaagctgggtttgctgctactgcaatg

SEQ ID NO: 11894 - DNA, 49 bp, Artificial Sequence; identical to SEQ ID NO: 11892
  Amplification primer (reverse)

SEQ ID NO: 11895 - DNA, 50 bp, Artificial Sequence
  Amplification primer (reverse)
ggggaccactttgtacaagaaagctgggtttaaattcctttgttgtaata

SEQ ID NO: 11896 - DNA, 46 bp, Artificial Sequence
  Amplification primer (reverse)
ggggaccactttgtacaagaaagctgggttaccatcagttgtcacc

SEQ ID NO: 11897 - DNA, 46 bp, Artificial Sequence
  Amplification primer (reverse)
ggggaccactttgtacaagaaagctgggtttattgaccagtgcacg

SEQ ID NO: 11898 - DNA, 50 bp, Artificial Sequence
  Amplification primer (reverse)
ggggaccactttgtacaagaaagctgggtttttttttgaatttgtaaaag

SEQ ID NO: 11899 - DNA, 52 bp, Artificial Sequence
  Amplification primer (reverse)
ggggaccactttgtacaagaaagctgggttagagattatttttattttaaat

SEQ ID NO: 11900 - DNA, 52 bp, Artificial Sequence
  Amplification primer (reverse)
ggggaccactttgtacaagaaagctgggtttttatttttagtatctaaaacg

SEQ ID NO: 11901 - DNA, 51 bp, Artificial Sequence
  Amplification primer (reverse)
ggggaccactttgtacaagaaagctgggtttttagaaactccaagtatctc

SEQ ID NO: 11902 - DNA, 53 bp, Artificial Sequence
  Amplification primer (reverse)
ggggaccactttgtacaagaaagctgggttgttaatttgactattgatatatt

SEQ ID NO: 11903 - DNA, 50 bp, Artificial Sequence
  Amplification primer (reverse)
ggggaccactttgtacaagaaagctgggtttaaactctcaaaagctaaac

SEQ ID NO: 11904 - DNA, 46 bp, Artificial Sequence
  Amplification primer (reverse)
ggggaccactttgtacaagaaagctgggttacgttcttctctggct

SEQ ID NO: 11905 - DNA, 47 bp, Artificial Sequence
  Amplification primer (reverse)
ggggaccactttgtacaagaaagctgggttacttaaatggaacaacc

SEQ ID NO: 11906 - DNA, 48 bp, Artificial Sequence
  Amplification primer (reverse)
ggggaccactttgtacaagaaagctgggtttttgcctaaaaaattagg

SEQ ID NO: 11907 - DNA, 46 bp, Artificial Sequence
  Amplification primer (reverse)
ggggaccactttgtacaagaaagctgggttggctttcctcccttca

SEQ ID NO: 11908 - DNA, 49 bp, Artificial Sequence
  Amplification primer (reverse)
ggggaccactttgtacaagaaagctgggttttcatctttttcaatatca

SEQ ID NO: 11909 - DNA, 48 bp, Artificial Sequence
  Amplification primer (reverse)
ggggaccactttgtacaagaaagctgggttgtgagagtgtctttgttt

SEQ ID NO: 11910 - DNA, 50 bp, Artificial Sequence
  Amplification primer (reverse)
ggggaccactttgtacaagaaagctgggttcagatttttagctacttgtc

SEQ ID NO: 11911 - DNA, 48 bp, Artificial Sequence
  Amplification primer (reverse)
ggggaccactttgtacaagaaagctgggtttctagagcgctttataag

SEQ ID NO: 11912 - DNA, 50 bp, Artificial Sequence
  Amplification primer (reverse)
ggggaccactttgtacaagaaagctgggttttttctaatagttagaagcc

SEQ ID NO: 11913 - DNA, 47 bp, Artificial Sequence
  Amplification primer (reverse)
ggggaccactttgtacaagaaagctgggttttttaaatgtgcagaga

SEQ ID NO: 11914 - DNA, 48 bp, Artificial Sequence
  Amplification primer (reverse)
ggggaccactttgtacaagaaagctgggttatttataatttccttggg

SEQ ID NO: 11915 - DNA, 53 bp, Artificial Sequence
  Amplification primer (reverse)
ggggaccactttgtacaagaaagctgggtttctataatatctctctaaagtga

SEQ ID NO: 11916 - DNA, 47 bp, Artificial Sequence
  Amplification primer (reverse)
ggggaccactttgtacaagaaagctgggttcctcgctaacatatcac

SEQ ID NO: 11917 - DNA, 47 bp, Artificial Sequence
  Amplification primer (reverse)
ggggaccactttgtacaagaaagctgggttagctcttacagtcttgc

SEQ ID NO: 11918 - DNA, 46 bp, Artificial Sequence
  Amplification primer (reverse)
ggggaccactttgtacaagaaagctgggttttgtctgagtgaccaa

SEQ ID NO: 11919 - DNA, 52 bp, Artificial Sequence
  Amplification primer (reverse)
ggggaccactttgtacaagaaagctgggttataatatgaaatatgttgttca

SEQ ID NO: 11920 - DNA, 46 bp, Artificial Sequence
  Amplification primer (reverse)
ggggaccactttgtacaagaaagctgggtttccgcagagtaaaaaa

SEQ ID NO: 11921 - DNA, 46 bp, Artificial Sequence
  Amplification primer (reverse)
ggggaccactttgtacaagaaagctgggttttcataaatgtgccaa

SEQ ID NO: 11922 - DNA, 46 bp, Artificial Sequence
  Amplification primer (reverse)
ggggaccactttgtacaagaaagctgggttttcatctctgctcacc

SEQ ID NO: 11923 - DNA, 47 bp, Artificial Sequence
  Amplification primer (reverse)
ggggaccactttgtacaagaaagctgggttttctccttcagctttta

SEQ ID NO: 11924 - DNA, 50 bp, Artificial Sequence
  Amplification primer (reverse)
ggggaccactttgtacaagaaagctgggttgtcattttttctaaagtttg

SEQ ID NO: 11925 - DNA, 49 bp, Artificial Sequence
  Amplification primer (reverse)
ggggaccactttgtacaagaaagctgggtttttttgtagttgtttcaat

SEQ ID NO: 11926 - DNA, 52 bp, Artificial Sequence
  Amplification primer (reverse)
ggggaccactttgtacaagaaagctgggtttttcattagataactattcagc

SEQ ID NO: 11927 - DNA, 54 bp, Artificial Sequence
  Amplification primer (reverse)
ggggaccactttgtacaagaaagctgggtttatagactgaagataattaattaa

SEQ ID NO: 11928 - DNA, 48 bp, Artificial Sequence
  Amplification primer (reverse)
ggggaccactttgtacaagaaagctgggttaaatcgattaatcaagtc

SEQ ID NO: 11929 - DNA, 52 bp, Artificial Sequence
  Amplification primer (reverse)
ggggaccactttgtacaagaaagctgggtttctaaagtagtcctttagacta

SEQ ID NO: 11930 - DNA, 52 bp, Artificial Sequence; identical to SEQ ID NO: 11929
  Amplification primer (reverse)

SEQ ID NO: 11931 - DNA, 48 bp, Artificial Sequence
  Amplification primer (reverse)
ggggaccactttgtacaagaaagctgggtttttgtccataatcatttc

SEQ ID NO: 11932 - DNA, 49 bp, Artificial Sequence
  Amplification primer (reverse)
ggggaccactttgtacaagaaagctgggttggtagatatgcctaacatt

SEQ ID NO: 11933 - DNA, 46 bp, Artificial Sequence
  Amplification primer (reverse)
ggggaccactttgtacaagaaagctgggttgtttccttccaaaaaa

SEQ ID NO: 11934 - DNA, 46 bp, Artificial Sequence
  Amplification primer (reverse)
ggggaccactttgtacaagaaagctgggtttccatgcttaatagcc

SEQ ID NO: 11935 - DNA, 50 bp, Artificial Sequence
  Amplification primer (reverse)
ggggaccactttgtacaagaaagctgggttatctaaaccaatttctgtac

SEQ ID NO: 11936 - DNA, 46 bp, Artificial Sequence
  Amplification primer (reverse)
ggggaccactttgtacaagaaagctgggttgtccacaaaaacgtct

SEQ ID NO: 11937 - DNA, 48 bp, Artificial Sequence
  Amplification primer (reverse)
ggggaccactttgtacaagaaagctgggtttagatgttctacggagaa

SEQ ID NO: 11938 - DNA, 46 bp, Artificial Sequence
  Amplification primer (reverse)
ggggaccactttgtacaagaaagctgggttaaagatggcaagccat

SEQ ID NO: 11939 - DNA, 47 bp, Artificial Sequence
  Amplification primer (reverse)
ggggaccactttgtacaagaaagctgggtttctctctccacaccata

SEQ ID NO: 11940 - DNA, 46 bp, Artificial Sequence
  Amplification primer (reverse)
ggggaccactttgtacaagaaagctgggttcttacctcctgtggct

SEQ ID NO: 11941 - DNA, 47 bp, Artificial Sequence
  Amplification primer (reverse)
ggggaccactttgtacaagaaagctgggttcttttgttggttacctc

SEQ ID NO: 11942 - DNA, 52 bp, Artificial Sequence
  Amplification primer (reverse)
ggggaccactttgtacaagaaagctgggtttattgttaaatatgatgaaatg

SEQ ID NO: 11943 - DNA, 52 bp, Artificial Sequence
  Amplification primer (reverse)
ggggaccactttgtacaagaaagctgggttatgattatacaaattgattaat

SEQ ID NO: 11944 - DNA, 52 bp, Artificial Sequence; identical to SEQ ID NO: 11943
  Amplification primer (reverse)

SEQ ID NO: 11945 - DNA, 46 bp, Artificial Sequence
  Amplification primer (reverse)
ggggaccactttgtacaagaaagctgggtttccctcttccttgaca

SEQ ID NO: 11946 - DNA, 46 bp, Artificial Sequence
  Amplification primer (reverse)
ggggaccactttgtacaagaaagctgggttaacgtttttgagcttt

SEQ ID NO: 11947 - DNA, 48 bp, Artificial Sequence
  Amplification primer (reverse)
ggggaccactttgtacaagaaagctgggttttttgtcttaaacgttct

SEQ ID NO: 11948 - DNA, 50 bp, Artificial Sequence
  Amplification primer (reverse)
ggggaccactttgtacaagaaagctgggtttttagatagtctagccattt

SEQ ID NO: 11949 - DNA, 46 bp, Artificial Sequence
  Amplification primer (reverse)
ggggaccactttgtacaagaaagctgggttacggcttggggcagag

SEQ ID NO: 11950 - DNA, 46 bp, Artificial Sequence
  Amplification primer (reverse)
ggggaccactttgtacaagaaagctgggtttaccattatccgtgct

SEQ ID NO: 11951 - DNA, 50 bp, Artificial Sequence
  Amplification primer (reverse)
ggggaccactttgtacaagaaagctgggttactattaaactccaatgtta

SEQ ID NO: 11952 - DNA, 46 bp, Artificial Sequence
  Amplification primer (reverse)
ggggaccactttgtacaagaaagctgggttgcgcattgtaacaaat

SEQ ID NO: 11953 - DNA, 47 bp, Artificial Sequence
  Amplification primer (reverse)
ggggaccactttgtacaagaaagctgggttttttggtaaaaggtctg

SEQ ID NO: 11954 - DNA, 46 bp, Artificial Sequence
  Amplification primer (reverse)
ggggaccactttgtacaagaaagctgggtttcctggaaagttcatc

SEQ ID NO: 11955 - DNA, 49 bp, Artificial Sequence
  Amplification primer (reverse)
ggggaccactttgtacaagaaagctgggtttagtttatctaaagcgttc

SEQ ID NO: 11956 - DNA, 50 bp, Artificial Sequence
  Amplification primer (reverse)
ggggaccactttgtacaagaaagctgggtttttatgtatagaaacagcag

SEQ ID NO: 11957 - DNA, 52 bp, Artificial Sequence
  Amplification primer (reverse)
ggggaccactttgtacaagaaagctgggttaatgtacataacaatagagagc

SEQ ID NO: 11958 - DNA, 46 bp, Artificial Sequence
  Amplification primer (reverse)
ggggaccactttgtacaagaaagctgggttcaacgatcccaagaac

SEQ ID NO: 11959 - DNA, 46 bp, Artificial Sequence
  Amplification primer (reverse)
ggggaccactttgtacaagaaagctgggttgccattcttacctcct

SEQ ID NO: 11960 - DNA, 46 bp, Artificial Sequence
  Amplification primer (reverse)
ggggaccactttgtacaagaaagctgggttacgttttttctgaccg

SEQ ID NO: 11961 - DNA, 52 bp, Artificial Sequence
  Amplification primer (reverse)
ggggaccactttgtacaagaaagctgggtttataaaataaatttgaagatct

SEQ ID NO: 11962 - DNA, 48 bp, Artificial Sequence
  Amplification primer (reverse)
ggggaccactttgtacaagaaagctgggttatcatcttgtaccaactc

SEQ ID NO: 11963 - DNA, 46 bp, Artificial Sequence
  Amplification primer (reverse)
ggggaccactttgtacaagaaagctgggttgccaataaattcacgg

SEQ ID NO: 11964 - DNA, 50 bp, Artificial Sequence
  Amplification primer (reverse)
ggggaccactttgtacaagaaagctgggttagtctgttttttaacaaaag

SEQ ID NO: 11965 - DNA, 49 bp, Artificial Sequence
  Amplification primer (reverse)
ggggaccactttgtacaagaaagctgggtttggttttagaacaacttta

SEQ ID NO: 11966 - DNA, 48 bp, Artificial Sequence
  Amplification primer (reverse)
ggggaccactttgtacaagaaagctgggttaattaagctgaaaatgac

SEQ ID NO: 11967 - DNA, 52 bp, Artificial Sequence
  Amplification primer (reverse)
ggggaccactttgtacaagaaagctgggttattatattcttttaatttgtca

SEQ ID NO: 11968 - DNA, 46 bp, Artificial Sequence
  Amplification primer (reverse)
ggggaccactttgtacaagaaagctgggttcttacgacgtcctgga

SEQ ID NO: 11969 - DNA, 50 bp, Artificial Sequence
  Amplification primer (reverse)
ggggaccactttgtacaagaaagctgggttgtgtgtcatgactactgtac

SEQ ID NO: 11970 - DNA, 46 bp, Artificial Sequence
  Amplification primer (reverse)
ggggaccactttgtacaagaaagctgggtttgagtagagcacaagc

SEQ ID NO: 11971 - DNA, 47 bp, Artificial Sequence
  Amplification primer (reverse)
ggggaccactttgtacaagaaagctgggttgaaacgaatacgttctt

SEQ ID NO: 11972 - DNA, 48 bp, Artificial Sequence
  Amplification primer (reverse)
ggggaccactttgtacaagaaagctgggttactacctaccgttttcac

SEQ ID NO: 11973 - DNA, 47 bp, Artificial Sequence
  Amplification primer (reverse)
ggggaccactttgtacaagaaagctgggtttttgatggtaacagtcg

SEQ ID NO: 11974 - DNA, 46 bp, Artificial Sequence
  Amplification primer (reverse)
ggggaccactttgtacaagaaagctgggttagaaaggcgctcttct

SEQ ID NO: 11975 - DNA, 49 bp, Artificial Sequence
  Amplification primer (reverse)
ggggaccactttgtacaagaaagctgggtttatctttaataaagcccta

SEQ ID NO: 11976 - DNA, 47 bp, Artificial Sequence
  Amplification primer (reverse)
ggggaccactttgtacaagaaagctgggttcatcccataaatttgtt

SEQ ID NO: 11977 - DNA, 48 bp, Artificial Sequence
  Amplification primer (reverse)
ggggaccactttgtacaagaaagctgggttcaagacatttcttaaagc

SEQ ID NO: 11978 - DNA, 46 bp, Artificial Sequence
  Amplification primer (reverse)
ggggaccactttgtacaagaaagctgggttttttgttttagcgatg

SEQ ID NO: 11979 - DNA, 46 bp, Artificial Sequence
  Amplification primer (reverse)
ggggaccactttgtacaagaaagctgggttttttaaaccatgctgt

SEQ ID NO: 11980 - DNA, 48 bp, Artificial Sequence
  Amplification primer (reverse)
ggggaccactttgtacaagaaagctgggtttttgtaaagaccttcttt

SEQ ID NO: 11981 - DNA, 48 bp, Artificial Sequence
  Amplification primer (reverse)
ggggaccactttgtacaagaaagctgggttttcctcgtttattaattt

SEQ ID NO: 11982 - DNA, 46 bp, Artificial Sequence
  Amplification primer (reverse)
ggggaccactttgtacaagaaagctgggttaaagaaaagatgtgcc

SEQ ID NO: 11983 - DNA, 46 bp, Artificial Sequence
  Amplification primer (reverse)
ggggaccactttgtacaagaaagctgggttctgtgcaggctcaaat

SEQ ID NO: 11984 - DNA, 49 bp, Artificial Sequence
  Amplification primer (reverse)
ggggaccactttgtacaagaaagctgggttaattgtccagtctaagtta

SEQ ID NO: 11985 - DNA, 50 bp, Artificial Sequence
  Amplification primer (reverse)
ggggaccactttgtacaagaaagctgggttatttagtgttatttctcctg

SEQ ID NO: 11986 - DNA, 49 bp, Artificial Sequence
  Amplification primer (reverse)
ggggaccactttgtacaagaaagctgggttttttttaagtgatgatgaa

SEQ ID NO: 11987 - DNA, 47 bp, Artificial Sequence; identical to SEQ ID NO: 11801
  Amplification primer (reverse)

SEQ ID NO: 11988 - DNA, 47 bp, Artificial Sequence
  Amplification primer (reverse)
ggggaccactttgtacaagaaagctgggttttttggggttactttac

SEQ ID NO: 11989 - DNA, 48 bp, Artificial Sequence
  Amplification primer (reverse)
ggggaccactttgtacaagaaagctgggttttttgctgaaataatgtt

SEQ ID NO: 11990 - DNA, 46 bp, Artificial Sequence
  Amplification primer (reverse)
ggggaccactttgtacaagaaagctgggttatcatacgaatgcaac

SEQ ID NO: 11991 - DNA, 49 bp, Artificial Sequence
  Amplification primer (reverse)
ggggaccactttgtacaagaaagctgggtttttttcatattttttcaaa

SEQ ID NO: 11992 - DNA, 50 bp, Artificial Sequence
  Amplification primer (reverse)
ggggaccactttgtacaagaaagctgggttattatttttataagcatgtg

SEQ ID NO: 11993 - DNA, 48 bp, Artificial Sequence; identical to SEQ ID NO: 11799
  Amplification primer (reverse)

SEQ ID NO: 11994 - DNA, 48 bp, Artificial Sequence
  Amplification primer (reverse)
ggggaccactttgtacaagaaagctgggttgataagcactttccttaa

SEQ ID NO: 11995 - DNA, 46 bp, Artificial Sequence
  Amplification primer (reverse)
ggggaccactttgtacaagaaagctgggttgcctaaaaaccaatca

SEQ ID NO: 11996 - DNA, 46 bp, Artificial Sequence; identical to SEQ ID NO: 11640
  Amplification primer (reverse)

SEQ ID NO: 11997 - DNA, 48 bp, Artificial Sequence; identical to SEQ ID NO: 11802
  Amplification primer (reverse)

SEQ ID NO: 11998 - DNA, 50 bp, Artificial Sequence; identical to SEQ ID NO: 11650
  Amplification primer (reverse)

SEQ ID NO: 11999 - DNA, 47 bp, Artificial Sequence
  Amplification primer (reverse)
ggggaccactttgtacaagaaagctgggttggctttaaagttcgata

SEQ ID NO: 12000 - DNA, 49 bp, Artificial Sequence; identical to SEQ ID NO: 11548
  Amplification primer (reverse)

SEQ ID NO: 12001 - DNA, 47 bp, Artificial Sequence
  Amplification primer (reverse)
ggggaccactttgtacaagaaagctgggttatgtttatggcttgctt

SEQ ID NO: 12002 - DNA, 48 bp, Artificial Sequence; identical to SEQ ID NO: 11802
  Amplification primer (reverse)

SEQ ID NO: 12003 - DNA, 49 bp, Artificial Sequence
  Amplification primer (reverse)
ggggaccactttgtacaagaaagctgggttgagttgtctttttttgtct

SEQ ID NO: 12004 - DNA, 46 bp, Artificial Sequence
  Amplification primer (reverse)
ggggaccactttgtacaagaaagctgggttttcaacttgattgcca

SEQ ID NO: 12005 - DNA, 45 bp, Artificial Sequence
  Amplification primer (reverse)
ggggaccactttgtacaagaaagctgggttttttgcaatttttgc

SEQ ID NO: 12006 - DNA, 47 bp, Artificial Sequence
  Amplification primer (reverse)
ggggaccactttgtacaagaaagctgggttttttaatgctgtttgaa

SEQ ID NO: 12007 - DNA, 47 bp, Artificial Sequence
  Amplification primer (reverse)
ggggaccactttgtacaagaaagctgggttttttttagctaaggctg

SEQ ID NO: 12008 - DNA, 47 bp, Artificial Sequence
  Amplification primer (reverse)
ggggaccactttgtacaagaaagctgggttttttgctaaaccttctg

SEQ ID NO: 12009 - DNA, 49 bp, Artificial Sequence
  Amplification primer (reverse)
ggggaccactttgtacaagaaagctgggttattcatattaacacgatgc

SEQ ID NO: 12010 - DNA, 46 bp, Artificial Sequence
  Amplification primer (reverse)
ggggaccactttgtacaagaaagctgggtttttgcgttttggaggg

SEQ ID NO: 12011 - DNA, 46 bp, Artificial Sequence
  Amplification primer (reverse)
ggggaccactttgtacaagaaagctgggtttgcaccttgatggcga

SEQ ID NO: 12012 - DNA, 48 bp, Artificial Sequence
  Amplification primer (reverse)
ggggaccactttgtacaagaaagctgggttccataatatttgatgctg

SEQ ID NO: 12013 - DNA, 48 bp, Artificial Sequence
  Amplification primer (reverse)
ggggaccactttgtacaagaaagctgggttttctaatcctacagcatg

SEQ ID NO: 12014 - DNA, 50 bp, Artificial Sequence
  Amplification primer (reverse)
ggggaccactttgtacaagaaagctgggttaaaaattcctcctaaattaa

SEQ ID NO: 12015 - DNA, 53 bp, Artificial Sequence
  Amplification primer (reverse)
ggggaccactttgtacaagaaagctgggttaaagttttgactattactgatag

SEQ ID NO: 12016 - DNA, 47 bp, Artificial Sequence
  Amplification primer (reverse)
ggggaccactttgtacaagaaagctgggtttgggggagatagttatg

SEQ ID NO: 12017 - DNA, 48 bp, Artificial Sequence
  Amplification primer (reverse)
ggggaccactttgtacaagaaagctgggttttgacagaaagctaattg

SEQ ID NO: 12018 - DNA, 7361 bp, Streptococcus agalactiae
ctttgatacaatattatcaaaattatattaacggtaaagatattgttaaagaccaaacttggattatcaatcgttatcaagaaattattagtgatttgtctttaggaagcactattgcagaagaaattactcgctctatagagcagctagcttcacttcccatagaaaataatcagtttttatatgattgttttttagcagccggtgaagataacaacgcaaagttagttgcaacgttttttaatcaaaatgacattcctgcaagatatgttcatccaaacgaagcaggaattattgtaactaaagaaccatgtaatgcacgaattattccaggaagttatgataagattgagaacttatgtctatacaatgaggttcttgttatccctggattttttggagtcacagaagataaccaaatttgtaccttttcaagagggggatctgacattactggatccctaattgcagcaggcataaaagcagacctttatgagaacttcacagatgttgatggtatatttgcagcacatccaggtgtagttaagaaccctcacgctatccctgagcttacttataaagaaatgcgtgaattagcctatgcgggtttttcggttttacatgatgaagctttacttcctgcctatcgtggcagaatccctcttgttattaaaaatacaaataatccccaacagcctggtacaaaaatagttttaaagcatactcgtagtaacatagcagtaactgggatcgcttctgatagccgttttgctagcataaacgtatctaaatacttaatgaatagagaagtaggtttcggccgaaaagtactacaaattttagaggatttaaatattagttttgaacatatgccaactggcatagatgatctatccattgtcttacgtgaaaaagaattgacaccaatcaaagaacaagaaatcttaaattacctaactcgtaaactagaagtagattacgttgacatccaacacaatctatctacaatcgtaattgtaggtgaaaatatgaaaagtcagattggagtcactgcaacagcgacacaagccttatcaagagaaaaaatcaatatcaccatgatatcacaaggttcaagcgaagtctccattatgttcgttataaacagtaaggatgaaaaaagagctattaaagcactatatgaaacattcttccaaaaatagtacctattacactacttacactattagatagataacaaatcgtcctaagtaagcttacttaggacgattttatttagaacataggatagtttttccacttttaatcgtaaccacttggtatcagtgacaaattcggacaattaagatgttagccaatcttaaggataataattccaataaaaaaaggctaaccaaagttagtctccctttatctactccgccagtaggactcgaacctacgacatcatgattaacagtcatgcgctactaccaactgagctatggcggattatagctaagcgactaccttatctcacagggggcaacccccaactacttccggcgttctagggcttaacttctgtgttcggcatgagaacaggtgtatctcctaggcaattatcacttaactattgagccttattcactcaaaattgaatatctatagtctaacaagaaaccgtaacgttgtcaatatctctttttggataagtcctcgagctattagtattagtccgctaaatgtgtcaccacaattacactcctaacctatctacctgatcatctctcagggctcttactgatataaaatcatgggaaatctcatcttgaggtgggcttcgcacttagatgctttcagcgcttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctacgactgatttccaaccagtctgagggaacctttgggcgcctccgttaccttttaggaggcgaccgccccagtcaaactgcccgtcagacactgtctccgatagggattgcctatctgggttagagtagccataacacaagggtagtatcccaacaacgcctcaaacgaaactggcgtcccgttatcataggctcctacctatcctgtacatgtggtacagatactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgatctaaaatcagcgccccttctcccgaagttacggggccattttgccgagttccttaacgagagttctctcgctcacctgaggctactcgcctcgactacctgtgtcggtttgcggtacgggtagagtatatgtatcgctagaagcttttcttggcagtgtgacatcactaacttcgctactaaacttcgctcctcgtcacagctcaatgttaaagatataagcatttgactcatatcacacctcactgtttgaccagacacttccaatcgtctggtttagttagcctactgcgtccctccatcactatatactctagtacaggaatatcaacctgttgtccatcggatacacctttcggtctctccttaggtcccgactaacccagggcggacgagccttcccctggaaaccttagtcttacggtggacaggattctcacctgtcttgcgctactcataccggcattctcacttctatgcgttccagcgctcctcacggtacaccttcttcacacatagaacgctctcctaccatgacacttttgtgtcatccacagcttcggtaatatgttttagccccggtacattttcggcgcagggtcactcgactagtgagctattacgcactctttgaatgaatagctgcttctaagctaacatcctagttgtctgtgcaaccccacatccttttccacttaacatatattttgggaccttagctggtggtctgggctgtttccctttcgactacggatcttagcactcgcagtctgactgccgattatatctcgttggcattcggagtttatctgagattggtaatccgggatggacccctcacccaaacagtgctctacctccaagagacttaacatcgacgctagccctaaagctatttcggagagaaccagctatctccaagttcgtttggaatttctccgctacccacaagtcatccaagcacttttcaacgtgccctggttcggtcctccagtgagttttacctcaccttcaacctgctcatgggtaggtcacatggtttcgggtctacaacatgatactatgacgccctattaagactcggtttccctacggctccgtctcttcaacttaacctcgcatcatatcgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagagagtatttagggttgggagatggtcctcccagattccgacgagatttcgcgtgtctcgccgtactcaggatactgctaaggttaatctatcattttaaatacgaggctgttactctctttggcttaccttcccaggtaattcttctataatgattaatcctatatcgcagtcctacaaccccgaagtgtaaacacttcggtttgccctcctgccgtttcgctcgccgctactaaggcaatcgcttttgctttctcttcctgcagctacttagatgtttcagttcactgcgtcttccttctcatatccttaacagatatggatactagtcattaactagtgggttcccccattcggacatctctggatcagcgcttacttacagctccccaaagcatttcgtcgttagtcacgtccttcttcggcttctagtgccaaggcatccaccgtgcgcccttattaacttaaccttattaacctagtttctttaaaactagaaaactcattaaatattcacagcgttttcggtttattttcttgttactttctacaatctatttctagatcgtggaatttgatatagatattcaattttcaatgaacaatttgaacctttcgattcaatggagcctagcgggatcgaaccgctgacctcctgcgtgcaaagcaggcgctctcccagctgagctaaggccccacaagacctctcaaaactaaacaagacgcaaatggcaggtttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagattggctttaagagattagcttgccgtcaccggcttgcgactcgttgtaccaaccattgtagcacgtgtgtagcccaggtcataaggggcatgatgatttgacgtcatccccaccttcctccggtttattaccggcagtctcgctagagtgcccaacttaatgatggcaactaacaataggggttgcgctcgttgcgggacttaacccaacatctcacgacacgagctgacgacaaccatgcaccacctgtcacttctgctccgaagagaaagcctatctctaggccggtcagaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaagccccggaaagggcctaacacctagcactcatcgtttacggcgtggactaccagggtatctaatcctgtttgctccccacgctttcgagcctcagcgtcagttacagaccagagagccgctttcgccaccggtgttcctccatatatctacgcatttcaccgctacacatggaattccactctccccttctgcactcaagtcctccagtttccaaagcgtacaatggttaagccactgcctttaacttcagacttaaagaaccgcctgcgctcgctttacgcccaataaatccggacaacgctcgggacctacgtattaccgcggctgctggcacgtagttagccgtccctttctggttagttaccgtcacttggtagattttccactcctaccaacgttcttctctaacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagcctttacctcaccaactagctaatacaacgcaggtccatctcacagtgaagcaattgctccttttaaataactaacatgtgttaattactcttatgcggtattagctatcgtttccaatagttatcccccgctatgaggcaggttacctacgcgttactcacccgttcgcaactcatcagtctagtgtaaacaccaaacctcagcgttctacttgcatgtattaggcacgccgccagcgttcgtcctgagccaggatcaaactctcattaaaagtttgagctttgctcttttctgtctcgctgacagatttattgttttttgtcattgacggatttacaatgtaaatccaccctgcacattcgttcatcttgttcagttttcaaaggtctttgcctctcttgagacaacttctatattctagcaaacttattctgctttgtcaactactttttttaagttgtttataaaatgataatacaatattaggttcgcttaagaactcatttagtatactataattttttatttgttgtcaataggttttaaaaaaatctcagagaaaaccctgagattttttaaattatgttacaaagttaatttcctttagcttcaattaaacctagttcgccatcttcacgcttgtaaaggacatttgtcgtattatcttctgcatctgtatagataaagaaatcatgacctaaaagttccatttgcaacaatgcttcctcaacatccattggttttagattaacattcttagtacgtacaattctttggcttactgcttcttcatctggctcagcctcaaattctgttgtgaaaacttgacttgctggaatcttttcacgatattttttcgcaattttagttttatttttacgaatttgacgctcaattttatcaacaactaagtcaattgacccatacatatcttgtgaaacatcttctgctcgtaaagtaatagaatctattaagattgttacttcaacttttgcggtcttctctctgtatactttgaggttgactctagtatctaattcttgtgcttcattaaagtatttttcaactttagagagtttggtctcaacatactcacgaatagcttctgttacttcgatgttttcaccacgaatactgtatttaatcatatgagtacctctttcttgcgttgttaacgctttctatactcttattataaccgctttcatgaaaa

SEQ ID NO: 12019 - DNA, 8172 bp, Streptococcus agalactiae
tccaatcatacttaatttcactaatatctggattttgacatattcagttaattctttttcatgctttttgagataagctacttgttctttttttattacttttttacctttctttactgctgactgtttgctattttttacttcgtttgactgacttttagattcactattcatttgacagcctgctagtaacatcccaataatagatatgggaattaaccattttacatattttttcaacatgctctcttttcttagaaaataaacttcccatgtcaagtatctaataaaaataattattatttaccagtatgttaaaactaatattagtataacaaattttcacgagtttaattttttagtcgtaacatatacactgaaaaatcttattattttatactacctatctatcattcacaaacacttttattacttcagaacctatgacatttaggagtcctctttgaatttcatttaaatgttgagtctccactaactcttgaaaaatttccttattatttctgcttgttttaaaccttctataacgattgcaataatgaaaaacaaatataagtaattttcagtaactttttctcaaaattaccagcacaatacaaaaaagacaaggcttctaaaccttgtctttataaatataccggcggccggggtcgaaccggcacgtccgtgaggacactggattttgagtccagcgcgtctgccaattccgccacgccggctatcttaaaactggggtagctggattcgaaccaacgcatgagggagtcaaagtcccttgccttaccgcttggctataccccatgaaaaggcgagtgatgggaatcgaacccacgaatgtcagagccacaatctgatgtgttaaccacttcaccacacccgccatattagaaaaaacacgggcagtaggaatcgaacccacactgaaggttttggagaccttagttctacctttaaactatgcccgtttactatggagagagagggattcgaacccccgaacccgaaggagcggatttacagtccgccgcgtttagcctcttcgctatctctcctaaggtataaatggcgcgagacggaatcgaaccgccgacacatggagcttcaatccattgctctaccaactgagctaccgagcctattgcgggagcaggatttgaacctacgaccttcgggttatgagcccgacgagctacctagctgctccatcccgcgatatctttaaaggaggatgtgggattcgaacccacgcacgcttttacacgcctgacggttttcaagaccgttcccttcagccggacttgggtaatcctccatataacaaaaaatagtccgtacgggattcgaacccgtgttaccgccgtgaaaaggcggtgtcttaaccccttgaccaacggaccatattcttgatgggcacgagtggactcgaaccaccgacctcacgcttatcaggcgtgcgctctaaccacctgagctacgcgcccaaaataacttctaaaattataaagttaatgccggctacatgacttgaacacgcgaccctctgattacaaatcagatgctctaccaactgagctaagccggcaatctactaatgcgggtgaagggacttgaacccccacgccgttaagcgccagatcctaaatctggtgcgtctgccaattccgccacacccgcatttctaaatgacccgtactgggctcgaaccagtgacccattgattaaaagtcaattgctctaccaactgagctaacgagtctacggtcccgacgggaatcgaacccgcgatcttcgccgtgacagggcgacgtgataaccgctacactacgggacctatgggagttaacgggatcgaaccgctgaccctctgcttgtaaggcagatgctctcccagctgagctaaactccctttgctaagcgactaccttatctcacagggggcaacccccaactacttccggcgttctagggcttaacttctgtgttcggcatgagaacaggtgtatctcctaggcaattatcacttaactattgagccttattcactcaaaattgaatatctatagtctaacaagaaaccgtaacgttgtcaatatctctttttggataagtcctcgagctattagtattagtccgctaaatgtgtcaccacaattacactcctaacctatctacctgatcatctctcagggctcttactgatataaaatcatgggaaatctcatcttgaggtgggcttcgcacttagatgctttcagcgcttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctacgactgatttccaaccagtctgagggaacctttgggcgcctccgttaccttttaggaggcgaccgccccagtcaaactgcccgtcagacactgtctccgatagggattgcctatctgggttagagtagccataacacaagggtagtatcccaacaacgcctcaaacgaaactggcgtcccgttatcataggctcctacctatcctgtacatgtggtacagatactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgatctaaaatcagcgccccttctcccgaagttacggggccattttgccgagttccttaacgagagttctctcgctcacctgaggctactcgcctcgactacctgtgtcggtttgcggtacgggtagagtatatgtatcgctagaagcttttcttggcagtgtgacatcactaacttcgctactaaacttcgctcctcgtcacagctcaatgttaaagatataagcatttgactcatatcacacctcactgtttgaccagacacttccaatcgtctggtttagttagcctactgcgtccctccatcactatatactctagtacaggaatatcaacctgttgtccatcggatacacctttcggtctctccttaggtcccgactaacccagggcggacgagccttcccctggaaaccttagtcttacggtggacaggattctcacctgtcttgcgctactcataccggcattctcacttctatgcgttccagcgctcctcacggtacaccttcttcacacatagaacgctctcctaccatgacacttttgtgtcatccacagcttcggtaatatgttttagccccggtacattttcggcgcagggtcactcgactagtgagctattacgcactctttgaatgaatagctgcttctaagctaacatcctagttgtctgtgcaaccccacatccttttccacttaacatatattttgggaccttagctggtggtctgggctgtttccctttcgactacggatcttagcactcgcagtctgactgccgattatatctcgttggcattcggagtttatctgagattggtaatccgggatggacccctcacccaaacagtgctctacctccaagagacttaacatcgacgctagccctaaagctatttcggagagaaccagctatctccaagttcgtttggaatttctccgctacccacaagtcatccaagcacttttcaacgtgccctggttcggtcctccagtgagttttacctcaccttcaacctgctcatgggtaggtcacatggtttcgggtctacaacatgatactatgacgccctattaagactcggtttccctacggctccgtctcttcaacttaacctcgcatcatatcgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagagagtatttagggttgggagatggtcctcccagattccgacgagatttcgcgtgtctcgccgtactcaggatactgctaaggttaatctatcattttaaatacgaggctgttactctctttggcttaccttcccaggtaattcttctataatgattaatcctatatcgcagtcctacaaccccgaagtgtaaacacttcggtttgccctcctgccgtttcgctcgccgctactaaggcaatcgcttttgctttctcttcctgcagctacttagatgtttcagttcactgcgtcttccttctcatatccttaacagatatggatactagtcattaactagtgggttcccccattcggacatctctggatcagcgcttacttacagctccccaaagcatttcgtcgttagtcacgtccttcttcggcttctagtgccaaggcatccaccgtgcgcccttattaacttaaccttattaacctagtttctttaaaactagaaaactcattaaatattcacagcgttttcggtttattttcttgttactttctacaatctatttctagatcgtggaatttgatatagatattcaattttcaatgaacaatttgaacctttcgattcaatggagcctagcgggatcgaaccgctgacctcctgcgtgcaaagcaggcgctctcccagctgagctaaggccccacaagacctctcaaaactaaacaagacgcaaatggcaggtttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagattggctttaagagattagcttgccgtcaccggcttgcgactcgttgtaccaaccattgtagcacgtgtgtagcccaggtcataaggggcatgatgatttgacgtcatccccaccttcctccggtttattaccggcagtctcgctagagtgcccaacttaatgatggcaactaacaataggggttgcgctcgttgcgggacttaacccaacatctcacgacacgagctgacgacaaccatgcaccacctgtcacttctgctccgaagagaaagcctatctctaggccggtcagaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaagccccggaaagggcctaacacctagcactcatcgtttacggcgtggactaccagggtatctaatcctgtttgctccccacgctttcgagcctcagcgtcagttacagaccagagagccgctttcgccaccggtgttcctccatatatctacgcatttcaccgctacacatggaattccactctccccttctgcactcaagtcctccagtttccaaagcgtacaatggttaagccactgcctttaacttcagacttaaagaaccgcctgcgctcgctttacgcccaataaatccggacaacgctcgggacctacgtattaccgcggctgctggcacgtagttagccgtccctttctggttagttaccgtcacttggtagattttccactcctaccaacgttcttctctaacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagcctttacctcaccaactagctaatacaacgcaggtccatctcacagtgaagcaattgctccttttaaataactaacatgtgttaattactcttatgcggtattagctatcgtttccaatagttatcccccgctatgaggcaggttacctacgcgttactcacccgttcgcaactcatcagtctagtgtaaacaccaaacctcagcgttctacttgcatgtattaggcacgccgccagcgttcgtcctgagccaggatcaaactctcattaaaagtttgagctttgctcttttctgtctcgctgacagatttattgttttttgtcattgacggatttacaatgtaaatccaccctgcacattcgttcgtcttgttcagttttcaaaggtctttgcctctcttgagacaacttctatattctagcaaacttattctgctttgtcaactactttttttaagttgttaactacgcgctaatagaaactgctctctcgagacaacttattcattatactaaatatttctacttcctgtcaatactatttttgtattttataaatttagtatagacataactattcctctatattcaattaagagaaattatataaccactattgagaaatgtagtctagcgattaaattctttgctcatcgaaaatatccaataaatataataatgcataaaacgcctgcttacgaaatataaacaaaattgtttgcatttcgtaaacaagcgttacctatttaacaatatatgatgagtgttcccgctgagaataattctcagcggtagaccagagctagactaagaatcgattgattccatcatcataacactcaacaaaattgataaaaattatactaattcaataattgccattggggcagcatcgccacggcgtggttctgttttaagaatacgagtgtatcctccgttacgttcagcataacgaggtgcgatgtcgtcaaaaagtttttgaagagctgttgttgatgtatatttatcagaagcttcatcatagttttctgatgcaatttcattacgtacataagcagcagcttgacgacgagcatgtaaatcaccacgtttacctagagtaatcattttttcaactgttttacggatttctttagcacgtgcttcagtagttacaattgattcgttgataagaagatcggttgtcaaatcacgaagcattgccttacgttgtgagctagtgcgtcctagtttacggtaagccattatgtcctcctattttatttatcgttttttaatccaagacctagatcggcaagtttgattttaacttcttcaagactcttacgtcctaagtttcggactttcatcatttcaggctcagttttttctgttaaatcaaatactgtattaattccagcacgttttaaacagttatatgagcgcactgacaaatcaagttcctcaattgtccggtcaagcactttctcatcgttcactttctctgtttccttcattacttcagttgctttagcaacctctgttaaatcagtaaacaagtttaagtgttcaattaagacgcgagctgaaagaccaagagcatcctcaggaatga

SEQ ID NO: 12020 - DNA, 7267 bp, Streptococcus agalactiae
atcaaaaaaacatgaccagtatgaattaaagcaacgtataatcaatgccttaatgcgtaaaggataccagtacgaagatatcaaaagtgctttaagagaatatttataagataataactctcagacgatgtattttacagaaaattatgataaactataacagacgtataaattgtagaaagttggtaggctatgagattacctaaagaaggcgactttattacaattcaaagttacaaacatgatggtagtttacaccgaacttggcgtgacaccatggtattaaaaacaaccgaaaatgccctcattggtgttaatgatcatactttagtaacagaaaatgatggtcgacgctgggtgacacgagagcctgcaatagtatactttcataaaaaatactggtttaacattatcgctatgatacgtgaaactggtgtctcctactattgtaatctagcaagtccgtatatcttggaccctgaagcactcaagtatattgactatgaccttgatgtcaaagtatttgcagatggtgaaaaaagactactagatgtggacgaatatgaacagcataaagytcagatgaactatcctaccgatattgattatatattaaaggaaaatgtaaaaatattggtagaatggataaatgagaataaaggccccttttcatcatcatatatcaatatctggtataaacggtaccttgaattgaaaaagcgctaactaacacactaaatagtgtgtttttattaatatcaaatttaattacaatactattgcaaaaatatatacttaaaataaaaaaagtagaaagatcactttctacttttttaagaatagtccgtacgggattcgaacccgtgttaccgccgtgaaaaggcggtgtcttaaccccttgaccaacggaccatattcttgatgggcacgagtggactcgaaccaccgacctcacgcttatcaggcgtgcgctctaaccacctgagctacgcgcccaagctattgcttggtttttactttcttataaagtaaagcgggtgacgagaatcgaactcgcgacaacagcttggaaggctgtagttttaccactaaactacacccgcttctatgggagttaacgggatcgaaccgctgaccctctgcttgtaaggcagatgctctcccagctgagctaaactccctttgctaagcgactaccttatctcacagggggcaacccccaactacttccggcgttctagggcttaacttctgtgttcggcatgagaacaggtgtatctcctaggcaattatcacttaactattgagccttattcactcaaaattgaatatctatagtctaacaagaaaccgtaacgttgtcaatatctctttttggataagtcctcgagctattagtattagtccgctaaatgtgtcaccacaattacactcctaacctatctacctgatcatctctcagggctcttactgatataaaatcatgggaaatctcatcttgaggtgggcttcgcacttagatgctttcagcgcttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctacgactgatttccaaccagtctgagggaacctttgggcgcctccgttaccttttaggaggcgaccgccccagtcaaactgcccgtcagacactgtctccgatagggattgcctatctgggttagagtagccataacacaagggtagtatcccaacaacgcctcaaacgaaactggcgtcccgttatcataggctcctacctatcctgtacatgtggtacagatactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgatctaaaatcagcgccccttctcccgaagttacggggccattttgccgagttccttaacgagagttctctcgctcacctgaggctactcgcctcgactacctgtgtcggtttgcggtacgggtagagtatatgtatcgctagaagcttttcttggcagtgtgacatcactaacttcgctactaaacttcgctcctcgtcacagctcaatgttaaagatataagcatttgactcatatcacacctcactgtttgaccagacacttccaatcgtctggtttagttagcctactgcgtccctccatcactatatactctagtacaggaatatcaacctgttgtccatcggatacacctttcggtctctccttaggtcccgactaacccagggcggacgagccttcccctggaaaccttagtcttacggtggacaggattctcacctgtcttgcgctactcataccggcattctcacttctatgcgttccagcgctcctcacggtacaccttcttcacacatagaacgctctcctaccatgacacttttgtgtcatccacagcttcggtaatatgttttagccccggtacattttcggcgcagggtcactcgactagtgagctattacgcactctttgaatgaatagctgcttctaagctaacatcctagttgtctgtgcaaccccacatccttttccacttaacatatattttgggaccttagctggtggtctgggctgtttccctttcgactacggatcttagcactcgcagtctgactgccgattatatctcgttggcattcggagtttatctgagattggtaatccgggatggacccctcacccaaacagtgctctacctccaagagacttaacatcgacgctagccctaaagctatttcggagagaaccagctatctccaagttcgtttggaatttctccgctacccacaagtcatccaagcacttttcaacgtgccctggttcggtcctccagtgagttttacctcaccttcaacctgctcatgggtaggtcacatggtttcgggtctacaacatgatactatgacgccctattaagactcggtttccctacggctccgtctcttcaacttaacctcgcatcatatcgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagagagtatttagggttgggagatggtcctcccagattccgacgagatttcgcgtgtctcgccgtactcaggatactgctaaggttaatctatcattttaaatacgaggctgttactctctttggcttaccttcccaggtaattcttctataatgattaatcctatatcgcagtcctacaaccccgaagtgtaaacacttcggtttgccctcctgccgtttcgctcgccgctactaaggcaatcgcttttgctttctcttcctgcagctacttagatgtttcagttcactgcgtcttccttctcatatccttaacagatatggatactagtcattaactagtgggttcccccattcggacatctctggatcagcgcttacttacagctccccaaagcatttcgtcgttagtcacgtccttcttcggcttctagtgccaaggcatccaccgtgcgcccttattaacttaaccttattaacctagtttctttaaaactagaaaactcattaaatattcacagcgttttcggtttattttcttgttactttctacaatctatttctagatcgtggaatttgatatagatattcaattttcaatgaacaatttgaacctttcgattcaatggagcctagcgggatcgaaccgctgacctcctgcgtgcaaagcaggcgctctcccagctgagctaaggccccacaagacctctcaaaactaaacaagacgcaaatggcaggtttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagattggctttaagagattagcttgccgtcaccggcttgcgactcgttgtaccaaccattgtagcacgtgtgtagcccaggtcataaggggcatgatgatttgacgtcatccccaccttcctccggtttattaccggcagtctcgctagagtgcccaacttaatgatggcaactaacaataggggttgcgctcgttgcgggacttaacccaacatctcacgacacgagctgacgacaaccatgcaccacctgtcacttctgctccgaagagaaagcctatctctaggccggtcagaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaagccccggaaagggcctaacacctagcactcatcgtttacggcgtggactaccagggtatctaatcctgtttgctccccacgctttcgagcctcagcgtcagttacagaccagagagccgctttcgccaccggtgttcctccatatatctacgcatttcaccgctacacatggaattccactctccccttctgcactcaagtcctccagtttccaaagcgtacaatggttaagccactgcctttaacttcagacttaaagaaccgcctgcgctcgctttacgcccaataaatccggacaacgctcgggacctacgtattaccgcggctgctggcacgtagttagccgtccctttctggttagttaccgtcacttggtagattttccactcctaccaacgttcttctctaacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagcctttacctcaccaactagctaatacaacgcaggtccatctcacagtgaagcaattgctccttttaaataactaacatgtgttaattactcttatgcggtattagctatcgtttccaatagttatcccccgctatgaggcaggttacctacgcgttactcacccgttcgcaactcatcagtctagtgtaaacaccaaacctcagcgttctacttgcatgtattaggcacgccgccagcgttcgtcctgagccaggatcaaactctcattaaaagtttgagctttgctcttttctgtctcgctgacagatttattgtttttttgtcattgacggatttacaatgtaaatccaccctgcacattcgttcgtcttgttcagttttcaaaggtctttgcctctcttgagacaacttctatattctagcaaacttattctgctttgtcaactactttttttaagttgttaactacgcgctaatagaaactgctctctcgagacaacttatttagtttactacatcatctcttactttgtcaactcttttttcatactttttctacattttctgaaaatgtagatagagcgcaagaaaaaaagaggtctcacctctttttatttcttagtaactactacaaatctattaggatcgttaccttcagaataactttcaacaccctctatagttgcaattgttttatgaacagtttttcgctcactgttactcataggatccatatggtaaggttcattagtctctaaaacacgcctagctatttttttagaaaaatcaattaaagtttctgtacgatgctcaacgtagtcatggacattaatggatactgaaaaactcttagaaaagcggtcatgaagataattttgtgctaacaactgcaacgattttaatacttttccatgataaccaatgatgcgcccagcttctggcgtttctatttggagatttatttgtcgcttacttgtcgtagtttctattgttgcatctaaatccatctcatagatgatattttcaacgtatttagtcacctgagcagctgctacttcaatattaggaagtaggtcaattttttcaatagcttcacttgtagttacaacgtttttatcatcaatttttggaagttctggttgtgatacgtcttctttttcaagcgtttcatcaacctcctctatatattcttccaccacatctacgctagacggtacattcttaatattttttaacgctaccgattcattaatatcagttacttcgtcggtgataccttctatttcaacttttgctggctttttaccaaagcccaaaaaaccttttttctcacgtgatacaacttttatatgtgccctcaatcgtgaaatgtttaactcttgtagtcctttttcaatagcttcttctacagtcgctcctgtaaataatacc

SEQ ID NO: 12021 - DNA, 8766 bp, Streptococcus agalactiae
agtacccgtatatttactaggaacaatgacatttactttcccgaattggtctttctatggcttttcacgattaagcatactaactatatcaaagggattgacatagtaggtaacatgcttcccagcttcttggatttttttagcagaaatgccttccattttttccaagcttcttgatacatcagggccatcgaaaaggactacttgaccaacattctccaattctgcatagctaagattaacaactgcttgagaagatacaatcgtaccgagtgagtgaccagtaacatctataatagctccaggcgcttttccttttagctcggcaattttttctttcatagccttattagccaatttcgcttgtggaatatacttgttagagacagcaaacattgcattgttactaacccaatcgtttagtgtatctagaccaatcccatcactaccacgaatggctagataagtgtgctttgtagtgctatctattttttcagtatctgacaggtagtaagcattaaaacctgccttatcgtcagtaagcacacctttttgataagaatgagtaacataatgctcagtgtgatagcctccattgacatctggaatgaggacctttacattttcatcaatagattttaaggacttatctggttgcaggtagacaataccatcattggggaggttagtgccaccctgtgtgatttgacctttgttatcttctgagggttgagaaaattttacttctgttactgagtcagtctcaaataattcaggaaatgaattaggtcgactattatatgcactttctgctaaagagctatgtaagttatcaaaattatctaagttccaattactcaattattcttctcctctaccttgcttgtggtaaaaattctattactttatataggatgattcaagctattcataaatgtgccaaataccatttttatgtatatacggcttatttagcattcccattgatttgatatttgggatatcatttttatgagctaaataaaaatcaactattaattttgaattttgtagatgattaaactttcctctcagtgaaagattataatcacccccttgtggagttccattcccgctttgttctacttttacacttgaccaatcgaattgaacggactcaatttggttgttatgtaattttacataatctatgatttcttgctcatgctctttgagataggctaattgttctttttttgtcatttttttatctttcttcacttctgattgcttgctattttttacttcgtttgactgaattttatgttcactattcatttgacagcctccaagtatcatcccaaaaattgatatgggaattaaccattttatatattttctcatcatgttctcttttcttagaatataaattttatatatcaagtatataatgaaattaactattattcaccaacattataaaattaattttagtataacaaaattttcacgtatttttatagttttagtcttaacatgtaaacagaaaatcatttgtatattttaaatgccctaattaaattaataattaatatttattattatataaattcttctacaatgaaaaaaataaatatatattacaagtaacatttcacaataaattatctagtagaaaaaagacaaggtttagaaaccttgtctttataagtataccggcggccggggtcgaaccggcacgtccgtgaggacactggattttgagtccagcgcgtctgccaattccgccacgccggctatcttaaaactggggtagctggattcgaaccaacgcatgagggagtcaaagtcccttgccttaccgcttggctataccccatgaaaaggcgagtgatgggaatcgaacccacgaatgtcagagccacaatctgatgtgttaaccacttcaccacacccgccatattagaaaaaacacgggcagtaggaatcgaacccacactgaaggttttggagaccttagttctacctttaaactatgcccgtttactatggagagagagggattcgaacccccgaacccgaaggagcggatttacagtccgccgcgtttagcctcttcgctatctctcctaaggtataaatggcgcgagacggaatcgaaccgccgacacatggagcttcaatccattgctctaccaactgagctaccgagcctattgcgggagcaggatttgaacctacgaccttcgggttatgagcccgacgagctacctagctgctccatcccgcgatatctttaaaggaggatgtgggattcgaacccacgcacgcttttacacgcctgacggttttcaagaccgttcccttcagccggacttgggtaatcctccatataacaaaaaatagtccgtacgggattcgaacccgtgttaccgccgtgaaaaggcggtgtcttaaccccttgaccaacggaccatattcttgatgggcacgagtggactcgaaccaccgacctcacgcttatcaggcgtgcgctctaaccacctgagctacgcgcccaagctattgcttggtttttactttcttataaagtaaagcgggtgacgagaatcgaactcgcgacaacagcttggaaggctgtagttttaccactaaactacacccgcttctatgggagttaacgggatcgaaccgctgaccctctgcttgtaaggcagatgctctcccagctgagctaaactccctttgctaagcgactaccttatctcacagggggcaacccccaactacttccggcgttctagggcttaacttctgtgttcggcatgagaacaggtgtatctcctaggcaattatcacttaactattgagccttattcactcaaaattgaatatctatagtctaacaagaaaccgtaacgttgtcaatatctctttttggataagtcctcgagctattagtattagtccgctaaatgtgtcaccacaattacactcctaacctatctacctgatcatctctcagggctcttactgatataaaatcatgggaaatctcatcttgaggtgggcttcgcacttagatgctttcagcgcttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctacgactgatttccaaccagtctgagggaacctttgggcgcctccgttaccttttaggaggcgaccgccccagtcaaactgcccgtcagacactgtctccgatagggattgcctatctgggttagagtagccataacacaagggtagtatcccaacaacgcctcaaacgaaactggcgtcccgttatcataggctcctacctatcctgtacatgtggtacagatactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgatctaaaatcagcgccccttctcccgaagttacggggccattttgccgagttccttaacgagagttctctcgctcacctgaggctactcgcctcgactacctgtgtcggtttgcggtacgggtagagtatatgtatcgctagaagcttttcttggcagtgtgacatcactaacttcgctactaaacttcgctcctcgtcacagctcaatgttaaagatataagcatttgactcatatcacacctcactgtttgaccagacacttccaatcgtctggtttagttagcctactgcgtccctccatcactatatactctagtacaggaatatcaacctgttgtccatcggatacacctttcggtctctccttaggtcccgactaacccagggcggacgagccttcccctggaaaccttagtcttacggtggacaggattctcacctgtcttgcgctactcataccggcattctcacttctatgcgttccagcgctcctcacggtacaccttcttcacacatagaacgctctcctaccatgacacttttgtgtcatccacagcttcggtaatatgttttagccccggtacattttcggcgcagggtcactcgactagtgagctattacgcactctttgaatgaatagctgcttctaagctaacatcctagttgtctgtgcaaccccacatccttttccacttaacatatattttgggaccttagctggtggtctgggctgtttccctttcgactacggatcttagcactcgcagtctgactgccgattatatctcgttggcattcggagtttatctgagattggtaatccgggatggacccctcacccaaacagtgctctacctccaagagacttaacatcgacgctagccctaaagctatttcggagagaaccagctatctccaagttcgtttggaatttctccgctacccacaagtcatccaagcacttttcaacgtgccctggttcggtcctccagtgagttttacctcaccttcaacctgctcatgggtaggtcacatggtttcgggtctacaacatgatactatgacgccctattaagactcggtttccctacggctccgtctcttcaacttaacctcgcatcatatcgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagagagtatttagggttgggagatggtcctcccagattccgacgagatttcgcgtgtctcgccgtactcaggatactgctaaggttaatctatcattttaaatacgaggctgttactctctttggcttaccttcccaggtaattcttctataatgattaatcctatatcgcagtcctacaaccccgaagtgtaaacacttcggtttgccctcctgccgtttcgctcgccgctactaaggcaatcgcttttgctttctcttcctgcagctacttagatgtttcagttcactgcgtcttccttctcatatccttaacagatatggatactagtcattaactagtgggttcccccattcggacatctctggatcagcgcttacttacagctccccaaagcatttcgtcgttagtcacgtccttcttcggcttctagtgccaaggcatccaccgtgcgcccttattaacttaaccttattaacctagtttctttaaaactagaaaactcattaaatattcacagcgttttcggtttattttcttgttactttctacaatctatttctagatcgtggaatttgatatagatattcaattttcaatgaacaatttgaacctttcgattcaatggagcctagcgggatcgaaccgctgacctcctgcgtgcaaagcaggcgctctcccagctgagctaaggccccacaagacctctcaaaactaaacaagacgcaaatggcaggtttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagattggctttaagagattagcttgccgtcaccggcttgcgactcgttgtaccaaccattgtagcacgtgtgtagcccaggtcataaggggcatgatgatttgacgtcatccccaccttcctccggtttattaccggcagtctcgctagagtgcccaacttaatgatggcaactaacaataggggttgcgctcgttgcgggacttaacccaacatctcacgacacgagctgacgacaaccatgcaccacctgtcacttctgctccgaagagaaagcctatctctaggccggtcagaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaagccccggaaagggcctaacacctagcactcatcgtttacggcgtggactaccagggtatctaatcctgtttgctccccacgctttcgagcctcagcgtcagttacagaccagagagccgctttcgccaccggtgttcctccatatatctacgcatttcaccgctacacatggaattccactctccccttctgcactcaagtcctccagtttccaaagcgtacaatggttaagccactgcctttaacttcagacttaaagaaccgcctgcgctcgctttacgcccaataaatccggacaacgctcgggacctacgtattaccgcggctgctggcacgtagttagccgtccctttctggttagttaccgtcacttggtagattttccactcctaccaacgttcttctctaacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagcctttacctcaccaactagctaatacaacgcaggtccatctcacagtgaagcaattgctccttttaaataactaacatgtgttaattactcttatgcggtattagctatcgtttccaatagttatcccccgctatgaggcaggttacctacgcgttactcacccgttcgcaactcatcagtctagtgtaaacaccaaacctcagcgttctacttgcatgtattaggcacgccgccagcgttcgtcctgagccaggatcaaactctcattaaaagtttgagctttgctcttttctgtctcgctgacagatttattgtttttttgtcattgacggatttacaatgtaaatccaccctgcacattcgttcgtcttgttcagttttcaaaggtctttgcctctcttgagacaacttctatattctagcaaacttattctgctttgtcaactactttttttaagttgttaactacgcgctaatagaaactgctctctcgagacaacttatttagtttactacatcatctcttactttgtcaactcttttttcatactttttctacattttctgaaaatgtagatcaggctcaagcttaacgattctttttaaaatcattaaattttaaaacaaatttcagacatgttgccaaagttttgatattattactataatatagtttgtagaggagaataatatgggccaagaacctatcatcgaatatcaaaatatcaataaagtgtatggggaaaatgttgcggttgaagacattaaccttaaaatttaccctggtgattttgtttgtttcatcggtacgagtggatcaggtaaaacaacattaatgcgtatggttaaccatatgttaaaaccaacaaatggtactctattatttaagggaaaagatatttctactattaaccccattgaattaagacgcagaattggatatgttatccaaaacattggtttaatgcctcatatgaccatttacgaaaatatagttcttgtaccaaaattattgaaatggtcagaagaagctaaaagagctaaagcaagggaacttattaaattagttgaattacccgaagaatatttggatcgctaccctagtgagttgtctggcggtcagcaacaacgtatcggtgtcattcgcgctcttgcagcagaccaagatattattttaatggatgagccttttggagctctggatcctattactagagaaggtattcaagacttagtcaagtctcttcaggaagaaatggggaaaactatcatcttagttactcatgatatggatgaagccctcaagttagcaacaaaaattattgttatggacaatggtaaaatggtccaagaagggacacccaatgatctcttacatcatcctgcta

SEQ ID NO: 12022 - DNA, 8064 bp, Streptococcus agalactiae
cttctttgttttctttagagatattaactgtacccactttgggcgttaaaatacctaaagtagcctttattaaagttgatttagcagccccattttcacctgttaaggtaacaaactccccactgtctaaatggtaattaaccccttccagcacaggatcgctatcgtactgaaaagtaagaccactaactgtaatatatcgcatgattacccttctaattctctagagaaaagatcaagaaaacgttctaaaacgaccttttcgtcctttgaaaaatgatttactaatcttccgtaaacccctaacgtattgtcatgatgatgtgtgtgttcatctgcaatgggtttagcaagttcagataactcaaaataagtaatacgagcatctttagaatctttattcgctttcaacatatcctgagaaattaaactttttactgctttagttacagctgcctgactaatatttaacttcttagctaaatcagaatttgtcaactgctcttgtgataaaagcatcagaatgtgttcttgcgtattagtcaatttaacatcactttgacaagtaccaaacaataattcatgttgattttctgctttaagcaagatttgactcactaaatggtctaatttttgttctaaaactgtcatatatacctcttttttgttaaccagtaaattatatcacgaagatatagaagaatcaatcatagataggtgaagaagataaaaccttttatctcaacaacctaactttataaacttctttgcaaaaacctttcatactattaaaaacacgatcagcttttttctctgtagaacacattgaaaaaacagttggtccacttcctgtcattaatgcaacatcggctccagaatttaacatacgttcttttattgtacttataactggatttttagtaattgtaatatcctcgagtgaatttcccatagatttgaccattaactgataatctgatgacaaaatagcagactttaataaatcaatatcaactctacttatagacttacaatcaatatctctaaaaatggatttagttgaaataccaaaatccggcttaaccagaactatccaacatggtctcaatgtcggtaagggtttaacaatttcacctttacctaatactaacgaacatcccccaccaagacaataaggaacatcactaccaattttaaaaccaatagcaaccatttcgtcatagtccatttgaagattccataatcgattaagagctcttattgtagcagcagcatcagtagaaccaccccccagtcctgcacagacaggaatggatttttctaatctaatatgaacacctttattaataccatattgatttttgattatatctgcagctttaaacacatcattatcattatttaaaggcattttgctactatcagaatcgataacaatacaatcttcctttagctcagaaatggtaacgtagtcattaagatcaatactaaccataatcatagctaattcatgataaccatcgtcacatcgtcctttaatatctaatcctaaattaagtttggcaggagctttctcaaaaattttcataaaacctccctaataaaatatagaatatccatattataacataacaaatgacaaattcggacaattaagatgctagccaatcttaaggataataattccaataaaaaaaggctaaccaaagttagtctccctttatctactccgccagtaggactcgaacctacgacatcatgattaacagtcatgcgctactaccaactgagctatggcggattatagctaagcgactaccttatctcacagggggcaacccccaactacttccggcgttctagggcttaacttctgtgttcggcatgagaacaggtgtatctcctaggcaattatcacttaactattgagccttattcactcaaaattgaatatctatagtctaacaagaaaccgtaacgttgtcaatatctctttttggataagtcctcgagctattagtattagtccgctaaatgtgtcaccacaattacactcctaacctatctacctgatcatctctcagggctcttactgatataaaatcatgggaaatctcatcttgaggtgggcttcgcacttagatgctttcagcgcttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctacgactgatttccaaccagtctgagggaacctttgggcgcctccgttaccttttaggaggcgaccgccccagtcaaactgcccgtcagacactgtctccgatagggattgcctatctgggttagagtagccataacacaagggtagtatcccaacaacgcctcaaacgaaactggcgtcccgttatcataggctcctacctatcctgtacatgtggtacagatactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgatctaaaatcagcgccccttctcccgaagttacggggccattttgccgagttccttaacgagagttctctcgctcacctgaggctactcgcctcgactacctgtgtcggtttgcggtacgggtagagtatatgtatcgctagaagcttttcttggcagtgtgacatcactaacttcgctactaaacttcgctcctcgtcacagctcaatgttaaagatataagcatttgactcatatcacacctcactgtttgaccagacacttccaatcgtctggtttagttagcctactgcgtccctccatcactatatactctagtacaggaatatcaacctgttgtccatcggatacacctttcggtctctccttaggtcccgactaacccagggcggacgagccttcccctggaaaccttagtcttacggtggacaggattctcacctgtcttgcgctactcataccggcattctcacttctatgcgttccagcgctcctcacggtacaccttcttcacacatagaacgctctcctaccatgacacttttgtgtcatccacagcttcggtaatatgttttagccccggtacattttcggcgcagggtcactcgactagtgagctattacgcactctttgaatgaatagctgcttctaagctaacatcctagttgtctgtgcaaccccacatccttttccacttaacatatattttgggaccttagctggtggtctgggctgtttccctttcgactacggatcttagcactcgcagtctgactgccgattatatctcgttggcattcggagtttatctgagattggtaatccgggatggacccctcacccaaacagtgctctacctccaagagacttaacatcgacgctagccctaaagctatttcggagagaaccagctatctccaagttcgtttggaatttctccgctacccacaagtcatccaagcacttttcaacgtgccctggttcggtcctccagtgagttttacctcaccttcaacctgctcatgggtaggtcacatggtttcgggtctacaacatgatactatgacgccctattaagactcggtttccctacggctccgtctcttcaacttaacctcgcatcatatcgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagagagtatttagggttgggagatggtcctcccagattccgacgagatttcgcgtgtctcgccgtactcaggatactgctaaggttaatctatcattttaaatacgaggctgttactctctttggcttaccttcccaggtaattcttctataatgattaatcctatatcgcagtcctacaaccccgaagtgtaaacacttcggtttgccctcctgccgtttcgctcgccgctactaaggcaatcgcttttgctttctcttcctgcagctacttagatgtttcagttcactgcgtcttccttctcatatccttaacagatatggatactagtcattaactagtgggttcccccattcggacatctctggatcagcgcttacttacagctccccaaagcatttcgtcgttagtcacgtccttcttcggcttctagtgccaaggcatccaccgtgcgcccttattaacttaaccttattaacctagtttctttaaaactagaaaactcattaaatattcacagcgttttcggtttattttcttgttactttctacaatctatttctagatcgtggaatttgatatagatattcaattttcaatgaacaatttgaacctttcgattcaatggagcctagcgggatcgaaccgctgacctcctgcgtgcaaagcaggcgctctcccagctgagctaaggccccacaagacctctcaaaactaaacaagacgcaaatggcaggtttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagattggctttaagagattagcttgccgtcaccggcttgcgactcgttgtaccaaccattgtagcacgtgtgtagcccaggtcataaggggcatgatgatttgacgtcatccccaccttcctccggtttattaccggcagtctcgctagagtgcccaacttaatgatggcaactaacaataggggttgcgctcgttgcgggacttaacccaacatctcacgacacgagctgacgacaaccatgcaccacctgtcacttctgctccgaagagaaagcctatctctaggccggtcagaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaagccccggaaagggcctaacacctagcactcatcgtttacggcgtggactaccagggtatctaatcctgtttgctccccacgctttcgagcctcagcgtcagttacagaccagagagccgctttcgccaccggtgttcctccatatatctacgcatttcaccgctacacatggaattccactctccccttctgcactcaagtcctccagtttccaaagcgtacaatggttaagccactgcctttaacttcagacttaaagaaccgcctgcgctcgctttacgcccaataaatccggacaacgctcgggacctacgtattaccgcggctgctggcacgtagttagccgtccctttctggttagttaccgtcacttggtagattttccactcctaccaacgttcttctctaacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagcctttacctcaccaactagctaatacaacgcaggtccatctcacagtgaagcaattgctccttttaaataactaacatgtgttaattactcttatgcggtattagctatcgtttccaatagttatcccccgctatgaggcaggttacctacgcgttactcacccgttcgcaactcatcagtctagtgtaaacaccaaacctcagcgttctacttgcatgtattaggcacgccgccagcgttcgtcctgagccaggatcaaactctcattaaaagtttgagctttgctcttttctgtctcgctgacagatttattgttttttgtcattgacggatttacaatgtaaatccaccctgcacattcgttcgtcttgttcagttttcaaaggtctttgcctctcttgagacaacttctatattctagcaaacttattctgctttgtcaactactttttttaagttgttaactacgcgctaatagaaactgctctctcgagacaacttatttagtttactacatcatctcttactttgtcaactcttttttcatactttttctacattttctgaaaaaagtttcctgttggctaacaccaataacatagagtttaaaattccatacctaaatttattttattagtaaaaaaataaaagatgggctagccatcttttataatatttgttttttatattcttcagcttcttggggtgtagataaaacaaaatgaccaggggtaatctcgtgcatttgacgttcttgtccgtcttgctcaatagctggattatacggctggtgaacacgttgacgttcactctccggatctggttctggaatagctgataatagactcttcgtataagggtggattggattgttataaacatcatcagatgttccaacttctaacagtttcccccaatgcataacaccgatacgatctgaaatgtattttaccatagacaaatcatgtgcgataaacaaataagtcaatccttgttctctttgcaatttttgcattaaattaacaacttgtgcttggattgaaacatctaaggcagatattggttcatcagcaatgataaatttaggctctactgctaaagcacgtgcaatcccgatacgttgtcgttgtccacctgaaaattcatgcggataacgtgttaaatgatctttatttaaccctacaagatctaatagggcctgaactttactatcacgatctgattttgatttagctaatttatgtatatctaaaccttctgctacgatatcacgaatcttcatacggccgtttaagctagcctgaggatcctgaaaaatcatctgagcgtctttacgaaaactatgtaatgctttacctttcagatgtgagatcacttctccattaaaggtaatttctccatcagaaatatcataaagttttaaaattgaacgtccaacggttgtctttcctgatccagattccccaactaatccaaacacttcaccttcataaatgtcaaaactaacattatcaattgctctcacttcattagcttttcctttattgaaggtcaaagaaacatttttgacttcaactaatttttttcgattttcagtcattaggct

SEQ ID NO: 12023 - DNA, 7250 bp, Streptococcus agalactiae
tttcgagtcaaagtcatcagcgtttactgttacggcagcagttccaagagttactccactcacaaggactgctgataatattctttttttcatttttattaaactactcctttacgataagacattaaatattttaccaaaaaattcacgaaattatattacgtcattgttacatttatatttgaaatcaactatttctaaatgaaccataatcaaatctagaaaacgataaccttcttctattcactctatcaatataattactccatagtgaaactaaaagagaaataaaaaaagagtataattactcttaaaattataatatttacggagaataagggattcgaacccttgcgccagttacccgacctaacgatttagcaaaccgtcctcttcagcctcttgagtaattctccaaattaatattaatgggcacgagtggactcgaaccaccgacctcacgcttatcaggcgtgcgctctaaccacctgagctacgcgcccaagcaaatgcttggttttacttttatgtaaagtaagcgggtgacgagaatcgaactcgcgacaacagcttggaaggctgtagttttaccactaaactacacccgctaaaaacttatataataaatggcgcgagacggaatcgaaccgccgacacatggagcttcaatccattgctctaccaactgagctaccgagcctattgcgggagcaggatttgaacctacgaccttcgggttatgagcccgacgagctacctagctgctccatcccgcgatatctttaaaggaggatgtgggattcgaacccacgcacgcttttacacgcctgacggttttcaagaccgttcccttcagccggacttgggtaatcctccatataacaaaaaatatggaccttgtaggactcgaacctacgaccgctcggttatgagccgagtgctctaaccagttgagctaaaggtccaaagtctcaataaaataaatagcggcggaggggatcgaacccccgacctcccgggtatgaaccggacgctctagccagctgagctacaccgccataaaaatatatccatcgggaagacaggattcgaacctgcgacaccttggtcccaaaccaagtactctaccaagctgagctacttcccgaaaaatatgcaccctagaggagtcgaacctctaaccgcctgattcgtagtcaggtactctatccagttgagctaagggtgctaaatattatatgccgaggaccggaatcgaaccggtacgatgtttaccatcgcaggattttaagtcctgtgcgtctgccagttccgccaccccggcctctaacaagcgaacgacggggttcgaacccgcgaccctcaccttggcaaggtgatgttctaccactgaactacgttcgcactaaagacactatttatcctataaaattgtaatgccggctacatgacttgaacacgcgaccctctgattacaaatcagatgctctaccaactgagctaagccggcaatctactaatgcgggtgaagggacttgaacccccacgccgttaagcgccagatcctaaatctggtgcgtctgccaattccgccacacccgcatttctaaatgacccgtactgggctcgaaccagtgacccattgattaaaagtcaattgctctaccaactgagctaacgagtctacggtcccgacgggaatcgaacccgcgatcttcgccgtgacagggcgacgtgataaccgctacactacgggacctatgggagttaacgggatcgaaccgctgaccctctgcttgtaaggcagatgctctcccagctgagctaaactccctttgctaagcgactaccttatctcacagggggcaacccccaactacttccggcgttctagggcttaacttctgtgttcggcatgagaacaggtgtatctcctaggcaattatcacttaactattgagccttattcactcaaaattgaatatctatagtctaacaagaaaccgtaacgttgtcaatatctctttttggataagtcctcgagctattagtattagtccgctaaatgtgtcaccacaattacactcctaacctatctacctgatcatctctcagggctcttactgatataaaatcatgggaaatctcatcttgaggtgggcttcgcacttagatgctttcagcgcttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctacgactgatttccaaccagtctgagggaacctttgggcgcctccgttaccttttaggaggcgaccgccccagtcaaactgcccgtcagacactgtctccgatagggattgcctatctgggttagagtagccataacacaagggtagtatcccaacaacgcctcaaacgaaactggcgtcccgttatcataggctcctacctatcctgtacatgtggtacagatactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgatctaaaatcagcgccccttctcccgaagttacggggccattttgccgagttccttaacgagagttctctcgctcacctgaggctactcgcctcgactacctgtgtcggtttgcggtacgggtagagtatatgtatcgctagaagcttttcttggcagtgtgacatcactaacttcgctactaaacttcgctcctcgtcacagctcaatgttaaagatataagcatttgactcatatcacacctcactgtttgaccagacacttccaatcgtctggtttagttagcctactgcgtccctccatcactatatactctagtacaggaatatcaacctgttgtccatcggatacacctttcggtctctccttaggtcccgactaacccagggcggacgagccttcccctggaaaccttagtcttacggtggacaggattctcacctgtcttgcgctactcataccggcattctcacttctatgcgttccagcgctcctcacggtacaccttcttcacacatagaacgctctcctaccatgacacttttgtgtcatccacagcttcggtaatatgttttagccccggtacattttcggcgcagggtcactcgactagtgagctattacgcactctttgaatgaatagctgcttctaagctaacatcctagttgtctgtgcaaccccacatccttttccacttaacatatattttgggaccttagctggtggtctgggctgtttccctttcgactacggatcttagcactcgcagtctgactgccgattatatctcgttggcattcggagtttatctgagattggtaatccgggatggacccctcacccaaacagtgctctacctccaagagacttaacatcgacgctagccctaaagctatttcggagagaaccagctatctccaagttcgtttggaatttctccgctacccacaagtcatccaagcacttttcaacgtgccctggttcggtcctccagtgagttttacctcaccttcaacctgctcatgggtaggtcacatggtttcgggtctacaacatgatactatgacgccctattaagactcggtttccctacggctccgtctcttcaacttaacctcgcatcatatcgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagagagtatttagggttgggagatggtcctcccagattccgacgagatttcgcgtgtctcgccgtactcaggatactgctaaggttaatctatcattttaaatacgaggctgttactctctttggcttaccttcccaggtaattcttctataatgattaatcctatatcgcagtcctacaaccccgaagtgtaaacacttcggtttgccctcctgccgtttcgctcgccgctactaaggcaatcgcttttgctttctcttcctgcagctacttagatgtttcagttcactgcgtcttccttctcatatccttaacagatatggatactagtcattaactagtgggttcccccattcggacatctctggatcagcgcttacttacagctccccaaagcatttcgtcgttagtcacgtccttcttcggcttctagtgccaaggcatccaccgtgcgcccttattaacttaaccttattaacctagtttctttaaaactagaaaactcattaaatattcacagcgttttcggtttattttcttgttactttctacaatctatttctagatcgtggaatttgatatagatattcaattttcaatgaacaatttgaacctttcgattcaatggagcctagcgggatcgaaccgctgacctcctgcgtgcaaagcaggcgctctcccagctgagctaaggccccacaagacctctcaaaactaaacaagacgcaaatggcaggtttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagattggctttaagagattagcttgccgtcaccggcttgcgactcgttgtaccaaccattgtagcacgtgtgtagcccaggtcataaggggcatgatgatttgacgtcatccccaccttcctccggtttattaccggcagtctcgctagagtgcccaacttaatgatggcaactaacaataggggttgcgctcgttgcgggacttaacccaacatctcacgacacgagctgacgacaaccatgcaccacctgtcacttctgctccgaagagaaagcctatctctaggccggtcagaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaagccccggaaagggcctaacacctagcactcatcgtttacggcgtggactaccagggtatctaatcctgtttgctccccacgctttcgagcctcagcgtcagttacagaccagagagccgctttcgccaccggtgttcctccatatatctacgcatttcaccgctacacatggaattccactctccccttctgcactcaagtcctccagtttccaaagcgtacaatggttaagccactgcctttaacttcagacttaaagaaccgcctgcgctcgctttacgcccaataaatccggacaacgctcgggacctacgtattaccgcggctgctggcacgtagttagccgtccctttctggttagttaccgtcacttggtagattttccactcctaccaacgttcttctctaacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagcctttacctcaccaactagctaatacaacgcaggtccatctcacagtgaagcaattgctccttttaaataactaacatgtgttaattactcttatgcggtattagctatcgtttccaatagttatcccccgctatgaggcaggttacctacgcgttactcacccgttcgcaactcatcagtctagtgtaaacaccaaacctcagcgttctacttgcatgtattaggcacgccgccagcgttcgtcctgagccaggatcaaactctcattaaaagtttgagctttgctcttttctgtctcgctgacagatttattgttttttgtcattgacggatttacaatgtaaatccaccctgcacattcgttcgtcttgttcagttttcaaaggtctaatgatatatcataaaaatatatccatcgggaagacaggattcgaacctgcgacaccttggtcccaaaccaagtactctaccaagctgagctacttcccgaaaaatatgcaccctagaggagtcgaacctctaaccgcctgattcgtagtcaggtactctatccagttgagctaagggtgctaaatattatatgccgaggaccggaatcgaaccggtacgatgtttaccatcgcaggattttaagtcctgtgcgtctgccagttccgccaccccggcctctaacaagcgaacgacggggttcgaacccgcgaccctcaccttggcaaggtgatgttctaccactgaactacgttcgcactaaagacactatt

SEQ ID NO: 12024 - DNA, 9042 bp, Streptococcus agalactiae
tatcctataaaattgtaatgccggctacatgacttgaacacgcgaccctctgattacaaatcagatgctctaccaactgagctaagccggcaatctactaatgcgggtgaagggacttgaacccccacgccgttaagcgccagatcctaaatctggtgcgtctgccaattccgccacacccgcatttctaaatgacccgtactgggctcgaaccagtgacccattgattaaaagtcaattgctctaccaactgagctaacgagtctacggtcccgacgggaatcgaacccgcgatcttcgccgtgacagggcgacgtgataaccgctacactacgggacctatgggagttaacgggatcgaaccgctgaccctctgcttgtaaggcagatgctctcccagctgagctaaactccctttgctaagcgactaccttatctcacagggggcaacccccaactacttccggcgttctagggcttaacttctgtgttcggcatgagaacaggtgtatctcctaggcaattatcacttaactattgagccttattcactcaaaattgaatatctatagtctaacaagaaaccgtaacgttgtcaatatctctttttggataagtcctcgagctattagtattagtccgctaaatgtgtcaccacaattacactcctaacctatctacctgatcatctctcagggctcttactgatataaaatcatgggaaatctcatcttgaggtgggcttcgcacttagatgctttcagcgcttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctacgactgatttccaaccagtctgagggaacctttgggcgcctccgttaccttttaggaggcgaccgccccagtcaaactgcccgtcagacactgtctccgatagggattgcctatctgggttagagtagccataacacaagggtagtatcccaacaacgcctcaaacgaaactggcgtcccgttatcataggctcctacctatcctgtacatgtggtacagatactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgatctaaaatcagcgccccttctcccgaagttacggggccattttgccgagttccttaacgagagttctctcgctcacctgaggctactcgcctcgactacctgtgtcggtttgcggtacgggtagagtatatgtatcgctagaagcttttcttggcagtgtgacatcactaacttcgctactaaacttcgctcctcgtcacagctcaatgttaaagatataagcatttgactcatatcacacctcactgtttgaccagacacttccaatcgtctggtttagttagcctactgcgtccctccatcactatatactctagtacaggaatatcaacctgttgtccatcggatacacctttcggtctctccttaggtcccgactaacccagggcggacgagccttcccctggaaaccttagtcttacggtggacaggattctcacctgtcttgcgctactcataccggcattctcacttctatgcgttccagcgctcctcacggtacaccttcttcacacatagaacgctctcctaccatgacacttttgtgtcatccacagcttcggtaatatgttttagccccggtacattttcggcgcagggtcactcgactagtgagctattacgcactctttgaatgaatagctgcttctaagctaacatcctagttgtctgtgcaaccccacatccttttccacttaacatatattttgggaccttagctggtggtctgggctgtttccctttcgactacggatcttagcactcgcagtctgactgccgattatatctcgttggcattcggagtttatctgagattggtaatccgggatggacccctcacccaaacagtgctctacctccaagagacttaacatcgacgctagccctaaagctatttcggagagaaccagctatctccaagttcgtttggaatttctccgctacccacaagtcatccaagcacttttcaacgtgccctggttcggtcctccagtgagttttacctcaccttcaacctgctcatgggtaggtcacatggtttcgggtctacaacatgatactatgacgccctattaagactcggtttccctacggctccgtctcttcaacttaacctcgcatcatatcgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagagagtatttagggttgggagatggtcctcccagattccgacgagatttcgcgtgtctcgccgtactcaggatactgctaaggttaatctatcattttaaatacgaggctgttactctctttggcttaccttcccaggtaattcttctataatgattaatcctatatcgcagtcctacaaccccgaagtgtaaacacttcggtttgccctcctgccgtttcgctcgccgctactaaggcaatcgcttttgctttctcttcctgcagctacttagatgtttcagttcactgcgtcttccttctcatatccttaacagatatggatactagtcattaactagtgggttcccccattcggacatctctggatcagcgcttacttacagctccccaaagcatttcgtcgttagtcacgtccttcttcggcttctagtgccaaggcatccaccgtgcgcccttattaacttaaccttattaacctagtttctttaaaactagaaaactcattaaatattcacagcgttttcggtttattttcttgttactttctacaatctatttctagatcgtggaatttgatatagatattcaattttcaatgaacaatttgaacctttcgattcaatggagcctagcgggatcgaaccgctgacctcctgcgtgcaaagcaggcgctctcccagctgagctaaggccccacaagacctctcaaaactaaacaagacgcaaatggcaggtttccttatccttagaaaggaggtgatccagccgcaccttccgatacggctaccttgttacgacttcaccccaatcatctatcccaccttaggcggctggctcctaaaaggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagattggctttaagagattagcttgccgtcaccggcttgcgactcgttgtaccaaccattgtagcacgtgtgtagcccaggtcataaggggcatgatgatttgacgtcatccccaccttcctccggtttattaccggcagtctcgctagagtgcccaacttaatgatggcaactaacaataggggttgcgctcgttgcgggacttaacccaacatctcacgacacgagctgacgacaaccatgcaccacctgtcacttctgctccgaagagaaagcctatctctaggccggtcagaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctgcggcactaagccccggaaagggcctaacacctagcactcatcgtttacggcgtggactaccagggtatctaatcctgtttgctccccacgctttcgagcctcagcgtcagttacagaccagagagccgctttcgccaccggtgttcctccatatatctacgcatttcaccgctacacatggaattccactctccccttctgcactcaagtcctccagtttccaaagcgtacaatggttaagccactgcctttaacttcagacttaaagaaccgcctgcgctcgctttacgcccaataaatccggacaacgctcgggacctacgtattaccgcggctgctggcacgtagttagccgtccctttctggttagttaccgtcacttggtagattttccactcctaccaacgttcttctctaacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagcctttacctcaccaactagctaatacaacgcaggtccatctcacagtgaagcaattgctccttttaaataactaacatgtgttaattactcttatgcggtattagctatcgtttccaatagttatcccccgctatgaggcaggttacctacgcgttactcacccgttcgcaactcatcagtctagtgtaaacaccaaacctcagcgttctacttgcatgtattaggcacgccgccagcgttcgtcctgagccaggatcaaactctcattaaaagtttgagctttgctcttttctgtctcgctgacagatttattgtttttttgtcattgacggatttacaatgtaaatccaccctgcacattcgttcgtcttgttcagttttcaaaggtctttgcctctcttgagacaacttctatattctagcaaacttattctgctttgtcaactacttttttttaagttgttaactacgcgttactagaagctgctctctcgagacaacttattcattatactaaatatttctacttcctgtcaatactatttttgcattttttcttttatttttaaaaagttaatattatttatagtaactaaccttctatacttgttgaatggatagcatttttaccgttgtcatgttcatatttcatcttcttaattcacaaatttaaacttcatcttcataaaaaatacccttcaaattttatctaaatttgaagggtatttgaaatttataaagttctttaaaaatatatgatgacttattttttatcttcttcttgcattttttctttgatttcatcgtatgataacgctcttgctttatcttcatcattttctgtctcaggcattttacctgtctcaaaaatcgatttaatctgagcagcatcaagagtctcatattttaagagggcttctgcaattaatttatgagtatcacggttttcgttgataatatcagctgccttattacgtgcttcattaagaaggtgacgaacttcatcatcaataagttgtgcagtttgagcagaatatgatttttcaggtgacatttgaccagccatcattgcgtggttgccttcgtattgaactggtccaagtttctcgctcataccatattcagttaccatagcgcgggccatagcagtggcttgttcgaagtcatttgaggcacctgttgtctgagcgttgaaaataatttcttccgctacacgtcctcccataagacctgctaattgctctttcatatcatcttttgaaagaagcatttgatcttctttaggtaaagcaatcatatatccacctgcacgaccacgtggtacgatagtaactttatgaacaactcgcgcatttgaaagaatcaaaccgacaattgtgtgcccagcttcatggtaagcaaccatagctctttctctttcagaaatagtacgatcttttttagaaggaccagcaattacacggtcttctgcttcatcaatatctgaagcatcaataacttttttatttcgtcgcgcagcaactaaagcagcttcattgagaacattctccaaatcagcaccaacaaatcctggggtttgttgagctactacttttaagtcaacattatctgctaatggtttatttttagcatgtactctcagaattgcttcacgaccttttacatcaggttgtccaactagaacttttctatcaaaacgtcctggacgcagtaatgcgggatctaacacatcactacggttggtagcagcgataacgataatactttcgtttccttcaaaaccatccatttcaattaaaagttggttgagcgtttgttcacgttcatcgtttccgccacccataccagctccacgtcgacgtccaacagcatcaatttcatcaatgaaaataatagcacgttcagcttttttagcatcttcaaacaaagagcgtactcgactagctccaacaccgacaaacatttcaacaaaatctgaaccggaaatactaaagaatggaacccctgcttcaccggcaacagcttttgctaatagggttttacctgtccctggaggtccttctaatagaacccctgctggaattcgggcacctagagatttatatcgtttaggatctttaaggaagtcaacgacttctattaattcttgcttttcttcctctgctccagcaacatccgaaaatcgaactttaacctcatctttactagatgatcttgctttatttttaccaaagctcatggcaccacgagcgccaccgccaccgccttggttcatcatcatcatgaagaaaccaatcatgataactaaaggtaaaaaactggcaatataagaaatccatgtcccacttgaactttcatgtttgacctgaatattagtgttattttcttcagcagcgctaacaagagattttattgaagagtcatttggtagtataacagaattaaatcctgtaactttagtagcaacactaccacctaaaaaagtaaaactattagctgatttaattgttttggctttcttatatgtcccactaacttcaacaacaccaccacttggctggtatgagatagacttaatttctccagcttttaattgtttaacaagttttgtataagaaatttgctggttttgagagctagttccttttaaatagtattgaaaggttgtaataaccgcaataatcaataatatgtaaataaaggaatttttcagaaaaccattatttttattatttttcatagtttaagagagtaccttttttctattttgagtaaatttcttcttttaacacaccaacataaggtaagttacgatagttttcagcatagtctaaaccgaatcccacaataaattcatttgggatatcgtaacaaacgtaatcagcatcaatatctaccaatcgcccttctggcttatcaaaaagggttgcaactttgacagagttagcttggcgatacttaaacatatctcgaaggtattttaatgtacgtccagtatcaatgatgtcttcaataaagattacatctcttccttcaatgttagtatcaacatcttttaaaattttaacttctccactactagttgtaccaccatgatagcttgaaacaaccataaaatcaatttcaacatgtgtatcaatatgctttaatagctcagccataaaaggcactgacccctttaatacacctactaataatggattcttacctgcataatctgcagttaatttagctcctaattctttcgttttcagaataatatcttcttctgaatataaaactttttttatatcattttcaagcatgatgtcaccttttttctaaattttcaatataaagtttgcccttcattatatcatgttcagaaggttttctcaaatatgttctacctgcaacaatcacaaatatcaactctttattttgctccccaataacagcttcttctctctcttttagagttattttctcatcaataaatagacggcgaatttttttagtgtgatttcctaaaaatatcctatccccttcttttcttcttcttaaaataatcggagaagtatcataaataggaatagtaatgtctgcttgagaaatgaattttccataggaaaataaatattgtgagaatatttgtatattatgcaattctaatcttttttcaaccttaaaactatccgtcttaggatggatttttgtaatatgaaaactctcgtaatccttatgaagaaaatagcccgatttaatagtatagtcaatattggctttagttctaatcaattttaatattactctgaactgttctttactcacttgtaaatctggaaatttgctaatgtaatcttgcaataaaaattcttggacagaatgagtttgccttaaaaaatcatagcagtttgttacttcgatgctccttgttaggtctgttaaagccgtgaataaacactctgtttcctcagagagagttatgagaga

SEQ ID NO: 12025 - protein, 507 aa, Lactobacillus leichmannii
MKSKLKSLITGLIMILPLLLLSFATPQKVSAADTNNSVKVTLHKRVFDSAQEAKQNTGEIMNDFGGTGLNGVTFKAYNVTDHYLSLRKSGDSAQDAVTAIQSDAKDSDNLPSYAGSAIATETTATSKGEDGIAAFDNLNLKDSDGNYQTYLFVETDSPTDVTQQAAPIVLTMPIYKTSDTSAINHDIQIYPKNVKSTPITKDLDEASKKDLAVTLPDGSTIYNAQYGKSFGYNITVNVPWNIKDKDTFNVVDKPDTGIDIDASTVSIDGLTKSTDYTVNKKDNGYQVVFKTTSAAVQALAGKSLTITYKATLTNNATPDKAIGNTATLSIGNGTNITSTPANGPRIYTGGAQFVKKDSQSNKTLAGAEFQLVKVDSNGNIVSYATQASDGSYTWNDSATEATTYTSDANGLVALKGLSYSDKLDSGESYALLEIQAPDGYAKLDSPVKFSITQGSFGDSNKITIDNTKEGLLPSTGGKGIYIFLAIGIVIMIVAFGGYKAIKKHEEI

SEQ ID NO: 12026 - protein, 1585 aa, Streptococcus thermophilus
MKKKETFSLRKYKIGTVSVLLGAVFLFAGAPSVAADELTSLVETKVEATVPDAIVSESASESPVVEELVDTSVEATSTDVTTTDNEEETPGSEALENSANTEVETTQPAVETPAISEKKVEEEEKLSVADETTAITNQEEAKPQNIDSNTIITVPKVWYSGYKGEGTVVAIIDSGLDVDHDVLHISDLSTAKYKSEKEIEAAKEAAGITYGEWFNDKVVFGYNYVDVNTVLKEEDKRSHGMHVTSIATGNPTQPVAGQLMYGVAPEAQVMFMRVFSDLKATTGAALYVKAIEDAVKLGADSINLSLGGANGSVVNMNENVTAAIEAARRAGVSVVIAAGNDGTFGSGHSNPSADYPDYGLVGAPSTAHDAISVASYNNTTVGSKVINIIGLENNADLNYGKSSFDNPEKSPVPFEIGKEYEYVYAGIGQASDFDGLDLTGKLALIKRGTITFSEKIANATAAGAVGVVIFNSRPGEANVSMQLDDTAIAIPSVFIPLEFGEALAANSYKIAFNNETDIRPNPEAGLLSDFSSWGLSADGELKPDLAAPGGAIYAAINDNDYANMQGTSMASPHVAGAAVLVKQYLLATYPTKSPQEIEALVKHLLMSTAKAHVNKETTAYTSPRQQGAGIIDTAAAISTGLYLTGEDGYGSITLGNVEDTFSFTVTLHNITNEDKTLNYSTQLTTDTAQKRIDHLGSTSISRDSWRKVTVKANSSTTVTINVDASSFAEELTGLMKNGYYLEGFVRFTDVADDGDIVSIPYVGFRGEFQNLAVLEEPIYNLIADGKGGFYFEPVTAQPNTVDISHHYTGLVTGSTELIYSTDKRSDSAIKTLGTFKNKAGYFVLELDESGKPHLAISPNGDDNQDSLVFKGVFLRNYTDLVASVYAADDTERTNPLWESQPQSGDKNIYSGNPKNPKSSIIYPTEWNGTDSDGNALADGKYQYVLTYSSKVPGAAVQTMIFDVIIDRESPVITTATYDETNFTFNPRPAIEKGESGLYREQVFYLVADASGVTTIPSLLKNGDVTVSDNKVFVAQNDDGSFTLPLDLADISKFYYTVEDYAGNISYEKVENLISIGNEKGLVTVNILDKDTNSPVPILFSYSVTDETGKIVAELPRYAGDTSVLKLPFGTYTFDLFLYDTEWSSLAGETKAVVTILEDNSTAEVNFYVTLKDKANLLIDIDALLPSGSTIQLVTADGQAIQLPNAKYSKTDYGKFVPVGTYTILPTLPEGYEFLEELDVAVLANQSNVKKLTLINKVALKELIAELAGLEETARYYNASPELQTAYAKALEDANAVYANKHNQAQVDSALASLVAAREQLNGQATDKEKLIAEVSNYTPTQANFIYYNAENTKQIAYDTAVRSAQLVLNQENVTQAVVNQALADLLAAKANLDGQKTDISALRSAVSVSSVLKATDAKYLNASENVKQAYDQAVEAAKAILVDESASQASVDQALAVLTSAQAELDGVATSTNDAKEPANTATDKKDEGTVTPPPIDSEIVDVQAPPVKDTGNSEHVPIGQKPNPQPTLPRPVTLQASLSSPNQEKQVTQLPNTGENDTKYYLVPGVIIGLGTLLVSIRRHKEEV

SEQ ID NO: 12027 - protein, 507 aa, Lactobacillus leichmannii; identical to SEQ ID NO: 12025

SEQ ID NO: 12028 - DNA, 31 bp, Artificial Sequence
  primer
ggggacaagtttgtacaaaaaagcaggctct

SEQ ID NO: 12029 - DNA, 30 bp, Artificial Sequence
  primer
ggggaccactttgtacaagaaagctgggtt
